United States Patent
Krieg et al.

(10) Patent No.: US 10,174,323 B2
(45) Date of Patent: Jan. 8, 2019

(54) COMPOSITIONS AND METHODS FOR MODULATING ATP2A2 EXPRESSION

(71) Applicants: Translate Bio MA, Inc., Lexington, MA (US); The General Hospital Corporation, Boston, MA (US)

(72) Inventors: Arthur M. Krieg, Cambridge, MA (US); Romesh Subramanian, Framingham, MA (US); James McSwiggen, Arlington, MA (US); Jeannie T. Lee, Boston, MA (US)

(73) Assignees: The General Hospital Corporation, Boston, MA (US); Translate Bio MA, Inc., Lexington, MA (US)

( * ) Notice: Subject to any disclaimer, the term of this patent is extended or adjusted under 35 U.S.C. 154(b) by 0 days.

(21) Appl. No.: 14/401,214

(22) PCT Filed: May 16, 2013

(86) PCT No.: PCT/US2013/041381
§ 371 (c)(1),
(2) Date: Nov. 14, 2014

(87) PCT Pub. No.: WO2013/173598
PCT Pub. Date: Nov. 21, 2013

(65) Prior Publication Data
US 2015/0159160 A1 Jun. 11, 2015

Related U.S. Application Data

(60) Provisional application No. 61/785,832, filed on Mar. 14, 2013, provisional application No. 61/647,925, filed on May 16, 2012.

(51) Int. Cl.
| | | |
|---|---|---|
| *C12N 15/113* | (2010.01) | |
| *A61K 31/7125* | (2006.01) | |
| *A61K 31/7115* | (2006.01) | |
| *A61K 31/712* | (2006.01) | |
| *C07H 21/00* | (2006.01) | |
| *C07H 21/02* | (2006.01) | |
| *C07H 21/04* | (2006.01) | |
| *C12N 15/52* | (2006.01) | |

(52) U.S. Cl.
CPC ......... *C12N 15/1137* (2013.01); *C07H 21/00* (2013.01); *C07H 21/02* (2013.01); *C07H 21/04* (2013.01); *C12N 15/52* (2013.01); *C12Y 306/03008* (2013.01); *C12N 2310/11* (2013.01); *C12N 2310/321* (2013.01); *C12N 2310/3231* (2013.01); *C12N 2310/351* (2013.01); *C12N 2310/3513* (2013.01); *C12N 2310/3515* (2013.01); *C12N 2310/3521* (2013.01)

(58) Field of Classification Search
None
See application file for complete search history.

(56) References Cited

U.S. PATENT DOCUMENTS

| | | |
|---|---|---|
| 4,725,677 A | 2/1988 | Köster et al. |
| 5,491,133 A | 2/1996 | Walder et al. |
| 5,576,208 A | 11/1996 | Monia et al. |
| 5,623,065 A | 4/1997 | Cook et al. |
| 5,652,355 A | 7/1997 | Metelev et al. |
| 5,661,134 A | 8/1997 | Cook et al. |
| 5,912,332 A | 6/1999 | Agrawal et al. |
| 5,914,396 A | 6/1999 | Cook et al. |
| 5,919,619 A | 7/1999 | Tullis |
| 5,965,722 A | 10/1999 | Ecker et al. |
| 6,015,710 A | 1/2000 | Shay et al. |
| 6,046,307 A | 4/2000 | Shay et al. |
| 6,063,400 A | 5/2000 | Geho et al. |
| 6,107,094 A | 8/2000 | Crooke |
| 6,143,881 A | 11/2000 | Metelev et al. |
| 6,146,829 A | 11/2000 | Cook et al. |
| 6,197,944 B1 | 3/2001 | Walder et al. |
| 6,210,892 B1 | 4/2001 | Bennett et al. |
| 6,294,650 B1 | 9/2001 | Shay et al. |
| 6,326,199 B1 | 12/2001 | Cook et al. |
| 6,346,614 B1 | 2/2002 | Metelev et al. |
| 6,359,124 B1 | 3/2002 | Ecker et al. |
| 6,395,492 B1 | 5/2002 | Manoharan et al. |
| 6,451,991 B1 | 9/2002 | Martin et al. |
| 6,503,754 B1 | 1/2003 | Zhang et al. |

(Continued)

FOREIGN PATENT DOCUMENTS

| | | |
|---|---|---|
| CA | 2805791 A1 | 1/2012 |
| EP | 1 044 987 A2 | 10/2000 |

(Continued)

OTHER PUBLICATIONS

Taylor et al. Drug Discovery Today 1999, vol. 4, pp. 562-567.*
GenBank accession No. AM911722 [online] submitted Nov. 26, 2007 [retrieved Jul. 11, 2016] Retrieved from the internet: <URL: http://www.ncbi.nlm.nih.gov/nuccore/AM911722>.*
Genbank Submission; NCBI, Accession No. NM_022876.2. Apr. 2010. 5 pages.
Genbank Submission; NIH/NCBI, Accession No. ABZ86223. Nyce et al. Oct. 17, 2003.

(Continued)

*Primary Examiner* — Tracy Vivlemore
(74) *Attorney, Agent, or Firm* — Wolf, Greenfield & Sacks, P.C.

(57) ABSTRACT

Aspects of the invention provide single stranded oligonucleotides for activating or enhancing expression of ATP2A2. Further aspects provide compositions and kits comprising single stranded oligonucleotides for activating or enhancing expression of ATP2A2. Methods for modulating expression of ATP2A2 using the single stranded oligonucleotides are also provided. Further aspects of the invention provide methods for selecting a candidate oligonucleotide for activating or enhancing expression of ATP2A2.

31 Claims, No Drawings
Specification includes a Sequence Listing.

(56) References Cited

U.S. PATENT DOCUMENTS

| | | |
|---|---|---|
| 6,531,584 B1 | 3/2003 | Cook et al. |
| 6,608,035 B1 | 8/2003 | Agrawal et al. |
| 6,677,445 B1 | 1/2004 | Innis et al. |
| 6,727,355 B2 | 4/2004 | Matsuo et al. |
| 6,753,423 B1 | 6/2004 | Cook et al. |
| 6,831,166 B2 | 12/2004 | Manoharan et al. |
| 6,919,439 B2 | 7/2005 | Manoharan et al. |
| 7,015,315 B1 | 3/2006 | Cook et al. |
| 7,041,816 B2 | 5/2006 | Ravikumar et al. |
| 7,045,609 B2 | 5/2006 | Metelev et al. |
| 7,226,785 B2 | 6/2007 | Kmiec et al. |
| 7,374,927 B2 | 5/2008 | Palma et al. |
| 7,449,297 B2 | 11/2008 | Freije et al. |
| 7,501,400 B1 * | 3/2009 | Tachas .......... A61K 31/7105 435/6.11 |
| 7,655,785 B1 | 2/2010 | Bentwich |
| 7,683,036 B2 | 3/2010 | Esau et al. |
| 7,687,616 B1 | 3/2010 | Bentwich et al. |
| 7,687,617 B2 | 3/2010 | Thrue et al. |
| 7,709,456 B2 | 5/2010 | Corey et al. |
| 7,858,592 B2 | 12/2010 | Shames et al. |
| 7,879,992 B2 | 2/2011 | Vickers et al. |
| 7,888,012 B2 | 2/2011 | Iversen et al. |
| 8,092,992 B2 | 1/2012 | Kuwabara et al. |
| 8,129,515 B2 | 3/2012 | Esau et al. |
| 8,153,602 B1 | 4/2012 | Bennett et al. |
| 8,153,606 B2 | 4/2012 | Collard et al. |
| 8,222,221 B2 | 7/2012 | Corey et al. |
| 8,288,354 B2 | 10/2012 | Wahlestedt |
| 8,288,356 B2 | 10/2012 | Obad et al. |
| 8,318,690 B2 | 11/2012 | Collard et al. |
| 8,361,980 B2 | 1/2013 | Kauppinen et al. |
| 8,404,659 B2 | 3/2013 | Kauppinen et al. |
| 8,415,313 B2 | 4/2013 | Mourich et al. |
| 8,846,639 B2 | 9/2014 | Swayze et al. |
| 9,328,346 B2 | 5/2016 | Lee et al. |
| 9,567,581 B2 | 2/2017 | Lee et al. |
| 9,580,708 B2 | 2/2017 | Uhlmann et al. |
| 9,593,330 B2 | 3/2017 | Collard et al. |
| 2002/0160379 A1 | 10/2002 | Cook et al. |
| 2003/0198983 A1 | 10/2003 | Zhou |
| 2003/0208061 A1 * | 11/2003 | Manoharan .......... C07H 21/00 536/25.3 |
| 2003/0219770 A1 | 11/2003 | Eshleman et al. |
| 2003/0228690 A1 | 12/2003 | Baker et al. |
| 2003/0235822 A1 * | 12/2003 | Lokhov .......... C07H 19/06 435/6.18 |
| 2004/0002153 A1 | 1/2004 | Monia et al. |
| 2004/0038274 A1 | 2/2004 | Cook et al. |
| 2004/0096848 A1 | 5/2004 | Thrue et al. |
| 2004/0241651 A1 | 12/2004 | Olek et al. |
| 2004/0248840 A1 | 12/2004 | Hansen et al. |
| 2005/0003369 A1 | 1/2005 | Christians et al. |
| 2005/0026160 A1 * | 2/2005 | Allerson .......... C07H 21/00 435/6.11 |
| 2005/0054836 A1 | 3/2005 | Krainer et al. |
| 2005/0108783 A1 | 5/2005 | Koike |
| 2005/0130924 A1 | 6/2005 | Monia et al. |
| 2005/0164209 A1 | 7/2005 | Bennett et al. |
| 2005/0176025 A1 | 8/2005 | McSwiggen et al. |
| 2005/0203042 A1 | 9/2005 | Frieden et al. |
| 2005/0233455 A1 | 10/2005 | Damha et al. |
| 2005/0244851 A1 | 11/2005 | Blume et al. |
| 2005/0246794 A1 | 11/2005 | Khvorova et al. |
| 2005/0261218 A1 | 11/2005 | Esau et al. |
| 2005/0272080 A1 | 12/2005 | Palma et al. |
| 2005/0287539 A1 | 12/2005 | Labourier |
| 2006/0003322 A1 | 1/2006 | Bentwich |
| 2006/0046260 A1 | 3/2006 | Kriksunov et al. |
| 2006/0128646 A1 | 6/2006 | Christensen et al. |
| 2006/0270624 A1 | 11/2006 | Cook et al. |
| 2007/0032446 A1 | 2/2007 | Cook et al. |
| 2007/0042380 A1 | 2/2007 | Bentwich et al. |
| 2007/0111963 A1 | 5/2007 | Corey et al. |
| 2007/0123484 A1 | 5/2007 | Bhat et al. |
| 2007/0191294 A1 | 8/2007 | Elmen et al. |
| 2007/0219244 A1 | 9/2007 | Jenssen et al. |
| 2007/0269815 A1 | 11/2007 | Rivory et al. |
| 2008/0015162 A1 | 1/2008 | Bhanot et al. |
| 2008/0176793 A1 | 7/2008 | Simons et al. |
| 2008/0194463 A1 | 8/2008 | Weller et al. |
| 2008/0249039 A1 | 10/2008 | Elmen et al. |
| 2008/0293655 A1 | 11/2008 | Aygun et al. |
| 2008/0318895 A1 | 12/2008 | Lee et al. |
| 2009/0053205 A1 * | 2/2009 | Kandimalla ....... A61K 31/7105 424/130.1 |
| 2009/0082297 A1 | 3/2009 | Lioy et al. |
| 2009/0092988 A1 | 4/2009 | Schwartz et al. |
| 2009/0099066 A1 | 4/2009 | Moulton et al. |
| 2009/0099109 A1 | 4/2009 | Shames et al. |
| 2009/0143326 A1 | 6/2009 | Obad et al. |
| 2009/0155910 A1 | 6/2009 | McGonigle |
| 2009/0221685 A1 | 9/2009 | Esau et al. |
| 2009/0258925 A1 | 10/2009 | Wahlestedt |
| 2009/0325868 A1 | 12/2009 | Liu et al. |
| 2009/0326051 A1 | 12/2009 | Corey et al. |
| 2010/0004314 A1 | 1/2010 | Dondero et al. |
| 2010/0105760 A1 | 4/2010 | Collard et al. |
| 2010/0111982 A1 | 5/2010 | Zang et al. |
| 2010/0112042 A1 | 5/2010 | Polisky et al. |
| 2010/0124547 A1 | 5/2010 | Bramlage et al. |
| 2010/0143359 A1 | 6/2010 | Ebert et al. |
| 2010/0197762 A1 | 8/2010 | Swayze et al. |
| 2010/0210707 A1 | 8/2010 | Li et al. |
| 2010/0210712 A1 | 8/2010 | Hansen et al. |
| 2010/0247543 A1 | 9/2010 | Maes et al. |
| 2010/0280100 A1 | 11/2010 | Collard et al. |
| 2010/0286141 A1 | 11/2010 | Durden et al. |
| 2010/0286234 A1 | 11/2010 | Elmen et al. |
| 2010/0317606 A1 | 12/2010 | Chan et al. |
| 2011/0039910 A1 | 2/2011 | Crooke et al. |
| 2011/0054005 A1 * | 3/2011 | Naito ............... A61K 31/713 514/44 A |
| 2011/0077286 A1 | 3/2011 | Damha et al. |
| 2011/0086833 A1 | 4/2011 | Paushkin et al. |
| 2011/0150868 A1 | 6/2011 | Yu et al. |
| 2011/0172292 A1 | 7/2011 | Hansen et al. |
| 2011/0191912 A1 | 8/2011 | Alexandrov |
| 2011/0207217 A1 | 8/2011 | Corey et al. |
| 2011/0237606 A1 | 9/2011 | Chai et al. |
| 2011/0237649 A1 | 9/2011 | Collard et al. |
| 2011/0237650 A1 | 9/2011 | Collard et al. |
| 2011/0237651 A1 | 9/2011 | Collard et al. |
| 2011/0251261 A1 | 10/2011 | Burnett et al. |
| 2011/0263687 A1 | 10/2011 | Mattick et al. |
| 2011/0294870 A1 | 12/2011 | Collard et al. |
| 2011/0319283 A1 | 12/2011 | Thompson |
| 2011/0319317 A1 | 12/2011 | Collard et al. |
| 2011/0319475 A1 | 12/2011 | Collard et al. |
| 2011/0319476 A1 | 12/2011 | Collard et al. |
| 2012/0004184 A1 | 1/2012 | Collard et al. |
| 2012/0004278 A1 | 1/2012 | Chang et al. |
| 2012/0010156 A1 | 1/2012 | Collard et al. |
| 2012/0046236 A1 | 2/2012 | Collard et al. |
| 2012/0046344 A1 | 2/2012 | Collard et al. |
| 2012/0046345 A1 | 2/2012 | Collard et al. |
| 2012/0064048 A1 | 3/2012 | Collard et al. |
| 2012/0071418 A1 | 3/2012 | Copeland et al. |
| 2012/0083596 A1 | 4/2012 | Elmen et al. |
| 2012/0088817 A1 | 4/2012 | Collard et al. |
| 2012/0094934 A1 | 4/2012 | Collard et al. |
| 2012/0095079 A1 | 4/2012 | Collard et al. |
| 2012/0095081 A1 | 4/2012 | Collard et al. |
| 2012/0129917 A1 | 5/2012 | Collard et al. |
| 2012/0135941 A1 | 5/2012 | Collard et al. |
| 2012/0142610 A1 | 6/2012 | Collard et al. |
| 2012/0142758 A1 | 6/2012 | Collard et al. |
| 2012/0149759 A1 | 6/2012 | Collard et al. |
| 2012/0157333 A1 | 6/2012 | Kauppinen et al. |
| 2012/0171170 A1 | 7/2012 | Collard et al. |
| 2012/0252869 A1 | 10/2012 | Collard et al. |
| 2012/0264812 A1 | 10/2012 | Collard et al. |
| 2012/0277290 A1 | 11/2012 | Collard et al. |
| 2012/0288869 A1 | 11/2012 | Schwartz et al. |

(56) References Cited

U.S. PATENT DOCUMENTS

| | | | |
|---|---|---|---|
| 2012/0289581 A1 | 11/2012 | Chang et al. |
| 2012/0289583 A1 | 11/2012 | Collard et al. |
| 2012/0295952 A1 | 11/2012 | Collard et al. |
| 2012/0295953 A1 | 11/2012 | Colalrd et al. |
| 2012/0295954 A1 | 11/2012 | Collard et al. |
| 2012/0295959 A1 | 11/2012 | Collard et al. |
| 2012/0309814 A1 | 12/2012 | Collard et al. |
| 2012/0322851 A1 | 12/2012 | Hardee et al. |
| 2012/0322853 A1 | 12/2012 | Collard et al. |
| 2012/0329727 A1 | 12/2012 | Collard et al. |
| 2012/0329855 A1 | 12/2012 | Collar et al. |
| 2013/0035372 A1 | 2/2013 | Collard et al. |
| 2013/0035373 A1 | 2/2013 | Collard et al. |
| 2013/0053428 A1 | 2/2013 | Wahlestedt |
| 2013/0065947 A1 | 3/2013 | Collard et al. |
| 2013/0072421 A1 | 3/2013 | Collard et al. |
| 2013/0072546 A1 | 3/2013 | Collard et al. |
| 2013/0079505 A1 | 3/2013 | Moeller et al. |
| 2013/0085112 A1 | 4/2013 | Collard et al. |
| 2013/0096183 A1 | 4/2013 | Collard et al. |
| 2013/0164846 A1 | 6/2013 | Saestrom |
| 2013/0184325 A9 | 7/2013 | Collard et al. |
| 2013/0245099 A1 | 9/2013 | Collard et al. |
| 2013/0261065 A1 | 10/2013 | Collard et al. |
| 2014/0142160 A1 | 5/2014 | Lee et al. |
| 2014/0187606 A1 | 7/2014 | Collard et al. |
| 2015/0099791 A1 | 4/2015 | Krieg et al. |
| 2015/0133362 A1 | 5/2015 | Krieg et al. |
| 2015/0133528 A1 | 5/2015 | Krieg et al. |
| 2015/0133529 A1 | 5/2015 | Krieg et al. |
| 2015/0141320 A1 | 5/2015 | Krieg et al. |
| 2015/0152410 A1 | 6/2015 | Krieg et al. |
| 2015/0159161 A1 | 6/2015 | Krieg et al. |
| 2015/0191722 A1 | 7/2015 | Krieg et al. |
| 2015/0218560 A1 | 8/2015 | Krieg et al. |
| 2015/0225717 A1 | 8/2015 | Lee et al. |
| 2016/0222391 A1 | 8/2016 | Krieg et al. |
| 2017/0037396 A1 | 2/2017 | Lee et al. |

FOREIGN PATENT DOCUMENTS

| | | |
|---|---|---|
| EP | 1 752 536 A1 | 5/2005 |
| EP | 13790212.8 | 12/2005 |
| EP | 1 695 979 A2 | 8/2006 |
| EP | 1 957 648 B1 | 11/2006 |
| EP | 1752536 A1 | 2/2007 |
| EP | 1 967 525 A2 | 9/2008 |
| EP | 2 021 472 B1 | 6/2011 |
| EP | 2 023 940 B1 | 6/2011 |
| EP | 2 431 467 A2 | 3/2012 |
| EP | 2 431 467 A3 | 5/2012 |
| EP | 2 591 797 A1 | 5/2013 |
| JP | 04-320700 | 11/1992 |
| JP | 2006-522597 | 10/2006 |
| JP | 2008-044958 A | 2/2008 |
| JP | 2009-536037 | 10/2009 |
| JP | 2010-507579 A | 3/2010 |
| JP | 2010-516256 | 5/2010 |
| JP | 2015-518714 | 7/2015 |
| KR | 10-2011-0050134 | 5/2011 |
| WO | WO 89/05358 A1 | 6/1989 |
| WO | WO 93/13121 A1 | 7/1993 |
| WO | WO 94/02499 A1 | 2/1994 |
| WO | WO 94/17093 A1 | 8/1994 |
| WO | WO 2001/007662 A1 | 2/2001 |
| WO | WO 01/36627 A2 | 5/2001 |
| WO | WO 02/103015 A2 | 12/2002 |
| WO | WO 2004/011613 A2 | 2/2004 |
| WO | WO 2004/092356 A2 | 10/2004 |
| WO | WO 2004/099382 A2 | 11/2004 |
| WO | WO 2004/113867 A2 | 12/2004 |
| WO | WO 2005/042018 A2 | 5/2005 |
| WO | WO 2005/044981 A2 | 5/2005 |
| WO | WO 2005/061710 A1 | 7/2005 |
| WO | WO 2005/089169 A2 | 9/2005 |
| WO | WO 2005/094370 A2 | 10/2005 |
| WO | WO 2006/063356 A1 | 6/2006 |
| WO | WO 2006/130201 A1 | 12/2006 |
| WO | WO 2007/031091 A2 | 3/2007 |
| WO | WO 2007/086990 A2 | 8/2007 |
| WO | WO 2007/086990 A3 | 8/2007 |
| WO | WO 2007/115578 A1 | 10/2007 |
| WO | WO 2007/133812 A2 | 11/2007 |
| WO | WO 2008/024499 A2 | 2/2008 |
| WO | WO 2008/025069 A1 | 3/2008 |
| WO | WO 2008/029619 A1 | 3/2008 |
| WO | WO 2008/061537 A2 | 5/2008 |
| WO | WO 2008/103761 A2 | 8/2008 |
| WO | WO 2008/103763 A2 | 8/2008 |
| WO | WO 2008/113832 A2 | 9/2008 |
| WO | WO 2008/141282 A2 | 11/2008 |
| WO | WO 2009/043353 A2 | 4/2009 |
| WO | WO 2009/046397 A2 | 4/2009 |
| WO | WO 2009/061851 A2 | 5/2009 |
| WO | WO 2009/090182 A1 | 7/2009 |
| WO | WO 2009/124341 A1 | 10/2009 |
| WO | WO 2009/134710 A2 | 11/2009 |
| WO | WO 2009/149182 A1 | 12/2009 |
| WO | WO 2010/000665 A1 | 1/2010 |
| WO | WO 2010/014592 A1 | 2/2010 |
| WO | WO 2010/065671 A2 | 6/2010 |
| WO | WO 2010/065787 A2 | 6/2010 |
| WO | WO 2010/083615 A1 | 7/2010 |
| WO | WO 2010/093860 A2 | 8/2010 |
| WO | WO 2010/093904 A2 | 8/2010 |
| WO | WO 2010/102058 A2 | 9/2010 |
| WO | WO 2010/107733 A2 | 9/2010 |
| WO | WO 2010/129746 A2 | 11/2010 |
| WO | WO 2010/129799 A2 | 11/2010 |
| WO | WO 2010/129861 A2 | 11/2010 |
| WO | WO 2010/135329 A2 | 11/2010 |
| WO | WO 2010/135695 A2 | 11/2010 |
| WO | WO 2010/138806 A2 | 12/2010 |
| WO | WO 2010/148050 A2 | 12/2010 |
| WO | WO 2010/148065 A2 | 12/2010 |
| WO | WO 2010/151671 A2 | 12/2010 |
| WO | WO 2010/151674 A2 | 12/2010 |
| WO | WO 2011/009624 A1 | 1/2011 |
| WO | WO 2011/010706 A1 | 1/2011 |
| WO | WO 2011/017516 A2 | 2/2011 |
| WO | WO 2011/019815 A2 | 2/2011 |
| WO | WO 2011/022606 A2 | 2/2011 |
| WO | WO 2011/025862 A2 | 3/2011 |
| WO | WO 2011/031482 A2 | 3/2011 |
| WO | WO 2011/032109 A1 | 3/2011 |
| WO | WO 2011/038205 A2 | 3/2011 |
| WO | WO 2011/038210 A2 | 3/2011 |
| WO | WO 2011/048125 A1 | 4/2011 |
| WO | WO 2011/079261 A2 | 6/2011 |
| WO | WO 2011/079263 A2 | 6/2011 |
| WO | WO 2011/082409 A2 | 7/2011 |
| WO | WO 2011/084455 A2 | 7/2011 |
| WO | WO 2011/085066 A2 | 7/2011 |
| WO | WO 2011/097388 A1 | 8/2011 |
| WO | WO 2011/097582 A2 | 8/2011 |
| WO | WO 2011/097641 A1 | 8/2011 |
| WO | WO 2011/123745 A2 | 10/2011 |
| WO | WO 2011/139387 A1 | 11/2011 |
| WO | WO 2011/146674 A2 | 11/2011 |
| WO | WO 2011/146675 A2 | 11/2011 |
| WO | WO 2011/150005 A2 | 12/2011 |
| WO | WO 2011/159836 A2 | 12/2011 |
| WO | WO 2011/161460 A2 | 12/2011 |
| WO | WO 2011/163499 A2 | 12/2011 |
| WO | WO 2012/009347 A2 | 1/2012 |
| WO | WO 2012/009402 A2 | 1/2012 |
| WO | WO 2012/018881 A2 | 2/2012 |
| WO | WO 2012/024478 A2 | 2/2012 |
| WO | WO 2012/047956 A2 | 4/2012 |
| WO | WO 2012/054723 A2 | 4/2012 |
| WO | WO 2012/058268 A2 | 5/2012 |
| WO | WO 2012/065143 A1 | 5/2012 |
| WO | WO 2012/068340 A2 | 5/2012 |
| WO | WO 2012/071238 A2 | 5/2012 |

(56) References Cited

FOREIGN PATENT DOCUMENTS

| | | |
|---|---|---|
| WO | WO 2012/087983 A1 | 6/2012 |
| WO | WO 2012/109476 A2 | 8/2012 |
| WO | WO 2012/144220 A1 | 10/2012 |
| WO | WO 2012/170771 A1 | 12/2012 |
| WO | WO 2013/006619 A1 | 1/2013 |
| WO | WO 2013/036403 A1 | 3/2013 |
| WO | WO 2013/040429 A1 | 3/2013 |
| WO | WO 2013/124807 A2 | 8/2013 |
| WO | WO 2013/138374 A2 | 9/2013 |
| WO | WO 2013/173598 A1 | 11/2013 |
| WO | WO 2013/173599 A1 | 11/2013 |
| WO | WO 2013/173601 A1 | 11/2013 |
| WO | WO 2013/173605 A1 | 11/2013 |
| WO | WO 2013/173608 A1 | 11/2013 |
| WO | WO 2013/173635 A1 | 11/2013 |
| WO | WO 2013/173637 A1 | 11/2013 |
| WO | WO 2013/173638 A1 | 11/2013 |
| WO | WO 2013/173645 A1 | 11/2013 |
| WO | WO 2013/173647 A1 | 11/2013 |
| WO | WO 2013/173652 A1 | 11/2013 |
| WO | WO 2014/043544 A1 | 3/2014 |
| WO | WO 2014/076195 A1 | 5/2014 |
| WO | WO 2014/197826 A1 | 12/2014 |
| WO | WO 2015/035476 A1 | 3/2015 |

OTHER PUBLICATIONS

Submission. EBI Accession No. EMBL:GC092872. Palma et al. Aug. 31, 2008.

[No Author Listed] UCSC Genome Browser on Human Feb. 2009 (GRCh37/hg19) Assembly. Retrieved from http://genome.ucsc.edu/cgi-bin/hgTracks?db=hg1 9&position=chr5%3A 702 11 956-7027 1 955&hgsid=452570083 _sxavccF 1dzrwhzM3tcNOyMcxbye 7 on Nov. 9, 2015.

[No Author Listed], New England BioLabs 1998/99 Catalog. 121, 284.

[No Author Listed] Catalogue of Parent of Origin Effects, Imprinted Genes and Related Effects, Parental Origins of de novo Mutations, downloaded at http://igc.otago.ac.nz/home.html on May 22, 2015, 2 pgs.

Buck et al., Design strategies and performance of custom DNA sequencing primers. Biotechniques. Sep. 1999;27(3):528-36.

Crea et al., Pharmacologic disruption of Polycomb Repressive Complex 2 inhibits tumorigenicity and tumor progression in prostate cancer. Mol Cancer. Apr. 18, 2011;10:40. doi: 10.1186/1476-4598-10-40.

Davidovich et al., Toward a consensus on the binding specificity and promiscuity of PRC2 for RNA. Mol Cell. Feb. 5, 2015;57(3):552-8. doi: 10.1016/j.molcel.2014.12.017. Epub Jan. 15, 2015.

Dheda et al., Validation of housekeeping genes for normalizing RNA expression in real-time PCR. Biotechniques. Jul. 2004;37(1):112-4, 116, 118-9.

Dias et al., Antisense oligonucleotides: basic concepts and mechanisms. Mol Cancer Ther. Mar. 2002;1(5):347-55.

Eddy, Non-coding RNA genes and the modern RNA world. Nat Rev Genet. Dec. 2001;2(12):919-29.

Fish et al., Hypoxia-inducible expression of a natural cis-antisense transcript inhibits endothelial nitric-oxide synthase. J Biol Chem. May 25, 2007;282(21):15652-66. Epub Apr. 2, 2007.

Huang, Shoujun et al., Non-encoding RNA and development of animals, Science China Life Science, Dec. 31, 2009; pp. 21-30.

Jackson et al., Expression profiling reveals off-target gene regulation by RNAi. Nat Biotechnol. Jun. 2003;21(6):635-7. Epub May 18, 2003.

Keil et al., A short antisense oligonucleotide ameliorates symptoms of severe mouse models of spinal muscular atrophy. Mol Ther Nucleic Acids. Jul. 8, 2014;3:e174. doi: 10.1038/mtna.2014.23.

Lapointe et al., Gene expression profiling identifies clinically relevant subtypes of prostate cancer. Proc Natl Acad Sci U S A. Jan. 20, 2004;101(3):811-6. Epub Jan. 7, 2004.

Latorra et al., Design considerations and effects of LNA in PCR primers. Mol Cell Probes. Oct. 2003;17(5):253-9.

Niwano et al., Lentiviral vector-mediated SERCA2 gene transfer protects against heart failure and left ventricular remodeling after myocardial infarction in rats. Mol Ther. Jun. 2008;16(6):1026-32. doi: 10.1038/mt.2008.61. Epub Mar. 25, 2008.

Rozen et al., Primer3 on the WWW for general users and for biologist programmers. Methods Mol Biol. 2000;132:365-86.

Schadt et al., An integrative genomics approach to infer causal associations between gene expression and disease. Nat Genet. Jul. 2005;37(7):710-7. Epub Jun. 19, 2005.

Singh et al., A short antisense oligonucleotide masking a unique intronic motif prevents skipping of a critical exon in spinal muscular atrophy. RNA Biol. Jul.-Aug. 2009;6(3):341-50. Epub Jul. 14, 2009.

Varela et al., Natural Antisense Makes Sense for Gene-specific Activation in Brain. Mol Ther Nucleic Acids. May 15, 2012;1:e24. doi: 10.1038/mtna.2012.17.

Venter et al., The sequence of the human genome. Science. Feb. 16, 2001;291(5507):1304-51. Erratum in: Science Jun. 5, 2001;292(5523):1838.

Whitehead et al., Variation in tissue-specific gene expression among natural populations. Genome Biol. 2005;6(2):R13. Epub Jan. 26, 2005.

Yang et al., High fidelity PCR with an off/on switch mediated by proofreading polymerases combining with phosphorothioate-modified primer. Biochem Biophys Res Commun. Mar. 4, 2005;328(1):265-72. Erratum in: Biochem Biophys Res Commun. Jun. 3, 2005;331(2):682. Zhang, Jia [removed]; Li, Kai [removed].

International Preliminary Report on Patentability for Application No. PCT/US2013/041440 dated Nov. 27, 2014.

International Search Report and Written Opinion for Application No. PCT/US2013/041452 dated Jul. 29, 2013.

International Preliminary Report on Patentability for Application No. PCT/US2013/041452 dated Nov. 27, 2014.

International Preliminary Report on Patentability for Application No. PCT/US2013/041382 dated Nov. 27, 2014.

International Search Report and Written Opinion for Application No. PCT/US2013/041381 dated Jul. 29, 2013.

International Preliminary Report on Patentability for Application No. PCT/US2013/041381 dated Nov. 27, 2014.

International Preliminary Report on Patentability for Application No. PCT/US2013/041455 dated Nov. 27, 2014.

International Preliminary Report on Patentability for Application No. PCT/US2013/041389 dated Nov. 27, 2014.

International Preliminary Report on Patentability for Application No. PCT/US2013/041385 dated Nov. 27, 2014.

International Preliminary Report on Patentability for Application No. PCT/US2013/041394 dated Nov. 27, 2014.

International Preliminary Report on Patentability for Application No. PCT/US2013/041434 dated Nov. 27, 2014.

International Preliminary Report on Patentability for Application No. PCT/US2013/041437 dated Nov. 27, 2014.

International Search Report and Written Opinion for Application No. PCT/US2013/041461 dated Aug. 21, 2013.

International Preliminary Report on Patentability for Application No. PCT/US2013/041461 dated Nov. 27, 2014.

International Search Report and Written Opinion for Application No. PCT/US2014/041345 dated Oct. 14, 2014.

Extended European Search Report for Application No. EP 11840099.3 dated Oct. 7, 2014.

International Search Report and Written Opinion for Application No. PCT/US2011/060493 dated Apr. 18, 2012.

European Search Report for Application No. EP 11852141.8 dated Jan. 19, 2015.

International Search Report and Written Opinion for Application No. PCT/US2011/065939 dated Apr. 20, 2012.

GENBANK Submission; NIH/NCBI, Accession No. AA106140. Marra et al., Feb. 4, 1997. 1 page.

GENBANK Submission; NIH/NCBI, Accession No. AL137002. Holt, Dec. 13, 2012. 29 pages.

GENBANK Submission; NIH/NCBI, Accession No. BX383579. Li et al., Dec. 23, 2010. 1 page.

(56) References Cited

OTHER PUBLICATIONS

GENBANK Submission; NIH/NCBI, Accession No. NM_001079668. Young et al., Jan. 18, 2014. 4 pages.
GENBANK Submission; NIH/NCBI, Accession No. NM_003317. Young et al., Jan. 18, 2014. 4 pages.
GENBANK Submission; NIH/NCBI, Accession No. NM_028475. Diez-Roux et al., Feb. 3, 2014. 6 pages.
[No Author Listed], Geneimprint. 2012. http://www.geneimprint.com/site/about-this-site [last accessed May 25, 2015]. 1 page.
[No Author Listed], Imprinted gene. Mosby's Dictionary of Medicine, Nursing and Health Professions. 8th ed. 2009;949.
Ahn et al., Retinoic acid accelerates downregulation of the Xist repressor, Oct. 4, and increases the likelihood of Xist activation when Tsix is deficient. BMC Develop Biol. 2010;10:90. 14 pages.
Astuti et al., Epigenetic alteration at the DLK1-GTL2 imprinted domain in human neoplasia: analysis of neuroblastoma, phaeochromocytoma and Wilms' tumour. Br J Cancer. Apr. 25, 2005;92(8):1574-80.
Beletskii et al., PNA interference mapping demonstrates functional domains in the noncoding RNA Xist. Proc Natl Acad Sci U S A. Jul. 31, 2001;98(16):9215-20.
Bernardi et al., Structure, dynamics and functions of promyelocytic leukaemia nuclear bodies. Nat Rev Mol Cell Biol. Dec. 2007;8(12):1006-16. Review.
Bernstein et al., Mouse polycomb proteins bind differentially to methylated histone H3 and RNA and are enriched in facultative heterochromatin. Mol Cell Biol. Apr. 2006;26(7):2560-9.
Bernstein et al., RNA meets chromatin. Genes Dev. Jul. 15, 2005;19(14):1635-55. Review.
Boyer et al., Polycomb complexes repress developmental regulators in murine embryonic stem cells. Nature. May 18, 2006;441(7091):349-53. Epub Apr. 19, 2006.
Brockdorff et al., The product of the mouse Xist gene is a 15 kb inactive X-specific transcript containing no conserved ORF and located in the nucleus. Cell. Oct. 30, 1992;71(3):515-26.
Brown et al., A gene from the region of the human X inactivation centre is expressed exclusively from the inactive X chromosome. Nature. Jan. 3, 1991;349:38-44.
Brown et al., The Human XIST Gene: Analysis of a 17 kb Inactive X-Specific RNA That Contains Conserved Repeats and Is Highly Localized within the Nucleus. Cell. Oct. 30, 1992;71:527-42.
Carninci et al., The transcriptional landscape of the mammalian genome. Science. Sep. 2, 2005;309(5740):1559-63.
Chahrour et al., MeCP2, a key contributor to neurological disease, activates and represses transcription. Science. May 30, 2008;320(5880):1224-9.
Chen et al., Decoding the function of nuclear long non-coding RNAs. Curr Opin Cell Biol. Jun. 2010;22(3):357-64. doi: 10.1016/j.ceb.2010.03.003. Epub Mar. 29, 2010. Review.
Chow et al., Inducible XIST-dependent X-chromosome inactivation in human somatic cells is reversible. Proc Natl Acad Sci U S A. Jun. 12, 2007;104(24):10104-9. Epub May 30, 2007.
Clark et al., The Reality of Pervasive Transcription. PLOS Bio. Jul. 2011;9(7):e1000625. 6 pages.
Clemson et al., XIST RNA paints the inactive X chromosome at interphase: evidence for a novel RNA involved in nuclear/chromosome structure. J Cell Biol. Feb. 1996;132(3):259-75.
Cohen et al., X-chromosome inactivation and the search for chromosome-wide silencers. Curr Opin Genet Dev. 2002;12:219-24.
Coombes et al., Epigenetic properties and identification of an imprint mark in the Nesp-Gnasxl domain of the mouse Gnas imprinted locus. Mol Cell Biol. Aug. 2003;23(16):5475-88.
Core et al., Nascent RNA sequencing reveals widespread pausing and divergent initiation at human promoters. Science. Dec. 19, 2008;322(5909):1845-8. doi: 10.1126/science.1162228. Epub Dec. 4, 2008.
Costa, Non-coding RNAs: new players in eukaryotic biology. Gene. Sep. 12, 2005;357(2):83-94. Review.
Davidson et al., Singles engage the RNA interference pathway. Cell. Aug. 31, 2012;150(5):8735. doi: 10.1016/j.cell.2012.08.008.

Denisenko et al., Point mutations in the WD40 domain of Eed block its interaction with Ezh2. Mol Cell Biol. Oct. 1998;18(10):5634-42.
Di Certo et al., The artificial gene Jazz, a transcriptional regulator of utrophin, corrects the dystrophic pathology in mdx mice. Hum Mol Genet. Mar. 1, 2010;19(5):752-60. doi: 10.1093/hmg/ddp539. Epub Dec. 4, 2009.
Dinger et al., NRED: A database of long noncoding RNA expression. Nucleic Acids Res. Jan. 2009;37(Database issue):D122-6. doi: 10.1093/nar/gkn617. Epub Oct. 1, 2008.
Duthie et al., Xist RNA exhibits a banded localization on the inactive X chromosome and is excluded from autosomal material in cis. Hum Mol Genet. Feb. 1999;8(2):195-204.
Edwards et al., Mechanisms regulating imprinted genes in clusters. Curr Opin Cell Biol. Jun. 2007;19(3):281-9. Review.
Engström et al., Complex Loci in human and mouse genomes. PLoS Genet. Apr. 2006;2(4):e47. Epub Apr. 28, 2006.
Faghihi et al., Expression of a noncoding RNA is elevated in Alzheimer's disease and drives rapid feed-forward regulation of [beta]-secretase. Nat Med. Jul. 2008;14(7):723-30. doi:10.1038/nm1784. Epub Feb. 23, 2010. 19 pages.
Francis et al., Reconstitution of a functional core polycomb repressive complex. Mol Cell. Sep. 2001;8(3):545-56.
Frieden et al., Expanding the design horizon of antisense oligonucleotides with alpha-L-LNA. Nucleic Acids Res. Nov. 1, 2003;31(21):6365-72.
Froberg et al., Guided by RNAs: X-inactivation as a model for lncRNA function. J Mol Biol. Oct. 9, 2013;425(19):3698-706. doi: 10.1016/j.jmb.2013.06.031. Epub Jun. 28, 2013. Review. 15 pages.
Fu et al., Mir-144 selectively regulates embryonic alpha-hemoglobin synthesis during primitive erythropoiesis. Blood. Feb. 5, 2009;113(6):1340-9.
Golding et al., Depletion of Kcnq1ot1 non-coding RNA does not affect imprinting maintenance in stem cells. Development. 2011;138:3667-8. doi:10.1242/dev.057778.
Gontan et al., Long Noncoding RNAs and X Chromosome Inactivation. Prog Mol Subcell Biol. 2011;51:43-64. doi: 10.1007/978-3-642-16502-3_3.
Guo et al., High resolution genome wide binding event finding and motif discovery reveals transcription factor spatial binding constraints. PLoS Comput Biol. 2012;8(8):e1002638. doi: 10.1371/journal.pcbi.1002638. Epub Aug. 9, 2012.
Gupta et al., Long non-coding RNA HOTAIR reprograms chromatin state to promote cancer metastasis. Nature. Apr. 15, 2010;464(7291):1071-6. doi: 10.1038/nature08975. E-pub version.
Guttman et al., Chromatin signature reveals over a thousand highly conserved large non-coding RNAs in mammals. Nature. Mar. 12, 2009;458(7235):223-7. doi: 10.1038/nature07672. Epub Sep. 30, 2009. 13 pages.
Guttman et al., Modular regulatory principles of large non-coding RNAs. Nature. Feb. 15, 2012;482(7385):339-46. Review.
Hendrich et al., Evolutionary conservation of possible functional domains of the human and murine XIST genes. Human Molec Gen. 1993;2(6):663-72.
Horike et al., Targeted disruption of the human LIT1 locus defines a putative imprinting control element playing an essential role in Beckwith-Wiedemann syndrome. Hum Mol Genet. Sep. 1, 2000;9(14):2075-83.
Inesi et al., Studies of Ca2+ ATPase (SERCA) inhibition. J Bioenerg Biomembr. Dec. 2005;37(6):365-8. Review.
Inouye, Antisense RNA: its functions and applications in gene regulation—a review. Gene. Dec. 10, 1988;72(1-2):25-34.
Jeon et al., YY1 tethers Xist RNA to the inactive X nucleation center. Cell. Jul. 8, 2011;146(1):119-33. doi: 10.1016/j.cell.2011.06.026.
Jepsen et al., Locked nucleic acid: a potent nucleic acid analog in therapeutics and biotechnology. Oligonucleotides. 2004;14(2):130-46. Review.
Jia et al., Genome-wide computational identification and manual annotation of human long noncoding RNA genes. RNA. Aug. 2010;16(8):1478-87. doi: 10.1261/rna.1951310. Epub Jun. 29, 2010.
Johansson et al., Target-specific arrest of mRNA translation by antisense 2'-O-alkyloligoribonucleotides. Nucleic Acids Res. Nov. 11, 1994;22(22):4591-8.

(56) References Cited

OTHER PUBLICATIONS

Johnson, Long non-coding RNAs in Huntington's disease neurodegeneration. Neurobiol Dis. 2012;46:245-54.
Kanduri et al., The length of the transcript encoded from the Kcnq1ot1 antisense promoter determines the degree of silencing. EMBO J. 2006;25:2096-106.
Kanhere et al., Short RNAs are transcribed from repressed polycomb target genes and interact with polycomb repressive complex-2. Mol Cell. Jun. 11, 2010;38(5):675-88. doi: 10.1016/j.molcel.2010.03.019.
Kapranov et al., Genome-wide transcription and the implications for genomic organization. Nat Rev Genet. Jun. 2007;8(6):413-23.
Kapranov et al., RNA maps reveal new RNA classes and a possible function for pervasive transcription. Science. Jun. 8, 2007;316(5830):1484-8.
Khalil et al., Many human large intergenic noncoding RNAs associate with chromatin-modifying complexes and affect gene expression. Proc Natl Acad Sci U S A. Jul. 14, 2009;106(28):11667-72.
Kim et al., Identification of clustered YY1 binding sites in imprinting control regions. Genome Res. Jul. 2006;16(7):901-11. Epub Jun. 7, 2006.
Klein et al., Homeostatic regulation of MeCP2 expression by a CREB-induced microRNA. Nat Neurosci. Dec. 2007;10(12):1513-4.
Krützfeldt et al., Silencing of microRNAs in vivo with 'antagomirs'. Nature. Dec. 1, 2005;438(7068):685-9. Epub Oct. 30, 2005.
Ku et al., Genomewide analysis of PRC1 and PRC2 occupancy identifies two classes of bivalent domains. PLoS Genet. Oct. 2008;4(10):e1000242. doi: 10.1371/journal.pgen.1000242. Epub Oct. 31, 2008. 14 pages.
Lee et al., A 450 kb Transgene Displays Properties of the Mammalian X-Inactivation Center. Cell. Jul. 12, 1996;86:83-94.
Lee et al., Control of developmental regulators by Polycomb in human embryonic stem cells. Cell. Apr. 21, 2006;125(2):301-13.
Lee et al., Genetic analysis of the mouse X inactivation center defines an 80-kb multifunction domain. Proc Natl Acad Sci U S A. Mar. 30, 1999;96(7):3836-41.
Lee et al., Targeted Mutagenesis of Tsix Leads to Nonrandom X Inactivation. Cell. Oct. 1, 1999;99:47-57.
Lee et al., Tsix, a gene antisense to Xist at the X-inactivation centre. Nat Genet. Apr. 1999;21:400-4.
Lee, Disruption of Imprinted X Inactivation by Parent-of-Origin Effects at Tsix. Cell. Sep. 29, 2000;103:17-27.
Lee, Epigenetic regulation by long noncoding RNAs. Science. Dec. 14, 2002;338(6113):1435-9. Review.
Lee, Homozygous Tsix mutant mice reveal a sex-ratio distortion and revert to random X-inactivation. Nat Genet. Sep. 2002;32:195-200.
Lee, Lessons from X-chromosome inactivation: long ncRNA as guides and tethers to the epigenome. Genes Dev. Aug. 15, 2009;23(16):1831-42.doi: 10.1101/gad.1811209.
Lee, The X as a Model for RNA's Niche in Epigenomic Regulation. Cold Spring Harb Perspect Biol. 2010;2:A003749. 12 pages.
Li et al., Jarid2 and PRC2, partners in regulating gene expression. Genes Dev. Feb. 15, 2010;24(4):368-80. doi: 10.1101/gad.1886410. Epub Feb. 1, 2010.
Lima et al., Single-stranded siRNAs activate RNAi in animals. Cell. Aug. 31, 2012;150(5):883-94. doi: 10.1016/j.cell.2012.08.014.
Lin et al., An in-depth map of polyadenylation sites in cancer. Nucleic Acids Res. Sep. 1, 2012;40(17):8460-71. Epub Jun. 29, 2012.
Lin et al., Asymmetric regulation of imprinting on the maternal and paternal chromosomes at the Dlk1-Gtl2 imprinted cluster on mouse chromosome 12. Nat Genet. Sep. 2003;35(1):97-102. Epub Aug. 24, 2003.
Lipovich et al., MacroRNA underdogs in a microRNA world: evolutionary, regulatory, and biomedical significance of mammalian long non-protein-coding RNA. Biochim Biophys Acta. Sep. 2010;1799(9):597-615. Review.
Margueron et al., The Polycomb complex PRC2 and its mark in life. Nature. Jan. 20, 2011;469(7330):343-9. Review.
Mercer et al., Long non-coding RNAs: insights into functions. Nat Rev Genet. Mar. 2009;10(3):155-9. Review.
Mercer et al., Structure and function of long noncoding RNAs in epigenetic regulation. Mar. 5, 2013;20:300-7.
Merienne et al., SCA8 CAG/CTG expansions, a tale of two TOXICities: a unique or common case? PLoS Genet. Aug. 2009;5(8):e1000593. doi: 10.1371/journal.pgen.1000593. Epub Aug. 14, 2009.
Miremadi et al., Cancer genetics of epigenetic genes. Hum Mol Genet. Apr. 15, 2007;16 Spec No. 1:R28-49. Review.
Miura et al., Utrophin upregulation for treating Duchenne or Becker muscular dystrophy: how close are we? Trends Mol Med. Mar. 2006;12(3):122-9. Epub Jan. 27, 2006.
Modarresi et al., Inhibition of natural antisense transcripts in vivo results in gene-specific transcriptional upregulation. Nat Biotechnol. Mar. 25, 2012;30(5):453-9. doi: 10.1038/nbt.2158. 21 pages.
Montgomery et al., the murine polycomb group protein Eed is required for global histone H3 lysine-27 methylation. Curr Biol. May 24, 2005;15(10):942-7.
Morris et al., Small interfering RNA-induced transcriptional gene silencing in human cells. Science. Aug. 27, 2004;305(5688):1289-92. Epub Aug. 5, 2004.
Morris, RNA-mediated transcriptional gene silencing in human cells. Curr Top Microbiol Immunol. 2008;320:211-24. Review.
Munroe, Antisense RNA inhibits splicing of pre-mRNA in vitro. Embo J. Aug. 1988; 7(8):2523-32.
Nagano et al., The Air noncoding RNA epigenetically silences transcription by targeting G9a to chromatin. Science. Dec. 12, 2008;322(5908):1717-20.
Nie et al., Long non-coding RNAs: versatile master regulators of gene expression and crucial players in cancer. Am J Transl Res. 2012;4(2):127-50. Epub Apr. 8, 2012.
Numata et al., Comparative analysis of cis-encoded antisense RNAs in eukaryotes. Gene. May 1, 2007;392(1-2):134-41.
Numata et al., Identification of novel endogenous antisense transcripts by DNA microarray analysis targeting complementary strand of annotated genes. BMC Genomics. Aug. 22, 2009;10:392. doi: 10.1186/1471-2164-10-392.
Okada et al., Comparative expression analysis uncovers novel features of endogenous antisense transcription. Hum Mol Genet. Jun. 1, 2008;17(11):1631-40. doi: 10.1093/hmg/ddn051. Epub Feb. 18, 2008.
Ørom et al., LNA-modified oligonucleotides mediate specific inhibition of microRNA function. Gene. May 10, 2006;372:137-41. Epub Feb. 24, 2006.
Ozsolak et al., Comprehensive polyadenylation site maps in yeast and human reveal pervasive alternative polyadenylation. Cell. Dec. 10, 2010;143(6):1018-29. doi: 10.1016/j.cell.2010.11.020.
Pandey et al., Kcnq1ot1 antisense noncoding RNA mediates lineage-specific transcriptional silencing through chromatin-level regulation. Mol Cell. Oct. 24, 2008;32(2):232-46. doi: 10.1016/j.molcel.2008.08.022.
Paro et al., Extending the frontiers of epigenetic regulation. Curr Opin Genet Dev. Apr. 2010;20(2):107-9. doi: 10.1016/j.gde.2010.03.011.
Pasini et al., Suz12 is essential for mouse development and for EZH2 histone methyltransferase activity. EMBO J. Oct. 13, 2004;23(20):4061-71. Epub Sep. 23, 2004.
Peng et al., Jarid2/Jumonji coordinates control of PRC2 enzymatic activity and target gene occupancy in pluripotent cells. Cell. Dec. 24, 2009;139(7):1290-302. doi: 10.1016/j.cell.2009.12.002. Epub Jul. 29, 2010. 24 pages.
Penny et al., Requirement for Xist in X chromosome inactivation. Nature. Jan. 11, 1996;379(6561):131-7.
Pereira et al., Ezh2, the histone methyltransferase of PRC2, regulates the balance between self-renewal and differentiation in the cerebral cortex. Proc Natl Acad Sci U S A. Sep. 7, 2010;107(36):15957-62. doi: 10.1073/pnas.1002530107. Epub Aug. 23, 2010.
Petersen et al., LNA: a versatile tool for therapeutics and genomics. TRENDS Biotech. Feb. 2003;21(2):74-81. Review.
Pietersen et al., Stem cell regulation by polycomb repressors: postponing commitment. Curr Opin Cell Biol. Apr. 2008;20(2):201-7. doi: 10.1016/j.ceb.2008.01.004. Epub Mar. 4, 2008. Review.

(56) References Cited

OTHER PUBLICATIONS

Plath et al., Role of Histone H3 Lysine 27 Methylation in X Inactivation. Science. Apr. 4, 2003;300:131-5. doi: 10.1126/science.1084274.
Ponting et al., Evolution and functions of long noncoding RNAs. Cell. Feb. 20, 2009;136(4):629-41. doi: 10.1016/j.cell.2009.02.006. Review.
Qi et al., Repurposing CRISPR as an RNA-guided platform for sequence-specific control of gene expression. Cell. Feb. 28, 2013;152(5):1173-83. doi: 10.1016/j.cell.2013.02.022.
Rajasekhar et al., Concise review: roles of polycomb group proteins in development and disease: a stem cell perspective. Stem Cells. Oct. 2007;25(10):2498-510. Epub Jun. 28, 2007. Review.
Redrup et al., The long noncoding RNA Kcnq1ot1 organises a lineage-specific nuclear domain for epigenetic gene silencing. Development. Feb. 2009;136(4):525-30. doi: 10.1242/dev.031328. Epub Jan. 14, 2009. 14 pages.
Ringrose et al., Epigenetic regulation of cellular memory by the Polycomb and Trithorax group proteins. Annu Rev Genet. 2004;38:413-43. Review.
Rinn et al., Functional demarcation of active and silent chromatin domains in human HOX loci by noncoding RNAs. Cell. Jun. 29, 2007;129(7):1311-23.
Rinn et al., Genome Regulation by Long Noncoding RNAs. Annu Rev Biochem. 2012;81:145-66.
Røsok et al., Systematic identification of sense-antisense transcripts in mammalian cells. Nat Biotechnol. Jan. 2004;22(1):104-8. Epub Dec. 14, 2003.
Sankaran et al., MicroRNA-15a and -16-1 act via MYB to elevate fetal hemoglobin expression in human trisomy 13. Proc Natl Acad Sci U S A. Jan. 25, 2011;108(4):1519-24.
Sankaran, Targeted therapeutic strategies for fetal hemoglobin induction. Hematol Am Soc Hematol Educ Program. 2011;2011:459-65.
Sarma et al., Locked nucleic acids (LNAs) reveal sequence requirements and kinetics of Xist RNA localization to the X chromosome. Proc Natl Acad Sci U S A. Dec. 21, 2010;107(51):22196-201. doi: 10.1073/pnas.1009785107. Epub Dec. 6, 2010.
Saxena et al., Long non-coding RNA modifies chromatin. Bioessays. 2011;33:830-9. Review.
Schoeftner et al., Recruitment of PRC1 function at the initiation of X inactivation independent of PRC2 and silencing. EMBO J. Jul. 12, 2006;25(13):3110-22. Epub Jun. 8, 2006.
Schuettengruber et al., Genome regulation by polycomb and trithorax proteins. Cell. Feb. 23, 2007;128(4):735-45.
Schultz et al., Enhancers compete with a long non-coding RNA for regulation of the Kcnq1 domain. Nucl Acids Res. 2015;43(2):745-59.
Schwartz et al., Genome-wide analysis of Polycomb targets in Drosophila melanogaster. Nat Genet. Jun. 2006;38(6):700-5.
Schwartz et al., Polycomb complexes and epigenetic states. Curr Opin Cell Biol. 2008;20:266-73. doi: 10.1016/j.ceb.2008.03.002.
Seong et al., Huntingtin facilitates polycomb repressive complex 2. Hum Mol Genet. Feb. 15, 2010;19(4):573-83. doi: 10.1093/hmg/ddp524. Epub Nov. 23, 2006.
Shaver et al., Origin of the polycomb repressive complex 2 and gene silencing by an E(z) homolog in the unicellular alga Chlamydomonas. Epigenetics. May 16, 2010; 5(4):301-12. Epub May 24, 2010.
Shen et al., EZH1 mediates methylation on histone H3 lysine 27 and complements EZH2 in maintaining stem cell identity and executing pluripotency. Mol Cell. Nov. 21, 2008;32(4):491-502. doi: 10.1016/j.molcel.2008.10.016.
Shen et al., Jumonji modulates polycomb activity and self-renewal versus differentiation of stem cells. Cell. Dec. 24, 2009;139(7):1303-14. doi: 10.1016/j.cell.2009.12.003. Epub Jun. 24, 2010. 26 pages.
Shore et al., Pregnancy-induced noncoding RNA (PINC) associates with polycomb repressive complex 2 and regulates mammary epithelial differentiation. PLoS Genet. 2012;8(7):e1002840. doi: 10.1371/journal.pgen.1002840. Epub Jul. 26, 2012.
Simon et al., High-resolution Xist binding maps reveal two-step spreading during X-chromosome inactivation. Nature. Dec. 19, 2013;504(7480):465-9. doi: 10.1038/nature12719. Epub Oct. 27, 2013.
Simon et al., Roles of the EZH2 histone methyltransferase in cancer epigenetics. Mutat Res. Dec. 1, 2008;647(1-2):21-9. Review.
Sing et al., A vertebrate Polycomb response element governs segmentation of the posterior hindbrain. Cell. Sep. 4, 2009;138(5):885-97. doi: 10.1016/j.cell.2009.08.020.
Sparmann et al., Polycomb silencers control cell fate, development and cancer. Nat Rev Cancer. Nov. 2006;6(11):846-56. Review.
Taft et al., Non-coding RNAs: regulators of disease. J Pathol. Jan. 2010;220(2):126-39. doi: 10.1002/path.2638. Review.
Taft et al., Tiny RNAs associated with transcription start sites in animals. Nat Genet. May 2009;41(5):572-8. doi: 10.1038/ng.312. Epub Apr. 19, 2009. Erratum in: Nat Genet. Jul. 2009;41(7):859.
Takagi et al., Role of Sp1 in transcription of human ATP2A2 gene in keratinocytes. J Invest Dermatol. Jan. 2008;128(1):96-103. Epub Jun. 28, 2007.
Takahashi et al., Deletion of Gtl2, imprinted non-coding RNA, with its differentially methylated region induces lethal parent-origin-dependent defects in mice. Hum Mol Genet. May 15, 2009;18(10):1879-88. doi: 10.1093/hmg/ddp108. Epub Mar. 4, 2009.
Tano et al., MALAT-1 enhances cell motility of lung adenocarcinoma cells by influencing the expression of motility-related genes. FEBS Lett. Nov. 19, 2010;584(22):4575-80. doi: 10.1016/j.febslet.2010.10.008. Epub Oct. 13, 2010.
Thorvaldsen et al., A YY1 bridge for X inactivation. Cell. Jul. 8, 2011;146(1):11-3. doi: 10.1016/j.cell.2011.06.029.
Thorvaldsen et al., SnapShot: imprinted gene clusters. Cell. Sep. 7, 2007;130(5):958.
Tian et al., The long noncoding RNA, Jpx, is a molecular switch for X chromosome inactivation. Cell. Oct. 29, 2010;143(3):390-403. doi: 10.1016/j.cell.2010.09.049. 21 pages.
Tsai et al., Higher order chromatin structure at the X-inactivation center via looping DNA. Dev Biol. Jul. 15, 2008;319(2):416-25. doi: 10.1016/j.ydbio.2008.04.010. Epub Apr. 18, 2008. 22 pages.
Tsai et al., Long noncoding RNA as modular scaffold of histone modification complexes. Science. Aug. 6, 2010;329(5992):689-93. doi: 10.1126/science.1192002. Epub Nov. 2, 2010. 9 pages.
Vickers et al., Fully modified 2' MOE oligonucleotides redirect polyadenylation. Nucleic Acids Res. Mar. 15, 2001;29(6):1293-9.
Wahlestedt, Natural antisense and noncoding RNA transcripts as potential drug targets. Drug Discov Today. Jun. 2006;11(11-12):503-8.
Wahlestedt, Targeting long non-coding RNA to therapeutically upregulate gene expression. Nature Rev Drug Disc. Jun. 2013;12:433-46. Review.
Wan et al., Regulation of imprinting in clusters: noncoding RNAs versus insulators. Adv Genet. 2008;61:207-23. Review.
Wang et al., Long non-coding RNA UCA1a(CUDR) promotes proliferation and tumorigenesis of bladder cancer. Int J Oncol. Jul. 2012;41(1):276-84.
Wang et al., Molecular mechanisms of long noncoding RNAs. Cell Press. Sep. 16, 2011; 43(6):904-14.
Williamson et al., Identification of an imprinting control region affecting the expression of all transcripts in the Gnas cluster. Nat Genet. Mar. 2006;38(3):350-5.
Wilusz et al., A triple helix stabilizes the 3' ends of long noncoding RNAs that lack poly(A) tails. Genes Dev. Nov. 1, 2012;26(21):2392-407. doi: 10.1101/gad.204438.112. Epub Oct. 16, 2012.
Woo et al., A Region of the Human HOXD Cluster that Confers Polycomb-Group Responsiveness. Cell. Jan. 8, 2010;140:99-110.
Wutz et al., A Shift from Reversible to Irreversible X Inactivation Is Triggered during ES Cell Differentiation. Molec Cell. Apr. 2000;5:695-705.
Xiong et al., Polycomb antagonizes p300/CREB-binding protein associated factor to silence FOXP3 in a Kruppel-like factor-dependent manner. J Biol Chem. Oct. 5, 2012;287(41):34372-85. doi: 10.1074/jbc.M111.325332. Epub Aug. 15, 2012.
Yang et al., Long noncoding RNAs: fresh perspectives into the RNA world. Trends Biochem Sci. Jan. 2014;39(1):35-43. doi: 10.1016/j.tibs.2013.10.002. Epub Nov. 27, 2013. Review.

(56) References Cited

OTHER PUBLICATIONS

Yap et al., Molecular interplay of the noncoding RNA ANRIL and methylated histone H3 lysine 27 by polycomb CBX7 in transcriptional silencing of INK4a. Mol Cell. Jun. 11, 2010;38(5):662-74. doi: 10.1016/j.molcel.2010.03.021. Epub Jun. 11, 2011. 23 pages.
Yatsuki et al., Sequence-based structural features between Kvlqt1 and Tapa1 on mouse chromosome 7F4/F5 corresponding to the Beckwith-Wiedemann syndrome region on human 11p15.5: long-stretches of unusually well conserved intronic sequences of kvlqt1 between mouse and human. DNA Res. Jun. 30, 2000;7(3):195-206.
Yu et al., Single-stranded RNAs use RNAi to potently and allele-selectively inhibit mutant huntingtin expression. Cell. Aug. 31, 2012;150(5):895-908. doi: 10.1016/j.cell.2012.08.002.
Zhang et al., Long noncoding RNA-mediated intrachromosomal interactions promote imprinting at the Kcnq1 locus. J Cell Biol. 2014;204(1):61-75.
Zhang et al., NATsDB: Natural Antisense Transcripts DataBase. Nucleic Acids Res. Jan. 2007;35(Database issue):D156-61. Epub Nov. 1, 2006.
Zhang et al., Perinucleolar Targeting of the Inactive X during S Phase: Evidence for a Role in the Maintenance of Silencing. Cell. May 18, 2007;129:693-706.
Zhao et al., Genome-wide identification of polycomb-associated RNAs by RIP-seq. Mol Cell. Dec. 22, 2010;40(6):939-53.
Zhao et al., Polycomb proteins targeted by a short repeat RNA to the mouse X-chromosome. Science. 2008; 322(5902):750-756. doi:10.1126/science.1163045. E-pub version.
[No Author Listed] Locked Nucleic Acid. Exiqon. 2009. Retrieved from http://www.exiqon.com/ls/documents/scientific/lna_folder.pdf on Jun. 6, 2016.
Aartsma-Rus et al., Antisense-induced multiexon skipping for Duchenne muscular dystrophy makes more sense. Am J Hum Genet. Jan. 2004;74(1):83-92.
Bauer et al., The quest for mammalian Polycomb response elements: are we there yet? Chromosoma. Jun. 2016;125(3):471-96. doi:10.1007/s00412-015-0539-4.
Ebralidze et al., PU.1 expression is modulated by the balance of functional sense and antisense RNAs regulated by a shared cis-regulatory element. Genes Dev. Aug. 1, 2008;22(15):2085-92. doi:10.1101/gad.1654808. Supplemental Data.
Gajera et al., Molecular and biochemical characterization of Trichoderma isolates inhibiting a phytopathogenic fungi Aspergillus niger Van Tieghem. Phys Mol Plant Path. 2010;74:274-282.
GENBANK Submission; NCBI, Accession No. AM911724.1; Talwar et al. Nov. 26, 2007.
Hernandez et al., Degradation of nuclease-stabilized RNA oligonucleotides in Mycoplasma-contaminated cell culture media. Nucleic Acid Ther. Feb. 2012;22(1):58-68. doi: 10.1089/nat.2011.0316. Epub Jan. 9, 2012.
Inoue et al., Synthesis and hybridization studies on two complementary nona(2'-O-methyl)ribonucleotides. Nucleic Acids Res. Aug. 11, 1987;15(15):6131-48.
Kierzek et al., The influence of locked nucleic acid residues on the thermodynamic properties of 2'-0-methyl RNA/RNA heteroduplexes. Nucleic Acids Res. Sep. 9, 2005;33(16):5082-93. Print 2005.
Lennox et al., Improved Performance of Anti-miRNA Oligonucleotides Using a Novel Non-Nucleotide Modifier. Mol Ther Nucleic Acids. Aug. 27, 2013;2:e117. doi: 10.1038/mtna.2013.46.
Morse et al., Depleting regulatory T cells with arginine-rich, cell-penetrating, peptide-conjugated morpholino oligomer targeting FOXP3 inhibits regulatory T-cell function. Cancer Gene Ther. Jan. 2012;19(1):30-7. doi: 10.1038/cgt.2011.63.
Nishida et al., Synthesis, RNA selective hybridization and high nuclease resistance of an oligonucleotide containing novel bridged nucleic acid with cyclic urea structure. Chem Commun (Camb). Aug. 7, 2010;46(29):5283-5. doi: 10.1039/c0cc00154f. Epub Jun. 22, 2010.
Schwartz et al., Polycomb silencing mechanisms and the management of genomic programmes. Nat Rev Genet. Jan. 2007;8(1):9-22.
Wilusz et al., Long noncoding RNAs: functional surprises from the RNA world. Genes Dev. Jul. 1, 2009;23(13):1494-504. doi:10.1101/gad.1800909.
Yang et al., The histone code regulating expression of the imprinted mouse Igf2r gene. Endocrinology. Dec. 2003;144(12):5658-70.
U.S. Appl. No. 14/896,537, filed Dec. 7, 2015, Barsoum et al.
U.S. Appl. No. 14/401,194, filed Nov. 14, 2014, Krieg et al.
U.S. Appl. No. 14/401,196, filed Nov. 14, 2014, Krieg et al.
U.S. Appl. No. 14/401,201, filed Nov. 14, 2014, Krieg et al.
U.S. Appl. No. 14/401,223, filed Nov. 14, 2014, Krieg et al.
U.S. Appl. No. 14/401,227, filed Nov. 14, 2014, Krieg et al.
U.S. Appl. No. 14/401,234, filed Nov. 14, 2014, Krieg et al.
U.S. Appl. No. 14/401,237, filed Nov. 14, 2014, Krieg et al.
U.S. Appl. No. 14/401,240, filed Nov. 14, 2014, Krieg et al.
U.S. Appl. No. 14/401,248, filed Nov. 14, 2014, Krieg et al.
U.S. Appl. No. 14/401,252, filed Nov. 14, 2014, Krieg et al.
U.S. Appl. No. 14/691,361, filed Apr. 20, 2015, Krieg et al.
[No Author Listed] Designing Antisense Oligonucleotides. Integrated DNA Technologies. 2011. 1-16.
[No Author Listed] ncRNA. 2011;29(11):1716-1721.
ENCODE Project Consortium. A user's guide to the encyclopedia of DNA elements (ENCODE). PLoS Biol. Apr. 2011;9(4):e1001046. doi: 10.1371/journal.pbio.1001046. Epub Apr. 19, 2011.
GENBANK Submission; Accession No. AM750048. Gupta et al. Jul. 12, 2007.
Alvarez-Salas, Nucleic acids as therapeutic agents. Curr Top Med Chem. 2008;8(15):1379-404.
Behlke et al., Designing antisense oligonucleotides. Integrated DNA Technologies. 2005. 1-17.
Beltran et al., The interaction of PRC2 with RNA or chromatin is mutually antagonistic. Genome Res. Jul. 2016;26(7):896-907. doi:10.1101/gr.197632.115. Epub May 9, 2016.
Braasch et al., Locked nucleic acid (LNA): fine-tuning the recognition of DNA and RNA. Chem Biol. Jan. 2001;8(1):1-7.
Broderick et al., MicroRNA therapeutics. Gene Ther. Dec. 2011;18(12):1104-10. doi: 10.1038/gt.2011.50. Epub Apr. 28, 2011.
Cantàfora et al., Evaluation of RNA messengers involved in lipid trafficking of human intestinal cells by reverse-transcription polymerase chain reaction with competimer technology and microchip electrophoresis. Electrophoresis. Nov. 2003;24(21):3748-54.
Crooke et al., Kinetic characteristics of *Escherichia coli* RNase H1: cleavage of various antisense oligonucleotide-RNA duplexes. Biochem J. Dec. 1, 1995;312 ( Pt 2):599-608.
Cuddapah et al., A novel human polycomb binding site acts as a functional polycomb response element in *Drosophila*. PLoS One. 2012;7(5):e36365. doi: 10.1371./journal.pone.0036365. Epub May 3, 2012.
Cushman et al., Synthesis of the covalent hydrate of the incorrectly assumed structure of aurintricarboxylic acid (ATA). Tetrahedron. 1990;46(5):1491-1498.
Davidovich et al., The recruitment of chromatin modifiers by long noncoding RNAs: lessons from PRC2. RNA. Dec. 2015;21(12):2007-22. doi:10.1261/rna.053918.115.
Ganguli et al., Antagomirbase—A putative antagomir database. Bioinformation. 2011;7(1):41-3.
Halley et al., Natural antisense transcripts as therapeutic targets. Drug Discov Today Ther Strateg. 2013 Fall;10(3):e119-e125.
He et al., Polycomb repressive complex 2 regulates normal development of the mouse heart. Circ Res. Feb. 3, 2012;110(3):406-15. doi: 10.1161/CIRCRESAHA.111.252205. Epub Dec. 8, 2011.
Kalozoumi et al., Glob Cardiol Sci Pract. Jul. 4, 2012; 1(7):1-18.
Kao et al., Tumor necrosis factor-alpha decreases sarcoplasmic reticulum Ca2+-ATPase expressions via the promoter methylation in cardiomyocytes. Crit Care Med. Jan. 2010;38(1):217-22. doi: 10.1097/CCM.0b013e3181b4a854.
Kiss, Small nucleolar RNA-guided post-transcriptional modification of cellular RNAs. EMBO J. Jul. 16, 2001;20(14):3617-22.
Kutyavin et al., Reduced aggregation and improved specificity of G-rich oligodeoxyribonucleotides containing pyrazolo[3,4-d]pyrimidine guanine bases. Nucleic Acids Res. Nov. 15, 2002;30(22):4952-9.

(56) References Cited

OTHER PUBLICATIONS

Li et al., CTCF regulates allelic expression of Igf2 by orchestrating a promoter-polycomb repressive complex 2 intrachromosomal loop. Mol Cell Biol. Oct. 2008;28(20):6473-82. doi: 10.1128/MCB.00204-08. Epub Jul. 28, 2008.

Mencía et al., Mutations in the seed region of human miR-96 are responsible for nonsyndromic progressive hearing loss. Nat Genet. May 2009;41(5):609-13. doi: 10.1038/ng.355. Epub Apr. 12, 2009.

Mendenhall et al., GC-rich sequence elements recruit PRC2 in mammalian ES cells. PLoS Genet. Dec. 9, 2010;6(12):e1001244. doi: 10.1371/journal.pgen.1001244.

Mirguet et al., From ApoAI upregulation to BET family bromodomain inhibition:discovery of I-BET151. Bioorg Med Chem Lett. Apr. 15, 2012;22(8):2963-7. doi:10.1016/j.bmcl.2012.01.125. Epub Feb. 8, 2012.

Nakao, Gene Cluster control through epigenetic mechanisms and cytopathology. Uehara memorial life science foundation research report collection. 23;2009:1-4.

Prensner et al., Transcriptome sequencing across a prostate cancer cohort identifies PCAT-1, an unannotated lincRNA implicated in disease progression. Nat Biotechnol. Jul. 31, 2011;29(8):742-9 doi: 10.1038/nbt.1914.

Rader, Molecular regulation of HDL metabolism and function: implications for novel therapies. J Clin Invest. Dec. 2006;116(12):3090-100.

Schlesinger et al., Polycomb-mediated methylation on Lys27 of histone H3 pre-marks genes for de novo methylation in cancer. Nat Genet. Feb. 2007;39(2):232-6. Epub Dec. 31, 2006.

Summerton, Morpholino antisense oligomers: the case for an Rnase H-independent structural type. Biochim Biophys Acta. Dec. 10, 1999;1489(1):141-58.

Sun et al., Evidence for a preferential targeting of 3'-UTRs by cis-encoded natural antisense transcripts. Nucleic Acids Res. Oct. 4, 2005;33(17):5533-43. Print 2005.

Sun et al., SNPs in human miRNA genes affect biogenesis and function. RNA. Sep. 2009;15(9):1640-51. doi: 10.1261/rna.1560209. Epub Jul. 17, 2009.

Tae et al., Bromodomain protein 7 interacts with PRMT5 and PRC2, and is involved in transcriptional repression of their target genes. Nucleic Acids Res. Jul. 2011;39(13):5424-38. doi: 10.1093/nar/gkr170.

Van Peer et al., miRBase Tracker: keeping track of microRNA annotation changes. Database (Oxford). Aug. 25, 2014;2014. pii:bau080. doi: 10.1093/database/bau080. Print 2014.

Wang et al., Correlation between Dnase I hypersensitive site distribution and gene expression in HeLa S3 cells. PLoS One. 2012;7(8):e42414. doi: 10.1371/journal.pone.0042414. Epub Aug. 10, 2012.

Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.

Wu et al., Binding interactions between long noncoding RNA HOTAIR and PRC2 proteins. Biochemistry. Dec. 31, 2013;52(52):9519-27. doi: 10.1021/bi401085h.

Yakali et al., Supramolecular chirality-sensing DNA-mimicry of a norbornane derivative decorated with isoxazoline and methylpyrrolidine-2,5-dione ring. J Mol Structure. Jun. 10, 2013;1041:164-174.

Zhou et al., Targeting RNA-splicing for SMA treatment. Mol Cells. Mar. 2012;33(3):223-8. doi: 10.1007/s10059-012-0005-6.

Efthymiou et al., Chemical architecture and applications of nucleic acid derivatives containing 1, 2, 3-triazole functionalities synthesized via click chemistry. Molecules. 2012;17(11):12665-12703.

Gooding et al., Oligonucleotide conjugates-Candidates for gene silencing therapeutics. European J Pharmaceutics Biopharmaceutics. 2016;107:321-340. [Epub.]Aug. 10, 2016.

He et al., Conjugation and Evaluation of Triazole-Linked Single Guide RNA for CRISPR-Cas9 Gene Editing, ChemBioChem, 2016;17:1809-1812.

Jayaprakash et al., Non-nucleoside building blocks for copper-assisted and copper-free click chemistry for the efficient synthesis of RNA conjugates. Organic Letters. 2010;12(23): 5410-5413.

Matsuda et al., siRNA conjugates carrying sequentially assembled trivalent N-acetylgalactosamine linked through nucleosides elicit robust gene silencing in vivo in hepatocytes., ACS Chemical Biology. 2015;10:1181-1187.

Nair et al., Multivalent N-acetylgalactosamine-conjugated siRNA localizes in hepatocytes and elicits robust RNAi-mediated gene silencing, J American Chemical Society. 2014;136:16958-16961.

Thomas et al., Development of apolipoprotein B antisense molecules as a therapy for hyperlipidemia. Curr Atheroscler Rep. Jan. 2010;12(1):58-65. doi: 10.1007/s11883-009-0078-7.

\* cited by examiner

COMPOSITIONS AND METHODS FOR MODULATING ATP2A2 EXPRESSION

CROSS-REFERENCE TO RELATED APPLICATIONS

This application is a national stage filing under U.S.C. § 371 of PCT International Application PCT/US2013/041381, with an international filing date of May 16, 2013, which claims the benefit under 35 U.S.C. § 119(e) of U.S. Provisional Application No. 61/785,832, entitled "COMPOSITIONS AND METHODS FOR MODULATING ATP2A2 EXPRESSION", filed Mar. 14, 2013 and U.S. Provisional Application No. 61/647,925, entitled "COMPOSITIONS AND METHODS FOR MODULATING ATP2A2 EXPRESSION", filed May 16, 2012, each of which is incorporated herein by reference in its entirety.

GOVERNMENT SUPPORT

This invention was made with Government support under Grant No. R01-GM-090278 awarded by the National Institutes of Health. The Government has certain rights in the invention.

FIELD OF THE INVENTION

The invention relates to oligonucleotide based compositions, as well as methods of using oligonucleotide based compositions for treating disease.

BACKGROUND OF THE INVENTION

Cardiac disease includes a host of diseases and disorders of the heart, including congenital heart disease, aortic aneurysms, aortic dissections, arrhythmia, cardiomyopathy, and congestive heart failure. Congestive heart failure, in particular, occurs when the heart is unable to maintain an adequate circulation of blood in the tissues of the body or to pump out the venous blood returned to it. This weakening of the heart prevents it from circulating a sufficient quantity of oxygen to the body's tissues. Cardiac diseases that involve contractility, e.g., congestive heart failure, depend on the regulation of the contraction/relaxation cycle of muscle cells in the heart.

ATPase, Ca++ transporting, cardiac muscle, slow twitch 2 (ATP2A2) encodes a sarcoplasmic reticulum Ca++-ATPase (SERCA), which is an intracellular pump located in the sarcoplasmic or endoplasmic reticula of muscle cells. ATP2A2 maintains a low cytoplasmic concentration of Ca2+ ions through hydrolysis of ATP coupled with the translocation of calcium from the cytosol into the sarcoplasmic reticulum lumen. This transport of calcium is important for regulating the contraction/relaxation cycle of muscle cells. Mice harboring mutant forms of ATP2A2 display several cardiac issues due to decreased ATP2A2 activity. Specifically, defects occur in heart rate, cardiac stroke volume, cardiac output, cardiac hypertrophy, and congestive heart failure.

SUMMARY OF THE INVENTION

Aspects of the invention disclosed herein provide methods and compositions that are useful for upregulating ATP2A2 in cells. In some embodiments, single stranded oligonucleotides are provided that target a PRC2-associated region of an ATP2A2 gene (e.g., human ATP2A2) and thereby cause upregulation of the gene. In some embodiments, single stranded oligonucleotides are provided that target a PRC2-associated region of the gene encoding ATP2A2. In some embodiments, these single stranded oligonucleotides activate or enhance expression of ATP2A2 by relieving or preventing PRC2 mediated repression of ATP2A2. Aspects of the invention disclosed herein provide methods and compositions that are useful for upregulating ATP2A2 for the treatment and/or prevention of cardiac diseases, including congenital heart disease, aortic aneurysms, aortic dissections, arrhythmia, cardiomyopathy, and congestive heart failure. ATP2A2 is also associated with Darier-White disease, muscular dystrophy, and Acrokeratosis verruciformis. Accordingly, certain aspects of the invention disclosed herein provide methods and compositions that are useful for upregulating ATP2A2 for the treatment and/or prevention of Darier-White disease, muscular dystrophy or Acrokeratosis verruciformis.

Further aspects of the invention provide methods for selecting oligonucleotides for activating or enhancing expression of ATP2A2. In some embodiments, methods are provided for selecting a set of oligonucleotides that is enriched in candidates (e.g., compared with a random selection of oligonucleotides) for activating or enhancing expression of ATP2A2. Accordingly, the methods may be used to establish sets of clinical candidates that are enriched in oligonucleotides that activate or enhance expression of ATP2A2. Such libraries may be utilized, for example, to identify lead oligonucleotides for developing therapeutics to treat ATP2A2. Furthermore, in some embodiments, oligonucleotide chemistries are provided that are useful for controlling the pharmacokinetics, biodistribution, bioavailability and/or efficacy of the single stranded oligonucleotides for activating expression of ATP2A2.

According to some aspects of the invention single stranded oligonucleotides are provided that have a region of complementarity that is complementarty with (e.g., at least 8 consecutive nucleotides of) a PRC2-associated region of a ATP2A2 gene, e.g., a PRC2-associated region of the nucleotide sequence set forth as SEQ ID NO: 1 or 2. In some embodiments, the oligonucleotide has at least one of the following features: a) a sequence that is 5'X-Y-Z, in which X is any nucleotide and in which X is at the 5' end of the oligonucleotide, Y is a nucleotide sequence of 6 nucleotides in length that is not a human seed sequence of a microRNA, and Z is a nucleotide sequence of 1 to 23 nucleotides in length; b) a sequence that does not comprise three or more consecutive guanosine nucleotides; c) a sequence that has less than a threshold level of sequence identity with every sequence of nucleotides, of equivalent length to the second nucleotide sequence, that are between 50 kilobases upstream of a 5'-end of an off-target gene and 50 kilobases downstream of a 3'-end of the off-target gene; d) a sequence that is complementary to a PRC2-associated region that encodes an RNA that forms a secondary structure comprising at least two single stranded loops; and e) a sequence that has greater than 60% G-C content. In some embodiments, the single stranded oligonucleotide has at least two of features a), b), c), d), and e), each independently selected. In some embodiments, the single stranded oligonucleotide has at least three of features a), b), c), d), and e), each independently selected. In some embodiments, the single stranded oligonucleotide has at least four of features a), b), c), d), and e), each independently selected. In some embodiments, the single stranded oligonucleotide has each of features a), b), c), d), and e). In certain embodiments, the oligonucleotide has the sequence 5'X-Y-Z, in which the oligonucleotide is 8-50 nucleotides in length.

According to some aspects of the invention, single stranded oligonucleotides are provided that have a sequence X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with a PRC2-associated region of ATP2A2 gene, e.g., a PRC2-associated region of the nucleotide sequence set forth as SEQ ID NO: 1 or 2. In some aspects of the invention, single stranded oligonucleotides are provided that have a sequence 5'-X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with at least 8 consecutive nucleotides of a PRC2-associated region of ATP2A2 gene, e.g., a PRC2-associated region of the nucleotide sequence set forth as SEQ ID NO: 1 or 2. In some embodiments, Y is a sequence selected from Table 1. In some embodiments, the PRC2-associated region is a sequence listed in any one of SEQ ID NOS: 5 to 88.

In some embodiments, the single stranded oligonucleotide comprises a nucleotide sequence as set forth in any one of SEQ ID NOS: 89 to 59739, or a fragment thereof that is at least 8 nucleotides. In some embodiments, the single stranded oligonucleotide comprises a nucleotide sequence as set forth in any one of SEQ ID NOS: 89 to 59739, in which the 5' end of the nucleotide sequence provided is the 5' end of the oligonucleotide. In some embodiments, the region of complementarity (e.g., the at least 8 consecutive nucleotides) is also present within the nucleotide sequence set forth as SEQ ID NO: 3 or 4.

In some embodiments, the single stranded oligonucleotide comprises a nucleotide sequence as set forth in any one of SEQ ID NOS: 89 to 59739. In some embodiments, the single stranded oligonucleotide comprises a fragment of at least 8 nucleotides of a nucleotide sequence as set forth in any one of SEQ ID NOS: 89 to 59739.

In some embodiments, the PRC2-associated region is a sequence listed in any one of SEQ ID NOS: 5 to 70. In some embodiments, the single stranded oligonucleotide comprises a nucleotide sequence as set forth in any one of SEQ ID NOS: 89 to 41645 or a fragment thereof that is at least 8 nucleotides. In some embodiments, the single stranded oligonucleotide comprises a nucleotide sequence as set forth in any one of SEQ ID NOS: 89 to 41645, wherein the 5' end of the nucleotide sequence provided in any one of SEQ ID NOS: 89 to 41645 is the 5' end of the oligonucleotide. In some embodiments, the at least 8 consecutive nucleotides are also present within the nucleotide sequence set forth as SEQ ID NO: 3.

In some embodiments, the PRC2-associated region is a sequence listed in any one of SEQ ID NOS: 71 to 88. In some embodiments, the single stranded oligonucleotide comprises a nucleotide sequence as set forth in any one of SEQ ID NOS: 41548 to 59739 or a fragment thereof that is at least 8 nucleotides. In some embodiments, the single stranded oligonucleotide comprises a nucleotide sequence as set forth in any one of SEQ ID NOS: SEQ ID NOS: 41548 to 59739, wherein the 5' end of the nucleotide sequence provided in any one of SEQ ID NOS: SEQ ID NOS: 41548 to 59739 is the 5' end of the oligonucleotide. In some embodiments, the at least 8 consecutive nucleotides are present within the nucleotide sequence set forth as SEQ ID NO: 4.

In some embodiments, a single stranded oligonucleotide comprises a nucleotide sequence as set forth in Table 3. In some embodiments, the single stranded oligonucleotide comprises a fragment of at least 8 nucleotides of a nucleotide sequence as set forth in Table 3. In some embodiments, a single stranded oligonucleotide consists of a nucleotide sequence as set forth in Table 3.

In some embodiments, the single stranded oligonucleotide does not comprise three or more consecutive guanosine nucleotides. In some embodiments, the single stranded oligonucleotide does not comprise four or more consecutive guanosine nucleotides.

In some embodiments, the single stranded oligonucleotide is 8 to 30 nucleotides in length. In some embodiments, the single stranded oligonucleotide is up to 50 nucleotides in length. In some embodiments, the single stranded oligonucleotide is 8 to 10 nucleotides in length and all but 1, 2, or 3 of the nucleotides of the complementary sequence of the PRC2-associated region are cytosine or guanosine nucleotides.

In some embodiments, the single stranded oligonucleotide is complementary with at least 8 consecutive nucleotides of a PRC2-associated region of an ATP2A2 gene, e.g., a PRC2-associated region of a nucleotide sequence set forth as SEQ ID NO: 1 or 2, in which the nucleotide sequence of the single stranded oligonucleotide comprises one or more of a nucleotide sequence selected from the group consisting of (a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxxXXx, (X)XxxxXX, (X)xXxXXx, (X)xXxxXX, (X)xxXxXX, (X)xXxXxX and (X)XxXxXx, (d) (X)xxXXXX, (X)xXxXXX, (X)xXXxXX, (X)xXXXxX, (X)xXXXXx, (X)XxxXXXX, (X)XxXxXX, (X)XxXXxX, (X)XxXXXx, (X)XxXXx, (X)XXxxXX, (X)XXxXxX, (X)XXxXXx, (X)XXXxxX, (X)XXXxXx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, wherein "X" denotes a nucleotide analogue, (X) denotes an optional nucleotide analogue, and "x" denotes a DNA or RNA nucleotide unit.

In some embodiments, at least one nucleotide of the oligonucleotide is a nucleotide analogue. In some embodiments, the at least one nucleotide analogue results in an increase in Tm of the oligonucleotide in a range of 1 to 5° C. compared with an oligonucleotide that does not have the at least one nucleotide analogue.

In some embodiments, at least one nucleotide of the oligonucleotide comprises a 2' O-methyl. In some embodiments, each nucleotide of the oligonucleotide comprises a 2' O-methyl. In some embodiments, the oligonucleotide comprises at least one ribonucleotide, at least one deoxyribonucleotide, or at least one bridged nucleotide. In some embodiments, the bridged nucleotide is a LNA nucleotide, a cEt nucleotide or a ENA modified nucleotide. In some embodiments, each nucleotide of the oligonucleotide is a LNA nucleotide.

In some embodiments, the nucleotides of the oligonucleotide comprise alternating deoxyribonucleotides and 2'-fluoro-deoxyribonucleotides. In some embodiments, the nucleotides of the oligonucleotide comprise alternating deoxyribonucleotides and 2'-O-methyl nucleotides. In some embodiments, the nucleotides of the oligonucleotide comprise alternating deoxyribonucleotides and ENA nucleotide analogues. In some embodiments, the nucleotides of the oligonucleotide comprise alternating deoxyribonucleotides and LNA nucleotides. In some embodiments, the 5' nucleotide of the oligonucleotide is a deoxyribonucleotide. In some embodiments, the nucleotides of the oligonucleotide comprise alternating LNA nucleotides and 2'-O-methyl nucleotides. In some embodiments, the 5' nucleotide of the oligonucleotide is a LNA nucleotide. In some embodiments, the nucleotides of the oligonucleotide comprise deoxyribonucleotides flanked by at least one LNA nucleotide on each of the 5' and 3' ends of the deoxyribonucleotides.

In some embodiments, the single stranded oligonucleotide comprises modified internucleotide linkages (e.g., phosphorothioate internucleotide linkages or other linkages) between at least two, at least three, at least four, at least five or more nucleotides. In some embodiments, the single stranded oligonucleotide comprises modified internucleotide linkages (e.g., phosphorothioate internucleotide linkages or other linkages) between between all nucleotides.

In some embodiments, the nucleotide at the 3' position of the oligonucleotide has a 3' hydroxyl group. In some embodiments, the nucleotide at the 3' position of the oligonucleotide has a 3' thiophosphate. In some embodiments, the single stranded oligonucleotide has a biotin moiety or other moiety conjugated to its 5' or 3' nucleotide. In some embodiments, the single stranded oligonucleotide has cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

According to some aspects of the invention compositions are provided that comprise any of the oligonucleotides disclosed herein, and a carrier. In some embodiments, compositions are provided that comprise any of the oligonucleotides in a buffered solution. In some embodiments, the oligonucleotide is conjugated to the carrier. In some embodiments, the carrier is a peptide. In some embodiments, the carrier is a steroid. According to some aspects of the invention pharmaceutical compositions are provided that comprise any of the oligonucleotides disclosed herein, and a pharmaceutically acceptable carrier.

According to other aspects of the invention, kits are provided that comprise a container housing any of the compositions disclosed herein.

According to some aspects of the invention, methods of increasing expression of ATP2A2 in a cell are provided. In some embodiments, the methods involve delivering any one or more of the single stranded oligonucleotides disclosed herein into the cell. In some embodiments, delivery of the single stranded oligonucleotide into the cell results in a level of expression of ATP2A2 that is greater (e.g., at least 50% greater) than a level of expression of ATP2A2 in a control cell that does not comprise the single stranded oligonucleotide.

According to some aspects of the invention, methods of increasing levels of ATP2A2 in a subject are provided. According to some aspects of the invention, methods of treating a condition (e.g., a cardiac disease) associated with decreased levels of ATP2A2 in a subject are provided. In some embodiments, the methods involve administering any one or more of the single stranded oligonucleotides disclosed herein to the subject.

BRIEF DESCRIPTION OF TABLES

Table 1: Hexamers that are not seed sequences of human miRNAs.
Table 2: A listing of oligonucleotide modifications
Table 3: Formatted oligonucleotide sequences made for testing showing nucleotide modifications. The table shows the sequence of the modified nucleotides, where 1naX represents an LNA nucleotide with 3' phosphorothioate linkage, omeX is a 2'-O-methyl nucleotide, dX is a deoxy nucleotide. An s at the end of a nucleotide code indicates that the nucleotide had a 3' phosphorothioate linkage. The "-Sup" at the end of the sequence marks the fact that the 3' end lacks either a phosphate or thiophosphate on the 3' linkage. The Formatted Sequence column shows the sequence of the oligonucleotide, including modified nucleotides, for the oligonucleotides tested in Table 2.

DETAILED DESCRIPTION OF CERTAIN EMBODIMENTS OF THE INVENTION

Aspects of the invention provided herein relate to the discovery of polycomb repressive complex 2 (PRC2)-interacting RNAs. Polycomb repressive complex 2 (PRC2) is a histone methyltransferase and a known epigenetic regulator involved in silencing of genomic regions through methylation of histone H3. Among other functions, PRC2 interacts with long noncoding RNAs (lncRNAs), such as RepA, Xist, and Tsix, to catalyze trimethylation of histone H3-lysine27. PRC2 contains four subunits, Eed, Suz12, RbAp48, and Ezh2. Aspects of the invention relate to the recognition that single stranded oligonucleotides that bind to PRC2-associated regions of RNAs (e.g., lncRNAs) that are expressed from within a genomic region that encompasses or that is in functional proximity to the ATP2A2 gene can induce or enhance expression of ATP2A2. In some embodiments, this upregulation is believed to result from inhibition of PRC2 mediated repression of ATP2A2.

As used herein, the term "PRC2-associated region" refers to a region of a nucleic acid that comprises or encodes a sequence of nucleotides that interact directly or indirectly with a component of PRC2. A PRC2-associated region may be present in a RNA (e.g., a long non-coding RNA (lncRNA)) that that interacts with a PRC2. A PRC2-associated region may be present in a DNA that encodes an RNA that interacts with PRC2. In some cases, the PRC2-associated region is equivalently referred to as a PRC2-interacting region.

In some embodiments, a PRC2-associated region is a region of an RNA that crosslinks to a component of PRC2 in response to in situ ultraviolet irradiation of a cell that expresses the RNA, or a region of genomic DNA that encodes that RNA region. In some embodiments, a PRC2-associated region is a region of an RNA that immunoprecipitates with an antibody that targets a component of PRC2, or a region of genomic DNA that encodes that RNA region. In some embodiments, a PRC2-associated region is a region of an RNA that immunoprecipitates with an antibody that binds specifically to SUZ12, EED, EZH2 or RBBP4 (which as noted above are components of PRC2), or a region of genomic DNA that encodes that RNA region.

In some embodiments, a PRC2-associated region is a region of an RNA that is protected from nucleases (e.g., RNases) in an RNA-immunoprecipitation assay that employs an antibody that targets a component of PRC2, or a region of genomic DNA that encodes that protected RNA region. In some embodiments, a PRC2-associated region is a region of an RNA that is protected from nucleases (e.g., RNases) in an RNA-immunoprecipitation assay that employs an antibody that targets SUZ12, EED, EZH2 or RBBP4, or a region of genomic DNA that encodes that protected RNA region.

In some embodiments, a PRC2-associated region is a region of an RNA within which occur a relatively high frequency of sequence reads in a sequencing reaction of products of an RNA-immunoprecipitation assay that employs an antibody that targets a component of PRC2, or a region of genomic DNA that encodes that RNA region. In some embodiments, a PRC2-associated region is a region of an RNA within which occur a relatively high frequency of sequence reads in a sequencing reaction of products of an RNA-immunoprecipitation assay that employs an antibody that binds specifically to SUZ12, EED, EZH2 or RBBP4, or a region of genomic DNA that encodes that protected RNA region. In such embodiments, the PRC2-associated region may be referred to as a "peak."

In some embodiments, a PRC2-associated region comprises a sequence of 40 to 60 nucleotides that interact with PRC2 complex. In some embodiments, a PRC2-associated region comprises a sequence of 40 to 60 nucleotides that encode an RNA that interacts with PRC2. In some embodiments, a PRC2-associated region comprises a sequence of up to 5 kb in length that comprises a sequence (e.g., of 40 to 60 nucleotides) that interacts with PRC2. In some embodiments, a PRC2-associated region comprises a sequence of up to 5 kb in length within which an RNA is encoded that has a sequence (e.g., of 40 to 60 nucleotides) that is known to interact with PRC2. In some embodiments, a PRC2-associated region comprises a sequence of about 4 kb in length that comprise a sequence (e.g., of 40 to 60 nucleotides) that interacts with PRC2. In some embodiments, a PRC2-associated region comprises a sequence of about 4 kb in length within which an RNA is encoded that includes a sequence (e.g., of 40 to 60 nucleotides) that is known to interact with PRC2. In some embodiments, a PRC2-associated region has a sequence as set forth in any one of SEQ ID NOS: 5 to 88.

In some embodiments, single stranded oligonucleotides are provided that specifically bind to, or are complementary to, a PRC2-associated region in a genomic region that encompasses or that is in proximity to the ATP2A2 gene. In some embodiments, single stranded oligonucleotides are provided that specifically bind to, or are complementary to, a PRC2-associated region that has a sequence as set forth in any one of SEQ ID NOS: 5 to 88. In some embodiments, single stranded oligonucleotides are provided that specifically bind to, or are complementary to, a PRC2-associated region that has a sequence as set forth in SEQ ID NOs: 5 to 88 combined with up to 2 kb, up to 5 kb, or up to 10 kb of flanking sequences from a corresponding genomic region to which these SEQ IDs map (e.g., in a human genome). In some embodiments, single stranded oligonucleotides have a sequence as set forth in any one of SEQ ID NOS: 89 to 59739. In some embodiments, a single stranded oligonucleotide has a sequence as set forth in Table 3.

Without being bound by a theory of invention, these oligonucleotides are able to interfere with the binding of and function of PRC2, by preventing recruitment of PRC2 to a specific chromosomal locus. For example, a single administration of single stranded oligonucleotides designed to specifically bind a PRC2-associated region lncRNA can stably displace not only the lncRNA, but also the PRC2 that binds to the lncRNA, from binding chromatin. After displacement, the full complement of PRC2 is not recovered for up to 24 hours. Further, lncRNA can recruit PRC2 in a cis fashion, repressing gene expression at or near the specific chromosomal locus from which the lncRNA was transcribed.

Methods of modulating gene expression are provided, in some embodiments, that may be carried out in vitro, ex vivo, or in vivo. It is understood that any reference to uses of compounds throughout the description contemplates use of the compound in preparation of a pharmaceutical composition or medicament for use in the treatment of condition (e.g., a cardiac disease) associated with decreased levels or activity of ATP2A2. Thus, as one nonlimiting example, this aspect of the invention includes use of such single stranded oligonucleotides in the preparation of a medicament for use in the treatment of disease, wherein the treatment involves upregulating expression of ATP2A2.

In further aspects of the invention, methods are provided for selecting a candidate oligonucleotide for activating expression of ATP2A2. The methods generally involve selecting as a candidate oligonucleotide, a single stranded oligonucleotide comprising a nucleotide sequence that is complementary to a PRC2-associated region (e.g., a nucleotide sequence as set forth in any one of SEQ ID NOS: 5 to 88). In some embodiments, sets of oligonucleotides may be selected that are enriched (e.g., compared with a random selection of oligonucleotides) in oligonucleotides that activate expression of ATP2A2.

Single Stranded Oligonucleotides for Modulating Expression of ATP2A2

In one aspect of the invention, single stranded oligonucleotides complementary to the PRC2-associated regions are provided for modulating expression of ATP2A2 in a cell. In some embodiments, expression of ATP2A2 is upregulated or increased. In some embodiments, single stranded oligonucleotides complementary to these PRC2-associated regions inhibit the interaction of PRC2 with long RNA transcripts such that gene expression is upregulated or increased. In some embodiments, single stranded oligonucleotides complementary to these PRC2-associated regions inhibit the interaction of PRC2 with long RNA transcripts, resulting in reduced methylation of histone H3 and reduced gene inactivation, such that gene expression is upregulated or increased. In some embodiments, this interaction may be disrupted or inhibited due to a change in the structure of the long RNA that prevents or reduces binding to PRC2. The oligonucleotide may be selected using any of the methods disclosed herein for selecting a candidate oligonucleotide for activating expression of ATP2A2.

The single stranded oligonucleotide may comprise a region of complementarity that is complementary with a PRC2-associated region of a nucleotide sequence set forth in any one of SEQ ID NOS: 1 to 4. The region of complementarity of the single stranded oligonucleotide may be complementary with at least 6, e.g., at least 7, at least 8, at least 9, at least 10, at least 15 or more consecutive nucleotides of the PRC2-associated region.

The PRC2-associated region may map to a position in a chromosome between 50 kilobases upstream of a 5'-end of the ATP2A2 gene and 50 kilobases downstream of a 3'-end of the ATP2A2 gene. The PRC2-associated region may map to a position in a chromosome between 25 kilobases upstream of a 5'-end of the ATP2A2 gene and 25 kilobases downstream of a 3'-end of the ATP2A2 gene. The PRC2- associated region may map to a position in a chromosome between 12 kilobases upstream of a 5'-end of the ATP2A2 gene and 12 kilobases downstream of a 3'-end of the ATP2A2 gene. The PRC2-associated region may map to a position in a chromosome between 5 kilobases upstream of a 5'-end of the ATP2A2 gene and 5 kilobases downstream of a 3'-end of the ATP2A2 gene.

The genomic position of the selected PRC2-associated region relative to the ATP2A2 gene may vary. For example, the PRC2-associated region may be upstream of the 5' end of the ATP2A2 gene. The PRC2-associated region may be downstream of the 3' end of the ATP2A2 gene. The PRC2-associated region may be within an intron of the ATP2A2 gene. The PRC2-associated region may be within an exon of the ATP2A2 gene. The PRC2-associated region may traverse an intron-exon junction, a 5'-UTR-exon junction or a 3'-UTR-exon junction of the ATP2A2 gene.

The single stranded oligonucleotide may comprise a sequence having the formula X-Y-Z, in which X is any nucleotide, Y is a nucleotide sequence of 6 nucleotides in length that is not a human seed sequence of a microRNA, and Z is a nucleotide sequence of varying length. In some embodiments X is the 5' nucleotide of the oligonucleotide. In some embodiments, when X is anchored at the 5' end of the oligonucleotide, the oligonucleotide does not have any nucleotides or nucleotide analogs linked 5' to X. In some embodiments, other compounds such as peptides or sterols may be linked at the 5' end in this embodiment as long as they are not nucleotides or nucleotide analogs. In some embodiments, the single stranded oligonucleotide has a sequence 5'X-Y-Z and is 8-50 nucleotides in length. Oligonucleotides that have these sequence characteristics are predicted to avoid the miRNA pathway. Therefore, in some embodiments, oligonucleotides having these sequence characteristics are unlikely to have an unintended consequence of functioning in a cell as a miRNA molecule. The Y sequence may be a nucleotide sequence of 6 nucleotides in length set forth in Table 1.

The single stranded oligonucleotide may have a sequence that does not contain guanosine nucleotide stretches (e.g., 3 or more, 4 or more, 5 or more, 6 or more consecutive guanosine nucleotides). In some embodiments, oligonucleotides having guanosine nucleotide stretches have increased non-specific binding and/or off-target effects, compared with oligonucleotides that do not have guanosine nucleotide stretches.

The single stranded oligonucleotide may have a sequence that has less than a threshold level of sequence identity with every sequence of nucleotides, of equivalent length, that map to a genomic position encompassing or in proximity to an off-target gene. For example, an oligonucleotide may be designed to ensure that it does not have a sequence that maps to genomic positions encompassing or in proximity with all known genes (e.g., all known protein coding genes) other than ATP2A2. In a similar embodiment, an oligonucleotide may be designed to ensure that it does not have a sequence that maps to any other known PRC2-associated region, particularly PRC2-associated regions that are functionally related to any other known gene (e.g., any other known protein coding gene). In either case, the oligonucleotide is expected to have a reduced likelihood of having off-target effects. The threshold level of sequence identity may be 50%, 60%, 70%, 80%, 85%, 90%, 95%, 99% or 100% sequence identity.

The single stranded oligonucleotide may have a sequence that is complementary to a PRC2-associated region that encodes an RNA that forms a secondary structure comprising at least two single stranded loops. In has been discovered that, in some embodiments, oligonucleotides that are complementary to a PRC2-associated region that encodes an RNA that forms a secondary structure comprising one or more single stranded loops (e.g., at least two single stranded loops) have a greater likelihood of being active (e.g., of being capable of activating or enhancing expression of a target gene) than a randomly selected oligonucleotide. In some cases, the secondary structure may comprise a double stranded stem between the at least two single stranded loops. Accordingly, the region of complementarity between the oligonucleotide and the PRC2-associated region may be at a location of the PRC2 associated region that encodes at least a portion of at least one of the loops. In some cases, the region of complementarity between the oligonucleotide and the PRC2-associated region may be at a location of the PRC2-associated region that encodes at least a portion of at least two of the loops. In some cases, the region of complementarity between the oligonucleotide and the PRC2-associated region may be at a location of the PRC2 associated region that encodes at least a portion of the double stranded stem. In some embodiments, a PRC2-associated region (e.g., of an lncRNA) is identified (e.g., using RIP-Seq methodology or information derived therefrom). In some embodiments, the predicted secondary structure RNA (e.g., lncRNA) containing the PRC2-associated region is determined using RNA secondary structure prediction algorithms, e.g., RNAfold, mfold. In some embodiments, oligonucleotides are designed to target a region of the RNA that forms a secondary structure comprising one or more single stranded loop (e.g., at least two single stranded loops) structures which may comprise a double stranded stem between the at least two single stranded loops.

The single stranded oligonucleotide may have a sequence that is has greater than 30% G-C content, greater than 40% G-C content, greater than 50% G-C content, greater than 60% G-C content, greater than 70% G-C content, or greater than 80% G-C content. The single stranded oligonucleotide may have a sequence that has up to 100% G-C content, up to 95% G-C content, up to 90% G-C content, or up to 80% G-C content. In some embodiments in which the oligonucleotide is 8 to 10 nucleotides in length, all but 1, 2, 3, 4, or 5 of the nucleotides of the complementary sequence of the PRC2-associated region are cytosine or guanosine nucleotides. In some embodiments, the sequence of the PRC2-associated region to which the single stranded oligonucleotide is complementary comprises no more than 3 nucleotides selected from adenine and uracil.

The single stranded oligonucleotide may be complementary to a chromosome of a different species (e.g., a mouse, rat, rabbit, goat, monkey, etc.) at a position that encompasses or that is in proximity to that species' homolog of ATP2A2. The single stranded oligonucleotide may be complementary to a human genomic region encompassing or in proximity to the ATP2A2 gene and also be complementary to a mouse genomic region encompassing or in proximity to the mouse homolog of ATP2A2. For example, the single stranded oligonucleotide may be complementary to a sequence as set forth in SEQ ID NO: 1 or 2, which is a human genomic region encompassing or in proximity to the ATP2A2 gene, and also be complementary to a sequence as set forth in SEQ ID NO: 3 or 4, which is a mouse genomic region encompassing or in proximity to the mouse homolog of the ATP2A2 gene. Oligonucleotides having these characteristics may be tested in vivo or in vitro for efficacy in multiple species (e.g., human and mouse). This approach also facilitates development of clinical candidates for treating human disease by selecting a species in which an appropriate animal exists for the disease.

In some embodiments, the region of complementarity of the single stranded oligonucleotide is complementary with at least 8 to 15, 8 to 30, 8 to 40, or 10 to 50, or 5 to 50, or 5 to 40 bases, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of a PRC2-associated region. In some embodiments, the region of complementarity is complementary with at least 8 consecutive nucleotides of a PRC2-associated region. In some embodiments the sequence of the single stranded oligonucleotide is based on an RNA sequence that binds to PRC2, or a portion thereof, said portion having a length of from 5 to 40 contiguous base pairs, or about 8 to 40 bases, or about 5 to 15, or about 5 to 30, or about 5 to 40 bases, or about 5 to 50 bases.

Complementary, as the term is used in the art, refers to the capacity for precise pairing between two nucleotides. For example, if a nucleotide at a certain position of an oligonucleotide is capable of hydrogen bonding with a nucleotide at the same position of PRC2-associated region, then the single stranded nucleotide and PRC2-associated region are considered to be complementary to each other at that position. The single stranded nucleotide and PRC2-associated region are complementary to each other when a sufficient number of corresponding positions in each molecule are occupied by nucleotides that can hydrogen bond with each other through their bases. Thus, "complementary" is a term which is used to indicate a sufficient degree of complementarity or precise pairing such that stable and specific binding occurs between the single stranded nucleotide and PRC2-associated region. For example, if a base at one position of a single stranded nucleotide is capable of hydrogen bonding with a base at the corresponding position of a PRC2-associated region, then the bases are considered to be complementary to each other at that position. 100% complementarity is not required.

The single stranded oligonucleotide may be at least 80% complementary to (optionally one of at least 85%, 90%, 91%, 92%, 93%, 94%, 95%, 96%, 97%, 98%, 99% or 100% complementary to) the consecutive nucleotides of a PRC2-associated region. In some embodiments the single stranded oligonucleotide may contain 1, 2 or 3 base mismatches compared to the portion of the consecutive nucleotides of a PRC2-associated region. In some embodiments the single stranded oligonucleotide may have up to 3 mismatches over 15 bases, or up to 2 mismatches over 10 bases.

It is understood in the art that a complementary nucleotide sequence need not be 100% complementary to that of its target to be specifically hybridizable. In some embodiments, a complementary nucleic acid sequence for purposes of the present disclosure is specifically hybridizable when binding of the sequence to the target molecule (e.g., lncRNA) interferes with the normal function of the target (e.g., lncRNA) to cause a loss of activity (e.g., inhibiting PRC2-associated repression with consequent up-regulation of gene expression) and there is a sufficient degree of complementarity to avoid non-specific binding of the sequence to non-target sequences under conditions in which avoidance of non-specific binding is desired, e.g., under physiological conditions in the case of in vivo assays or therapeutic treatment, and in the case of in vitro assays, under conditions in which the assays are performed under suitable conditions of stringency.

In some embodiments, the single stranded oligonucleotide is 7, 8, 9, 10, 11, 12, 13, 14, 15, 16, 17, 18, 19, 20, 21, 22, 23, 24, 25, 26, 27, 28, 29, 30, 35, 40, 45, 50 or more nucleotides in length. In a preferred embodiment, the oligonucleotide is 8 to 30 nucleotides in length.

In some embodiments, the PRC2-associated region occurs on the same DNA strand as a gene sequence (sense). In some embodiments, the PRC2-associated region occurs on the opposite DNA strand as a gene sequence (anti-sense). Oligonucleotides complementary to a PRC2-associated region can bind either sense or anti-sense sequences. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A, C, U, or T. Inosine (I) has also been considered in the art to be a universal base and is considered complementary to any A, C, U or T.

In some embodiments, any one or more thymidine (T) nucleotides (or modified nucleotide thereof) or uridine (U) nucleotides (or a modified nucleotide thereof) in a sequence provided herein, including a sequence provided in the sequence listing, may be replaced with any other nucleotide suitable for base pairing (e.g., via a Watson-Crick base pair) with an adenosine nucleotide. In some embodiments, any one or more thymidine (T) nucleotides (or modified nucleotide thereof) or uridine (U) nucleotides (or a modified nucleotide thereof) in a sequence provided herein, including a sequence provided in the sequence listing, may be suitably replaced with a different pyrimidine nucleotide or vice versa. In some embodiments, any one or more thymidine (T) nucleotides (or modified nucleotide thereof) in a sequence provided herein, including a sequence provided in the sequence listing, may be suitably replaced with a uridine (U) nucleotide (or a modified nucleotide thereof) or vice versa.

In some embodiments, GC content of the single stranded oligonucleotide is preferably between about 30-60%. Contiguous runs of three or more Gs or Cs may not be preferable in some embodiments. Accordingly, in some embodiments, the oligonucleotide does not comprise a stretch of three or more guanosine nucleotides.

In some embodiments, the single stranded oligonucleotide specifically binds to, or is complementary to an RNA that is encoded in a genome (e.g., a human genome) as a single contiguous transcript (e.g., a non-spliced RNA). In some embodiments, the single stranded oligonucleotide specifically binds to, or is complementary to an RNA that is encoded in a genome (e.g., a human genome), in which the distance in the genome between the 5'end of the coding region of the RNA and the 3' end of the coding region of the RNA is less than 1 kb, less than 2 kb, less than 3 kb, less than 4 kb, less than 5 kb, less than 7 kb, less than 8 kb, less than 9 kb, less than 10 kb, or less than 20 kb.

It is to be understood that any oligonucleotide provided herein can be excluded. In some embodiments, it has been found that single stranded oligonucleotides disclosed herein may increase expression of mRNA corresponding to a target gene by at least about 50% (i.e. 150% of normal or 1.5 fold), or by about 2 fold to about 5 fold. In some embodiments, expression may be increased by at least about 15 fold, 20 fold, 30 fold, 40 fold, 50 fold or 100 fold, or any range between any of the foregoing numbers. It has also been found that increased mRNA expression has been shown to correlate to increased protein expression.

In some or any of the embodiments of the oligonucleotides described herein, or processes for designing or synthesizing them, the oligonucleotides will upregulate gene expression and may specifically bind or specifically hybridize or be complementary to the PRC2 binding RNA that is transcribed from the same strand as a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding sense strand of a reference gene (refGene).

In some or any of the embodiments of oligonucleotides described herein, or processes for designing or synthesizing them, the oligonucleotides will upregulate gene expression and may specifically bind or specifically hybridize or be complementary to a PRC2 binding RNA that transcribed from the opposite strand (the antisense strand) of a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding antisense strand of a reference gene The oligonucleotides described herein may be modified, e.g., comprise a modified sugar moiety, a modified internucleoside linkage, a modified nucleotide and/or combinations thereof. In addition, the oligonucleotides can exhibit one or more of the following properties: do not induce substantial cleavage or degradation of the target RNA; do not cause substantially complete cleavage or degradation of the target RNA; do not activate the RNAse H pathway; do not activate RISC; do not recruit any Argonaute family protein; are not cleaved by Dicer; do not mediate alternative splicing; are not immune stimulatory; are nuclease resistant; have improved cell uptake compared to unmodified oligonucleotides; are not toxic to cells or mammals; may have improved endosomal exit; do interfere with interaction of lncRNA with PRC2, preferably the Ezh2 subunit but optionally the Suz12, Eed, RbAp46/48 subunits or accessory factors such as Jarid2; do decrease histone H3 lysine27 methylation and/or do upregulate gene expression.

Oligonucleotides that are designed to interact with RNA to modulate gene expression are a distinct subset of base sequences from those that are designed to bind a DNA target (e.g., are complementary to the underlying genomic DNA sequence from which the RNA is transcribed).

Any of the oligonucleotides disclosed herein may be linked to one or more other oligonucleotides disclosed herein by a linker, e.g., a cleavable linker.

Method for Selecting Candidate Oligonucleotides for Activating Expression of ATP2A2

Methods are provided herein for selecting a candidate oligonucleotide for activating or enhancing expression of ATP2A2. The target selection methods may generally involve steps for selecting single stranded oligonucleotides having any of the structural and functional characteristics disclosed herein. Typically, the methods involve one or more steps aimed at identifying oligonucleotides that target a PRC2-associated region that is functionally related to ATP2A2, for example a PRC2-associated region of a lncRNA that regulates expression of ATP2A2 by facilitating (e.g., in a cis-regulatory manner) the recruitment of PRC2 to the ATP2A2 gene. Such oligonucleotides are expected to be candidates for activating expression of ATP2A2 because of their ability to hybridize with the PRC2-associated region of a nucleic acid (e.g., a lncRNA). In some embodiments, this hybridization event is understood to disrupt interaction of PRC2 with the nucleic acid (e.g., a lncRNA) and as a result disrupt recruitment of PRC2 and its associated co-repressors (e.g., chromatin remodeling factors) to the ATP2A2 gene locus.

Methods of selecting a candidate oligonucleotide may involve selecting a PRC2-associated region (e.g., a nucleotide sequence as set forth in any one of SEQ ID NOS: 5 to 88) that maps to a chromosomal position encompassing or in proximity to the ATP2A2 gene (e.g., a chromosomal position having a sequence as set forth in any one of SEQ ID NOS: 1 to 4). The PRC2-associated region may map to the strand of the chromosome comprising the sense strand of the ATP2A2 gene, in which case the candidate oligonucleotide is complementary to the sense strand of the ATP2A2 gene (i.e., is antisense to the ATP2A2 gene). Alternatively, the PRC2-associated region may map to the strand of the first chromosome comprising the antisense strand of the ATP2A2 gene, in which case the oligonucleotide is complementary to the antisense strand (the template strand) of the ATP2A2 gene (i.e., is sense to the ATP2A2 gene).

Methods for selecting a set of candidate oligonucleotides that is enriched in oligonucleotides that activate expression of ATP2A2 may involve selecting one or more PRC2-associated regions that map to a chromosomal position that encompasses or that is in proximity to the ATP2A2 gene and selecting a set of oligonucleotides, in which each oligonucleotide in the set comprises a nucleotide sequence that is complementary with the one or more PRC2-associated regions. As used herein, the phrase, "a set of oligonucleotides that is enriched in oligonucleotides that activate expression of" refers to a set of oligonucleotides that has a greater number of oligonucleotides that activate expression of a target gene (e.g., ATP2A2) compared with a random selection of oligonucleotides of the same physicochemical properties (e.g., the same GC content, $T_m$, length etc.) as the enriched set.

Where the design and/or synthesis of a single stranded oligonucleotide involves design and/or synthesis of a sequence that is complementary to a nucleic acid or PRC2-associated region described by such sequence information, the skilled person is readily able to determine the complementary sequence, e.g., through understanding of Watson Crick base pairing rules which form part of the common general knowledge in the field.

In some embodiments design and/or synthesis of a single stranded oligonucleotide involves manufacture of an oligonucleotide from starting materials by techniques known to those of skill in the art, where the synthesis may be based on a sequence of a PRC2-associated region, or portion thereof.

Methods of design and/or synthesis of a single stranded oligonucleotide may involve one or more of the steps of:
  Identifying and/or selecting PRC2-associated region;
  Designing a nucleic acid sequence having a desired degree of sequence identity or complementarity to a PRC2-associated region or a portion thereof;
  Synthesizing a single stranded oligonucleotide to the designed sequence;
  Purifying the synthesized single stranded oligonucleotide; and
  Optionally mixing the synthesized single stranded oligonucleotide with at least one pharmaceutically acceptable diluent, carrier or excipient to form a pharmaceutical composition or medicament.

Single stranded oligonucleotides so designed and/or synthesized may be useful in method of modulating gene expression as described herein.

Preferably, single stranded oligonucleotides of the invention are synthesized chemically. Oligonucleotides used to practice this invention can be synthesized in vitro by well-known chemical synthesis techniques.

Oligonucleotides of the invention can be stabilized against nucleolytic degradation such as by the incorporation of a modification, e.g., a nucleotide modification. For example, nucleic acid sequences of the invention include a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom.

It is understood that any of the modified chemistries or formats of single stranded oligonucleotides described herein can be combined with each other, and that one, two, three, four, five, or more different types of modifications can be included within the same molecule.

In some embodiments, the method may further comprise the steps of amplifying the synthesized single stranded oligonucleotide, and/or purifying the single stranded oligonucleotide (or amplified single stranded oligonucleotide), and/or sequencing the single stranded oligonucleotide so obtained.

As such, the process of preparing a single stranded oligonucleotide may be a process that is for use in the manufacture of a pharmaceutical composition or medicament for use in the treatment of disease, optionally wherein the treatment involves modulating expression of a gene associated with a PRC2-associated region.

In the methods described above a PRC2-associated region may be, or have been, identified, or obtained, by a method that involves identifying RNA that binds to PRC2.

Such methods may involve the following steps: providing a sample containing nuclear ribonucleic acids, contacting the sample with an agent that binds specifically to PRC2 or a subunit thereof, allowing complexes to form between the agent and protein in the sample, partitioning the complexes, synthesizing nucleic acid that is complementary to nucleic acid present in the complexes.

Where the single stranded oligonucleotide is based on a PRC2-associated region, or a portion of such a sequence, it may be based on information about that sequence, e.g., sequence information available in written or electronic form, which may include sequence information contained in publicly available scientific publications or sequence databases.

Nucleotide Analogues

In some embodiments, the oligonucleotide may comprise at least one ribonucleotide, at least one deoxyribonucleotide, and/or at least one bridged nucleotide. In some embodiments, the oligonucleotide may comprise a bridged nucleotide, such as a locked nucleic acid (LNA) nucleotide, a constrained ethyl (cEt) nucleotide, or an ethylene bridged nucleic acid (ENA) nucleotide. Examples of such nucleotides are disclosed herein and known in the art. In some embodiments, the oligonucleotide comprises a nucleotide analog disclosed in one of the following United States patent or patent application Publications: U.S. Pat. Nos. 7,399,845, 7,741,457, 8,022,193, 7,569,686, 7,335,765, 7,314,923, 7,335,765, and 7,816,333, US 20110009471, the entire contents of each of which are incorporated herein by reference for all purposes. The oligonucleotide may have one or more 2' O-methyl nucleotides. The oligonucleotide may consist entirely of 2' O-methyl nucleotides.

Often the single stranded oligonucleotide has one or more nucleotide analogues. For example, the single stranded oligonucleotide may have at least one nucleotide analogue that results in an increase in $T_m$ of the oligonucleotide in a range of 1° C., 2° C., 3° C., 4° C., or 5° C. compared with an oligonucleotide that does not have the at least one nucleotide analogue. The single stranded oligonucleotide may have a plurality of nucleotide analogues that results in a total increase in $T_m$ of the oligonucleotide in a range of 2° C., 3° C., 4° C., 5° C., 6° C., 7° C., 8° C., 9° C., 10° C., 15° C., 20° C., 25° C., 30° C., 35° C., 40° C., 45° C. or more compared with an oligonucleotide that does not have the nucleotide analogue.

The oligonucleotide may be of up to 50 nucleotides in length in which 2 to 10, 2 to 15, 2 to 16, 2 to 17, 2 to 18, 2 to 19, 2 to 20, 2 to 25, 2 to 30, 2 to 40, 2 to 45, or more nucleotides of the oligonucleotide are nucleotide analogues. The oligonucleotide may be of 8 to 30 nucleotides in length in which 2 to 10, 2 to 15, 2 to 16, 2 to 17, 2 to 18, 2 to 19, 2 to 20, 2 to 25, 2 to 30 nucleotides of the oligonucleotide are nucleotide analogues. The oligonucleotide may be of 8 to 15 nucleotides in length in which 2 to 4, 2 to 5, 2 to 6, 2 to 7, 2 to 8, 2 to 9, 2 to 10, 2 to 11, 2 to 12, 2 to 13, 2 to 14 nucleotides of the oligonucleotide are nucleotide analogues. Optionally, the oligonucleotides may have every nucleotide except 1, 2, 3, 4, 5, 6, 7, 8, 9, or 10 nucleotides modified.

The oligonucleotide may consist entirely of bridged nucleotides (e.g., LNA nucleotides, cEt nucleotides, ENA nucleotides). The oligonucleotide may comprise alternating deoxyribonucleotides and 2'-fluoro-deoxyribonucleotides. The oligonucleotide may comprise alternating deoxyribonucleotides and 2'-O-methyl nucleotides. The oligonucleotide may comprise alternating deoxyribonucleotides and ENA nucleotide analogues. The oligonucleotide may comprise alternating deoxyribonucleotides and LNA nucleotides. The oligonucleotide may comprise alternating LNA nucleotides and 2'-O-methyl nucleotides. The oligonucleotide may have a 5' nucleotide that is a bridged nucleotide (e.g., a LNA nucleotide, cEt nucleotide, ENA nucleotide). The oligonucleotide may have a 5' nucleotide that is a deoxyribonucleotide.

The oligonucleotide may comprise deoxyribonucleotides flanked by at least one bridged nucleotide (e.g., a LNA nucleotide, cEt nucleotide, ENA nucleotide) on each of the 5' and 3' ends of the deoxyribonucleotides. The oligonucleotide may comprise deoxyribonucleotides flanked by 1, 2, 3, 4, 5, 6, 7, 8 or more bridged nucleotides (e.g., LNA nucleotides, cEt nucleotides, ENA nucleotides) on each of the 5' and 3' ends of the deoxyribonucleotides. The 3' position of the oligonucleotide may have a 3' hydroxyl group. The 3' position of the oligonucleotide may have a 3' thiophosphate.

The oligonucleotide may be conjugated with a label. For example, the oligonucleotide may be conjugated with a biotin moiety, cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

Preferably the single stranded oligonucleotide comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the single stranded oligonucleotides are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric single stranded oligonucleotides of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the single stranded oligonucleotide comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly $CH_2$—NH—O—$CH_2$, CH,~N($CH_3$)~O~$CH_2$ (known as a methylene(methylimino) or MMI backbone, $CH_2$—O—N($CH_3$)—$CH_2$, $CH_2$—N($CH_3$)—N($CH_3$)—$CH_2$ and O—N($CH_3$)—$CH_2$—$CH_2$ backbones, wherein the native phosphodiester backbone is represented as O— P— O— CH,); amide backbones (see De Mesmaeker et al. Acc. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties).

Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues. Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide.

PCT Publication No. WO 99/67378 discloses arabinonucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-O,4'-C-ethylene-bridged nucleic acids.

Examples of LNAs are described in WO/2008/043753 and include compounds of the following general formula.

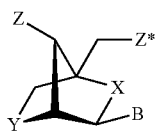

where X and Y are independently selected among the groups —O—,

—S—, —N(H)—, N(R)—, —CH$_2$— or —CH— (if part of a double bond),

—CH$_2$—O—, —CH$_2$—S—, —CH$_2$—N(H)—, —CH$_2$—N(R)—, —CH$_2$—CH$_2$— or —CH$_2$—CH— (if part of a double bond), —CH=CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligonucleotides described herein comprises at least one LNA unit according any of the formulas

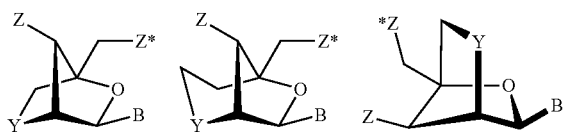

wherein Y is —O—, —S—, —NH—, or N(R$^H$); Z and Z* are independently selected among an internucleoside linkage, a terminal group or a protecting group; B constitutes a natural or non-natural nucleotide base moiety, and RH is selected from hydrogen and C$_{1-4}$-alkyl.

In some embodiments, the Locked Nucleic Acid (LNA) used in the oligonucleotides described herein comprises at least one Locked Nucleic Acid (LNA) unit according any of the formulas shown in Scheme 2 of PCT/DK2006/000512.

In some embodiments, the LNA used in the oligomer of the invention comprises internucleoside linkages selected from -0-P(O)$_2$—O—, —O—P(O,S)—O—, -0-P(S)$_2$—O—, —S—P(O)$_2$—O—, —S—P(O,S)—O—, —S—P(S)$_2$—O—, -0-P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, -0-PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, where R$^H$ is selected from hydrogen and C$_{1-4}$-alkyl.

Specifically preferred LNA units are shown in scheme 2:

Scheme 2

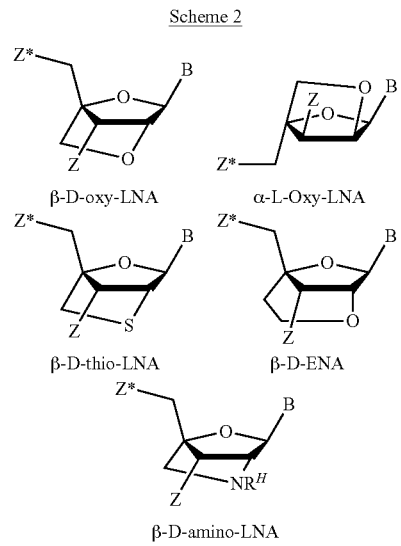

β-D-oxy-LNA    α-L-Oxy-LNA

β-D-thio-LNA    β-D-ENA

β-D-amino-LNA

The term "thio-LNA" comprises a locked nucleotide in which at least one of X or Y in the general formula above is selected from S or —CH$_2$—S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH$_2$—N(R)— where R is selected from hydrogen and C$_{14}$-alkyl. Amino-LNA can be in both beta-D and alpha-L-configuration.

The term "oxy-LNA" comprises a locked nucleotide in which at least one of X or Y in the general formula above represents —O— or —CH$_2$—O—. Oxy-LNA can be in both beta-D and alpha-L-configuration.

The term "ena-LNA" comprises a locked nucleotide in which Y in the general formula above is —CH$_2$—O— (where the oxygen atom of —CH$_2$—O— is attached to the 2'-position relative to the base B).

LNAs are described in additional detail herein.

One or more substituted sugar moieties can also be included, e.g., one of the following at the 2' position: OH, SH, SCH$_3$, F, OCN, OCH$_3$ OCH$_3$, OCH$_3$ O(CH$_2$)n CH$_3$, O(CH$_2$)n NH$_2$ or O(CH$_2$)n CH$_3$ where n is from 1 to about 10; C1 to C10 lower alkyl, alkoxyalkoxy, substituted lower alkyl, alkaryl or aralkyl; Cl; Br; CN; CF$_3$; OCF$_3$; O—, S—, or N-alkyl; O—, S—, or N-alkenyl; SOCH$_3$; SO$_2$ CH$_3$; ONO$_2$; NO$_2$; N$_3$; NH$_2$; heterocycloalkyl; heterocycloalkaryl; amino alkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A preferred modification includes 2'-methoxyethoxy[2'-O—CH$_2$CH$_2$OCH$_3$, also known as 2'-O-(2-methoxyethyl)] (Martin et al, Helv. Chim. Acta, 1995, 78, 486). Other preferred modifications include 2'-methoxy (2'-O—CH$_3$), 2'-propoxy (2'-OCH$_2$CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Single stranded oligonucleotides can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalkylamino)adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-77; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2° C. (Sanghvi, in Crooke, and Lebleu, eds., Antisense Research and Applications, CRC Press, Boca Raton, 1993, pp. 276-278) and may be used as base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al, Science, 1991, 254, 1497-1500.

Single stranded oligonucleotides can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990; those disclosed by Englisch et al., Angewandle Chemie, International Edition, 1991, 30, page 613, and those disclosed by Sanghvi, Chapter 15, "Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2<0>C (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the single stranded oligonucleotides are chemically linked to one or more moieties or conjugates that enhance the activity, cellular distribution, or cellular uptake of the oligonucleotide. For example, one or more single stranded oligonucleotides, of the same or different types, can be conjugated to each other; or single stranded oligonucleotides can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-t oxycholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552, 538; 5,578,717, 5,580,731; 5,580,731; 5,591,584; 5,109,124; 5,118,802; 5,138,045; 5,414,077; 5,486, 603; 5,512,439; 5,578,718; 5,608,046; 4,587,044; 4,605,735; 4,667,025; 4,762, 779; 4,789,737; 4,824,941; 4,835,263; 4,876,335; 4,904,582; 4,958,013; 5,082, 830; 5,112,963; 5,214,136; 5,082,830; 5,112,963; 5,214,136; 5, 245,022; 5,254,469; 5,258,506; 5,262,536; 5,272,250; 5,292,873; 5,317,098; 5,371,241, 5,391, 723; 5,416,203, 5,451,463; 5,510,475; 5,512,667; 5,514,785; 5, 565,552; 5,567,810; 5,574,142; 5,585,481; 5,587,371; 5,595,726; 5,597,696; 5,599,923; 5,599, 928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

In some embodiments, single stranded oligonucleotide modification include modification of the 5' or 3' end of the oligonucleotide. In some embodiments, the 3' end of the oligonucleotide comprises a hydroxyl group or a thiophosphate. It should be appreciated that additional molecules (e.g. a biotin moiety or a fluorophor) can be conjugated to the 5' or 3' end of the single stranded oligonucleotide. In some embodiments, the single stranded oligonucleotide comprises a biotin moiety conjugated to the 5' nucleotide.

In some embodiments, the single stranded oligonucleotide comprises locked nucleic acids (LNA), ENA modified nucleotides, 2'-O-methyl nucleotides, or 2'-fluoro-deoxyribonucleotides. In some embodiments, the single stranded oligonucleotide comprises alternating deoxyribonucleotides and 2'-fluoro-deoxyribonucleotides. In some embodiments, the single stranded oligonucleotide comprises alternating deoxyribonucleotides and 2'-O-methyl nucleotides. In some embodiments, the single stranded oligonucleotide comprises alternating deoxyribonucleotides and ENA modified nucleotides. In some embodiments, the single stranded oligonucleotide comprises alternating deoxyribonucleotides and locked nucleic acid nucleotides. In some embodiments, the single stranded oligonucleotide comprises alternating locked nucleic acid nucleotides and 2'-O-methyl nucleotides.

In some embodiments, the 5' nucleotide of the oligonucleotide is a deoxyribonucleotide. In some embodiments, the 5' nucleotide of the oligonucleotide is a locked nucleic acid nucleotide. In some embodiments, the nucleotides of the oligonucleotide comprise deoxyribonucleotides flanked by at least one locked nucleic acid nucleotide on each of the 5' and 3' ends of the deoxyribonucleotides. In some embodiments, the nucleotide at the 3' position of the oligonucleotide has a 3' hydroxyl group or a 3' thiophosphate.

In some embodiments, the single stranded oligonucleotide comprises phosphorothioate internucleotide linkages. In some embodiments, the single stranded oligonucleotide comprises phosphorothioate internucleotide linkages between at least two nucleotides. In some embodiments, the single stranded oligonucleotide comprises phosphorothioate internucleotide linkages between all nucleotides.

It should be appreciated that the single stranded oligonucleotide can have any combination of modifications as described herein.

The oligonucleotide may comprise a nucleotide sequence having one or more of the following modification patterns.

(a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxXXxx, (X)XxxXXx, (X)XxxxXX, (X)xXxXXx, (X)xXxxXX, (X)xxXxXX, (X)XxXxXx, (X)XxXxxX, (X)XxxXxX, (X)xXxXxX, (X)xxXxxX, (X)xXxXxX and (X)XxXxXx, (d) (X)xxXXX, (X)xXxXXX, (X)xXXxXX, (X)xXXXxX, (X)xXXXXx, (X)xxXXXX, (X)XxxXXX, (X)XxXxXX, (X)XxXXxX, (X)XxXXXx, (X)XXxxXX, (X)XxXXxX, (X)XXxXxX, (X)XXxXXx, (X)XXXxxX, (X)XXXxXx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, in which "X" denotes a nucleotide analogue, (X) denotes an optional nucleotide analogue, and "x" denotes a DNA or RNA nucleotide unit. Each of the above listed patterns may appear one or more times within an oligonucleotide, alone or in combination with any of the other disclosed modification patterns.

Methods for Modulating Gene Expression

In one aspect, the invention relates to methods for modulating gene expression in a cell (e.g., a cell for which ATP2A2 levels are reduced) for research purposes (e.g., to study the function of the gene in the cell). In another aspect, the invention relates to methods for modulating gene expression in a cell (e.g., a cell for which ATP2A2 levels are reduced) for gene or epigenetic therapy. The cells can be in vitro, ex vivo, or in vivo (e.g., in a subject who has a disease resulting from reduced expression or activity of ATP2A2. In some embodiments, methods for modulating gene expression in a cell comprise delivering a single stranded oligonucleotide as described herein. In some embodiments, delivery of the single stranded oligonucleotide to the cell results in a level of expression of gene that is at least 5%, 10%, 20%, 30%, 40%, 50%, 60%, 70%, 80%, 90%, 100%, 200% or more greater than a level of expression of gene in a control cell to which the single stranded oligonucleotide has not been delivered. In certain embodiments, delivery of the single stranded oligonucleotide to the cell results in a level of expression of gene that is at least 50% greater than a level of expression of gene in a control cell to which the single stranded oligonucleotide has not been delivered.

In another aspect of the invention, methods comprise administering to a subject (e.g. a human) a composition comprising a single stranded oligonucleotide as described herein to increase protein levels in the subject. In some embodiments, the increase in protein levels is at least 5%, 10%, 20%, 30%, 40%, 50%, 60%, 70%, 80%, 90%, 100%, 200%, or more, higher than the amount of a protein in the subject before administering.

As another example, to increase expression of ATP2A2 in a cell, the methods include introducing into the cell a single stranded oligonucleotide that is sufficiently complementary to a PRC2-associated region (e.g., of a long non-coding RNA) that maps to a genomic position encompassing or in proximity to the ATP2A2 gene.

In another aspect of the invention provides methods of treating a condition (e.g., cardiac disease) associated with decreased levels of expression of ATP2A2 in a subject, the method comprising administering a single stranded oligonucleotide as described herein.

A subject can include a non-human mammal, e.g. mouse, rat, guinea pig, rabbit, cat, dog, goat, cow, or horse. In preferred embodiments, a subject is a human. Single stranded oligonucleotides have been employed as therapeutic moieties in the treatment of disease states in animals, including humans. Single stranded oligonucleotides can be useful therapeutic modalities that can be configured to be useful in treatment regimes for the treatment of cells, tissues and animals, especially humans.

For therapeutics, an animal, preferably a human, suspected of having cardiac disease is treated by administering single stranded oligonucleotide in accordance with this invention. For example, in one non-limiting embodiment, the methods comprise the step of administering to the animal in need of treatment, a therapeutically effective amount of a single stranded oligonucleotide as described herein.

Formulation, Delivery, And Dosing

The oligonucleotides described herein can be formulated for administration to a subject for treating a condition (e.g., a cardiac disease) associated with decreased levels of ATP2A2. It should be understood that the formulations, compositions and methods can be practiced with any of the oligonucleotides disclosed herein.

The formulations may conveniently be presented in unit dosage form and may be prepared by any methods well known in the art of pharmacy. The amount of active ingredient (e.g., an oligonucleotide or compound of the invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g. tumor regression.

Pharmaceutical formulations of this invention can be prepared according to any method known to the art for the manufacture of pharmaceuticals. Such formulations can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

A formulated single stranded oligonucleotide composition can assume a variety of states. In some examples, the composition is at least partially crystalline, uniformly crystalline, and/or anhydrous (e.g., less than 80, 50, 30, 20, or 10% water). In another example, the single stranded oligonucleotide is in an aqueous phase, e.g., in a solution that includes water. The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the single stranded oligonucleotide composition is formulated in a manner that is compatible with the intended method of administration.

In some embodiments, the composition is prepared by at least one of the following methods: spray drying, lyophilization, vacuum drying, evaporation, fluid bed drying, or a combination of these techniques; or sonication with a lipid, freeze-drying, condensation and other self-assembly.

A single stranded oligonucleotide preparation can be formulated or administered (together or separately) in combination with another agent, e.g., another therapeutic agent or an agent that stabilizes a single stranded oligonucleotide, e.g., a protein that complexes with single stranded oligonucleotide. Still other agents include chelators, e.g., EDTA (e.g., to remove divalent cations such as $Mg^{2+}$), salts, RNAse inhibitors (e.g., a broad specificity RNAse inhibitor such as RNAsin) and so forth.

In one embodiment, the single stranded oligonucleotide preparation includes another single stranded oligonucleotide, e.g., a second single stranded oligonucleotide that modulates expression of a second gene or a second single stranded oligonucleotide that modulates expression of the first gene. Still other preparation can include at least 3, 5, ten, twenty, fifty, or a hundred or more different single stranded oligonucleotide species. Such single stranded oligonucleotides can mediated gene expression with respect to a similar number of different genes. In one embodiment, the single stranded oligonucleotide preparation includes at least a second therapeutic agent (e.g., an agent other than an oligonucleotide).

Route of Delivery

A composition that includes a single stranded oligonucleotide can be delivered to a subject by a variety of routes. Exemplary routes include: intravenous, intradermal, topical, rectal, parenteral, anal, intravaginal, intranasal, pulmonary, ocular. The term "therapeutically effective amount" is the amount of oligonucleotide present in the composition that is needed to provide the desired level of ATP2A2 expression in the subject to be treated to give the anticipated physiological response. The term "physiologically effective amount" is that amount delivered to a subject to give the desired palliative or curative effect. The term "pharmaceutically acceptable carrier" means that the carrier can be administered to a subject with no significant adverse toxicological effects to the subject.

The single stranded oligonucleotide molecules of the invention can be incorporated into pharmaceutical compositions suitable for administration. Such compositions typically include one or more species of single stranded oligonucleotide and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present invention may be administered in a number of ways depending upon whether local or systemic treatment is desired and upon the area to be treated. Administration may be topical (including ophthalmic, vaginal, rectal, intranasal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the single stranded oligonucleotide in aerosol form. The vascular endothelial cells could be targeted by coating a balloon catheter with the single stranded oligonucleotide and mechanically introducing the oligonucleotide.

Topical administration refers to the delivery to a subject by contacting the formulation directly to a surface of the subject. The most common form of topical delivery is to the skin, but a composition disclosed herein can also be directly applied to other surfaces of the body, e.g., to the eye, a mucous membrane, to surfaces of a body cavity or to an internal surface. As mentioned above, the most common topical delivery is to the skin. The term encompasses several routes of administration including, but not limited to, topical and transdermal. These modes of administration typically include penetration of the skin's permeability barrier and efficient delivery to the target tissue or stratum. Topical administration can be used as a means to penetrate the epidermis and dermis and ultimately achieve systemic delivery of the composition. Topical administration can also be used as a means to selectively deliver oligonucleotides to the epidermis or dermis of a subject, or to specific strata thereof, or to an underlying tissue.

Formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Transdermal delivery is a valuable route for the administration of lipid soluble therapeutics. The dermis is more permeable than the epidermis and therefore absorption is much more rapid through abraded, burned or denuded skin. Inflammation and other physiologic conditions that increase blood flow to the skin also enhance transdermal adsorption. Absorption via this route may be enhanced by the use of an oily vehicle (inunction) or through the use of one or more penetration enhancers. Other effective ways to deliver a composition disclosed herein via the transdermal route include hydration of the skin and the use of controlled release topical patches. The transdermal route provides a potentially effective means to deliver a composition disclosed herein for systemic and/or local therapy. In addition, iontophoresis (transfer of ionic solutes through biological membranes under the influence of an electric field), phonophoresis or sonophoresis (use of ultrasound to enhance the absorption of various therapeutic agents across biological membranes, notably the skin and the cornea), and optimization of vehicle characteristics relative to dose position and retention at the site of administration may be useful methods for enhancing the transport of topically applied compositions across skin and mucosal sites.

Both the oral and nasal membranes offer advantages over other routes of administration. For example, oligonucleotides administered through these membranes may have a rapid onset of action, provide therapeutic plasma levels, avoid first pass effect of hepatic metabolism, and avoid exposure of the oligonucleotides to the hostile gastrointestinal (GI) environment. Additional advantages include easy access to the membrane sites so that the oligonucleotide can be applied, localized and removed easily.

In oral delivery, compositions can be targeted to a surface of the oral cavity, e.g., to sublingual mucosa which includes the membrane of ventral surface of the tongue and the floor of the mouth or the buccal mucosa which constitutes the lining of the cheek. The sublingual mucosa is relatively permeable thus giving rapid absorption and acceptable bioavailability of many agents. Further, the sublingual mucosa is convenient, acceptable and easily accessible.

A pharmaceutical composition of single stranded oligonucleotide may also be administered to the buccal cavity of a human being by spraying into the cavity, without inhalation, from a metered dose spray dispenser, a mixed micellar pharmaceutical formulation as described above and a propellant. In one embodiment, the dispenser is first shaken prior to spraying the pharmaceutical formulation and propellant into the buccal cavity.

Compositions for oral administration include powders or granules, suspensions or solutions in water, syrups, slurries, emulsions, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening and/or flavoring agents can be added.

Parenteral administration includes intravenous drip, subcutaneous, intraperitoneal or intramuscular injection, intrathecal or intraventricular administration. In some embodiments, parental administration involves administration directly to the site of disease (e.g. injection into a tumor).

Formulations for parenteral administration may include sterile aqueous solutions which may also contain buffers, diluents and other suitable additives. Intraventricular injection may be facilitated by an intraventricular catheter, for example, attached to a reservoir. For intravenous use, the total concentration of solutes should be controlled to render the preparation isotonic.

Any of the single stranded oligonucleotides described herein can be administered to ocular tissue. For example, the compositions can be applied to the surface of the eye or nearby tissue, e.g., the inside of the eyelid. For ocular administration, ointments or droppable liquids may be delivered by ocular delivery systems known to the art such as applicators or eye droppers. Such compositions can include mucomimetics such as hyaluronic acid, chondroitin sulfate, hydroxypropyl methylcellulose or poly(vinyl alcohol), preservatives such as sorbic acid, EDTA or benzylchronium chloride, and the usual quantities of diluents and/or carriers. The single stranded oligonucleotide can also be administered to the interior of the eye, and can be introduced by a needle or other delivery device which can introduce it to a selected area or structure.

Pulmonary delivery compositions can be delivered by inhalation by the patient of a dispersion so that the composition, preferably single stranded oligonucleotides, within the dispersion can reach the lung where it can be readily absorbed through the alveolar region directly into blood circulation. Pulmonary delivery can be effective both for systemic delivery and for localized delivery to treat diseases of the lungs.

Pulmonary delivery can be achieved by different approaches, including the use of nebulized, aerosolized, micellular and dry powder-based formulations. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self-contained. Dry powder dispersion devices, for example, deliver agents that may be readily formulated as dry powders. A single stranded oligonucleotide composition may be stably stored as lyophilized or spray-dried powders by itself or in combination with suitable powder carriers. The delivery of a composition for inhalation can be mediated by a dosing timing element which can include a timer, a dose counter, time measuring device, or a time indicator which when incorporated into the device enables dose tracking, compliance monitoring, and/or dose triggering to a patient during administration of the aerosol medicament.

The term "powder" means a composition that consists of finely dispersed solid particles that are free flowing and capable of being readily dispersed in an inhalation device and subsequently inhaled by a subject so that the particles reach the lungs to permit penetration into the alveoli. Thus, the powder is said to be "respirable." Preferably the average particle size is less than about 10 μm in diameter preferably with a relatively uniform spheroidal shape distribution. More preferably the diameter is less than about 7.5 μm and most preferably less than about 5.0 μm. Usually the particle size distribution is between about 0.1 μm and about 5 μm in diameter, particularly about 0.3 μm to about 5 μm.

The term "dry" means that the composition has a moisture content below about 10% by weight (% w) water, usually below about 5% w and preferably less it than about 3% w. A dry composition can be such that the particles are readily dispersible in an inhalation device to form an aerosol.

The types of pharmaceutical excipients that are useful as carrier include stabilizers such as human serum albumin (HSA), bulking agents such as carbohydrates, amino acids and polypeptides; pH adjusters or buffers; salts such as sodium chloride; and the like. These carriers may be in a crystalline or amorphous form or may be a mixture of the two.

Suitable pH adjusters or buffers include organic salts prepared from organic acids and bases, such as sodium citrate, sodium ascorbate, and the like; sodium citrate is preferred. Pulmonary administration of a micellar single stranded oligonucleotide formulation may be achieved through metered dose spray devices with propellants such as tetrafluoroethane, heptafluoroethane, dimethylfluoropropane, tetrafluoropropane, butane, isobutane, dimethyl ether and other non-CFC and CFC propellants.

Exemplary devices include devices which are introduced into the vasculature, e.g., devices inserted into the lumen of a vascular tissue, or which devices themselves form a part of the vasculature, including stents, catheters, heart valves, and other vascular devices. These devices, e.g., catheters or stents, can be placed in the vasculature of the lung, heart, or leg.

Other devices include non-vascular devices, e.g., devices implanted in the peritoneum, or in organ or glandular tissue, e.g., artificial organs. The device can release a therapeutic substance in addition to a single stranded oligonucleotide, e.g., a device can release insulin.

In one embodiment, unit doses or measured doses of a composition that includes single stranded oligonucleotide are dispensed by an implanted device. The device can include a sensor that monitors a parameter within a subject. For example, the device can include pump, e.g., and, optionally, associated electronics.

Tissue, e.g., cells or organs can be treated with a single stranded oligonucleotide, ex vivo and then administered or implanted in a subject. The tissue can be autologous, allogeneic, or xenogeneic tissue. E.g., tissue can be treated to reduce graft v. host disease. In other embodiments, the tissue is allogeneic and the tissue is treated to treat a disorder characterized by unwanted gene expression in that tissue. E.g., tissue, e.g., hematopoietic cells, e.g., bone marrow hematopoietic cells, can be treated to inhibit unwanted cell proliferation. Introduction of treated tissue, whether autologous or transplant, can be combined with other therapies. In some implementations, the single stranded oligonucleotide treated cells are insulated from other cells, e.g., by a semipermeable porous barrier that prevents the cells from leaving the implant, but enables molecules from the body to reach the cells and molecules produced by the cells to enter the body. In one embodiment, the porous barrier is formed from alginate.

In one embodiment, a contraceptive device is coated with or contains a single stranded oligonucleotide. Exemplary devices include condoms, diaphragms, IUD (implantable uterine devices, sponges, vaginal sheaths, and birth control devices.

Dosage

In one aspect, the invention features a method of administering a single stranded oligonucleotide (e.g., as a compound or as a component of a composition) to a subject (e.g., a human subject). In one embodiment, the unit dose is between about 10 mg and 25 mg per kg of bodyweight. In one embodiment, the unit dose is between about 1 mg and 100 mg per kg of bodyweight. In one embodiment, the unit dose is between about 0.1 mg and 500 mg per kg of bodyweight. In some embodiments, the unit dose is more than 0.001, 0.005, 0.01, 0.05, 0.1, 0.5, 1, 2, 5, 10, 25, 50 or 100 mg per kg of bodyweight.

The defined amount can be an amount effective to treat or prevent a disease or disorder, e.g., a disease or disorder associated with ATP2A2. The unit dose, for example, can be administered by injection (e.g., intravenous or intramuscular), an inhaled dose, or a topical application.

In some embodiments, the unit dose is administered daily. In some embodiments, less frequently than once a day, e.g., less than every 2, 4, 8 or 30 days. In another embodiment, the unit dose is not administered with a frequency (e.g., not a regular frequency). For example, the unit dose may be administered a single time. In some embodiments, the unit dose is administered more than once a day, e.g., once an hour, two hours, four hours, eight hours, twelve hours, etc.

In one embodiment, a subject is administered an initial dose and one or more maintenance doses of a single stranded oligonucleotide. The maintenance dose or doses are generally lower than the initial dose, e.g., one-half less of the initial dose. A maintenance regimen can include treating the subject with a dose or doses ranging from 0.0001 to 100 mg/kg of body weight per day, e.g., 100, 10, 1, 0.1, 0.01, 0.001, or 0.0001 mg per kg of bodyweight per day. The maintenance doses may be administered no more than once every 1, 5, 10, or 30 days. Further, the treatment regimen may last for a period of time which will vary depending upon the nature of the particular disease, its severity and the overall condition of the patient. In some embodiments the dosage may be delivered no more than once per day, e.g., no more than once per 24, 36, 48, or more hours, e.g., no more than once for every 5 or 8 days. Following treatment, the patient can be monitored for changes in his condition and for alleviation of the symptoms of the disease state. The dosage of the oligonucleotide may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

In some embodiments, the oligonucleotide pharmaceutical composition includes a plurality of single stranded oligonucleotide species. In another embodiment, the single stranded oligonucleotide species has sequences that are non-overlapping and non-adjacent to another species with respect to a naturally occurring target sequence (e.g., a PRC2-associated region). In another embodiment, the plurality of single stranded oligonucleotide species is specific for different PRC2-associated regions. In another embodiment, the single stranded oligonucleotide is allele specific.

In some cases, a patient is treated with a single stranded oligonucleotide in conjunction with other therapeutic modalities.

Following successful treatment, it may be desirable to have the patient undergo maintenance therapy to prevent the recurrence of the disease state, wherein the compound of the invention is administered in maintenance doses, ranging from 0.0001 mg to 100 mg per kg of body weight.

The concentration of the single stranded oligonucleotide composition is an amount sufficient to be effective in treating or preventing a disorder or to regulate a physiological condition in humans. The concentration or amount of single stranded oligonucleotide administered will depend on the parameters determined for the agent and the method of administration, e.g. nasal, buccal, pulmonary. For example, nasal formulations may tend to require much lower concentrations of some ingredients in order to avoid irritation or burning of the nasal passages. It is sometimes desirable to dilute an oral formulation up to 10-100 times in order to provide a suitable nasal formulation.

Certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a single stranded oligonucleotide can include a single treatment or, preferably, can include a series of treatments. It will also be appreciated that the effective dosage of a single stranded oligonucleotide used for treatment may increase or decrease over the course of a particular treatment. For example, the subject can be monitored after administering a single stranded oligonucleotide composition. Based on information from the monitoring, an additional amount of the single stranded oligonucleotide composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of ATP2A2 expression levels in the body of the patient. Persons of ordinary skill can easily determine optimum dosages, dosing methodologies and repetition rates. Optimum dosages may vary depending on the relative potency of individual compounds, and can generally be estimated based on EC50s found to be effective in in vitro and in vivo animal models. In some embodiments, the animal models include transgenic animals that express a human ATP2A2. In another embodiment, the composition for testing includes a single stranded oligonucleotide that is complementary, at least in an internal region, to a sequence that is conserved between ATP2A2 in the animal model and the ATP2A2 in a human.

In one embodiment, the administration of the single stranded oligonucleotide composition is parenteral, e.g. intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The composition can be provided in measured doses or in a dispenser which delivers a metered dose. Selected modes of delivery are discussed in more detail below.

Kits

In certain aspects of the invention, kits are provided, comprising a container housing a composition comprising a single stranded oligonucleotide. In some embodiments, the composition is a pharmaceutical composition comprising a single stranded oligonucleotide and a pharmaceutically acceptable carrier. In some embodiments, the individual components of the pharmaceutical composition may be provided in one container. Alternatively, it may be desirable to provide the components of the pharmaceutical composition separately in two or more containers, e.g., one container for single stranded oligonucleotides, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

The present invention is further illustrated by the following Examples, which in no way should be construed as further limiting. The entire contents of all of the references (including literature references, issued patents, published patent applications, and co-pending patent applications) cited throughout this application are hereby expressly incorporated by reference.

EXAMPLES

The invention is further described in the following examples, which do not limit the scope of the invention described in the claims.

Materials and Methods:

Real Time PCR

RNA is harvested from the cells using Promega SV 96 Total RNA Isolation system or Trizol omitting the DNAse step. RNA harvested from cells is normalized so that equal RNA is input to each reverse transcription reaction. Reverse transcriptase reactions are performed using the Superscript II kit and real time PCR performed on cDNA samples using icycler SYBR green chemistry (Biorad). A baseline level of mRNA expression for ATP2A2 is determined through quantitative PCR as outlined above. Baseline levels are also determined for mRNA of various housekeeping genes which are constitutively expressed. A "control" housekeeping gene with approximately the same level of baseline expression as the target gene is chosen for comparison purposes.

Cell Culture

Human hepatocyte Hep3B, human hepatocyte HepG2 cells, mouse hepatoma Hepa1-6 cells, and human renal proximal tubule epithelial cells (RPTEC) are cultured using conditions known in the art (see, e.g. Current Protocols in Cell Biology).

Oligonucleotide Design

Oligonucleotides were designed within PRC2-interacting regions in order to upregulate ATP2A2. The sequence and structure of each oligonucleotide is shown in Table 3. A description of the nucleotide analogs, modifications and intranucleotide linkages used for certain oligonucleotides described is provided in Table 2.

In Vitro Transfection of Cells with Oligonucleotides

Oligonucleotides are designed within PRC2-interacting regions in order to upregulate ATP2A2. Cells are seeded into each well of 24-well plates at a density of 25,000 cells per 500 uL and transfections are performed with Lipofectamine and the single stranded oligonucleotides. Control wells contain Lipofectamine alone. At 48 hours post-transfection, approximately 200 uL of cell culture supernatants are stored at −80 C for ELISA. At 48 hours post-transfection, RNA is harvested from the cells and quantitative PCR is carried out as outlined above. The percent induction of target mRNA expression by each oligonucleotide is determined by normalizing mRNA levels in the presence of the oligonucleotide to the mRNA levels in the presence of control (Lipofectamine alone). This is compared side-by-side with the increase in mRNA expression of the "control" housekeeping gene.

In Vitro Delivery of Single Stranded Oligonucleotides

Oligonucleotides are designed as candidates for upregulating ATP2A2 expression. The single stranded oligonucleotides are designed to be complementary to a PRC2-interacting region within a sequence as set forth in SEQ ID NO: 1 or 2. The oligonucleotides are tested in at least duplicate. Briefly, cells are transfected in vitro with each of the oligonucleotides as described above. ATP2A2 expression in cells following treatment is evaluated by qRT-PCR. Oligonucleotides that upregulate ATP2A2 expression are identified.

TABLE 3

Hexamers that are not seed sequences of human miRNAs

AAAAAA, AAAAAG, AAAACA, AAAAGA, AAAAGC, AAAAGG, AAAAUA, AAACAA, AAACAC, AAACAG,

AAACAU, AAACCC, AAACCU, AAACGA, AAACGC, AAACGU, AAACUA, AAACUC, AAACUU, AAAGAU,

AAAGCC, AAAGGA, AAAGGG, AAAGUC, AAAUAC, AAAUAU, AAAUCG, AAAUCU, AAAUGC, AAAUGU,

AAAUUA, AAAUUG, AACAAC, AACAAG, AACAAU, AACACA, AACACG, AACAGA, AACAGC, AACAGG,

AACAUC, AACAUG, AACCAA, AACCAC, AACCAG, AACCAU, AACCCC, AACCCG, AACCGA, AACCGC,

AACCGG, AACCUA, AACCUU, AACGAA, AACGAC, AACGAG, AACGAU, AACGCU, AACGGG, AACGGU,

AACGUA, AACGUC, AACGUG, AACGUU, AACUAU, AACUCA, AACUCC, AACUCG, AACUGA, AACUGC,

AACUGU, AACUUA, AACUUC, AACUUG, AACUUU, AAGAAA, AAGAAG, AAGAAU, AAGACG, AAGAGA,

AAGAGC, AAGAGG, AAGAGU, AAGAUU, AAGCAA, AAGCAC, AAGCAG, AAGCAU, AAGCCA, AAGCCC,

AAGCCG, AAGCCU, AAGCGA, AAGCGG, AAGCGU, AAGCUA, AAGGAA, AAGGAC, AAGGCU, AAGGGC,

AAGGGU, AAGGUU, AAGUAA, AAGUAC, AAGUAU, AAGUCC, AAGUCG, AAGUGA, AAGUGG, AAGUUA,

AAGUUU, AAUAAA, AAUAAC, AAUAAG, AAUAAU, AAUACA, AAUACC, AAUACG, AAUAGA, AAUAGC,

AAUAGG, AAUAGU, AAUAUC, AAUAUU, AAUCAA, AAUCAU, AAUCCA, AAUCCC, AAUCCG, AAUCGA,

AAUCGC, AAUCGU, AAUCUA, AAUCUG, AAUCUU, AAUGAA, AAUGAC, AAUGAG, AAUGAU, AAUGCG,

AAUGCU, AAUGGA, AAUGGU, AAUGUA, AAUGUC, AAUGUG, AAUUAA, AAUUAC, AAUUAG, AAUUCC,

AAUUCG, AAUUGA, AAUUGG, AAUUGU, AAUUUC, AAUUUG, ACAAAA, ACAAAC, ACAAAG, ACAAAU,

ACAACC, ACAACG, ACAACU, ACAAGA, ACAAGC, ACAAGU, ACAAUC, ACAAUG, ACAAUU, ACACAG,

TABLE 3-continued

Hexamers that are not seed sequences of human miRNAs

ACACCA, ACACCC, ACACCG, ACACCU, ACACGA, ACACGC, ACACGU, ACACUC, ACACUG, ACACUU,

ACAGAA, ACAGAC, ACAGCC, ACAGCG, ACAGCU, ACAGGG, ACAGUC, ACAGUG, ACAGUU, ACAUAA,

ACAUAC, ACAUCC, ACAUCG, ACAUCU, ACAUGA, ACAUGC, ACAUGU, ACAUUG, ACAUUU, ACCAAA,

ACCAAC, ACCAAG, ACCAAU, ACCACC, ACCACG, ACCAGA, ACCAGU, ACCAUA, ACCAUG, ACCAUU,

ACCCAA, ACCCAC, ACCCCA, ACCCCG, ACCCGA, ACCCGC, ACCCUA, ACCCUC, ACCCUU, ACCGAA,

ACCGAC, ACCGAU, ACCGCA, ACCGCC, ACCGCG, ACCGCU, ACCGGA, ACCGGC, ACCGGU, ACCGUA,

ACCGUC, ACCGUG, ACCGUU, ACCUAA, ACCUAC, ACCUAG, ACCUAU, ACCUCA, ACCUCC, ACCUCG,

ACCUCU, ACCUGA, ACCUGC, ACCUGU, ACCUUA, ACCUUC, ACCUUU, ACGAAA, ACGAAC, ACGAAG,

ACGAAU, ACGACA, ACGACC, ACGACG, ACGACU, ACGAGA, ACGAGC, ACGAGG, ACGAGU, ACGAUA,

ACGAUC, ACGAUG, ACGAUU, ACGCAA, ACGCAG, ACGCAU, ACGCCC, ACGCCG, ACGCCU, ACGCGA,

ACGCGG, ACGCGU, ACGCUA, ACGCUG, ACGCUU, ACGGAA, ACGGAC, ACGGAG, ACGGAU, ACGGCC,

ACGGCG, ACGGCU, ACGGGC, ACGGGG, ACGGGU, ACGGUA, ACGGUC, ACGGUG, ACGGUU, ACGUAA,

ACGUAC, ACGUAU, ACGUCC, ACGUCG, ACGUCU, ACGUGA, ACGUGC, ACGUGG, ACGUGU, ACGUUA,

ACGUUC, ACGUUG, ACGUUU, ACUAAA, ACUAAG, ACUAAU, ACUACA, ACUACC, ACUACG, ACUACU,

ACUAGG, ACUAUC, ACUAUG, ACUAUU, ACUCAU, ACUCCC, ACUCCG, ACUCCU, ACUCGA, ACUCGC,

ACUCGG, ACUCUC, ACUCUU, ACUGAG, ACUGAU, ACUGCC, ACUGCG, ACUGCU, ACUGGG, ACUGGU,

ACUGUC, ACUUAA, ACUUAC, ACUUAU, ACUUCA, ACUUCC, ACUUCG, ACUUCU, ACUUGA, ACUUGC,

ACUUGU, ACUUUA, ACUUUC, ACUUUG, AGAAAA, AGAAAC, AGAAAG, AGAACC, AGAACG, AGAACU,

AGAAGC, AGAAGU, AGAAUA, AGAAUC, AGAAUG, AGAAUU, AGACAA, AGACAC, AGACAU, AGACCA,

AGACCC, AGACCG, AGACCU, AGACGA, AGACGC, AGACGU, AGACUA, AGACUC, AGACUU, AGAGAC,

AGAGAG, AGAGAU, AGAGCC, AGAGCG, AGAGCU, AGAGGC, AGAGGG, AGAGGU, AGAGUA, AGAGUU,

AGAUAC, AGAUAG, AGAUAU, AGAUCC, AGAUCG, AGAUCU, AGAUGA, AGAUGC, AGAUGG, AGAUUA,

AGAUUC, AGAUUG, AGAUUU, AGCAAC, AGCACA, AGCACG, AGCACU, AGCAGA, AGCAUA, AGCAUC,

AGCAUG, AGCCAA, AGCCAU, AGCCCA, AGCCGA, AGCCGC, AGCCGG, AGCCGU, AGCCUA, AGCCUC,

AGCGAA, AGCGAG, AGCGAU, AGCGCA, AGCGCC, AGCGCG, AGCGCU, AGCGGA, AGCGGC, AGCGGU,

AGCGUA, AGCGUC, AGCGUG, AGCGUU, AGCUAA, AGCUAC, AGCUAG, AGCUAU, AGCUCA, AGCUCC,

AGCUCG, AGCUCU, AGCUGA, AGCUGG, AGCUGU, AGCUUC, AGCUUU, AGGAAU, AGGACC, AGGACG,

AGGAGA, AGGAGU, AGGAUA, AGGCAA, AGGCAU, AGGCCG, AGGCGA, AGGCGC, AGGCGG, AGGCUA,

AGGCUC, AGGCUU, AGGGAC, AGGGAU, AGGGGA, AGGGGU, AGGGUA, AGGGUG, AGGUAA, AGGUAC,

AGGUCA, AGGUCC, AGGUCU, AGGUGA, AGGUGC, AGGUGG, AGGUGU, AGGUUC, AGGUUG, AGUAAA,

AGUAAG, AGUAAU, AGUACA, AGUACG, AGUAGC, AGUAGG, AGUAUA, AGUAUC, AGUAUG, AGUAUU,

AGUCAA, AGUCAC, AGUCAG, AGUCAU, AGUCCA, AGUCCG, AGUCCU, AGUCGA, AGUCGC, AGUCGG,

AGUCGU, AGUCUA, AGUCUC, AGUCUG, AGUCUU, AGUGAA, AGUGAC, AGUGCG, AGUGGG, AGUGUC,

AGUUAA, AGUUAC, AGUUAG, AGUUCC, AGUUCG, AGUUGA, AGUUGC, AGUUGU, AGUUUA, AGUUUC,

AGUUUG, AGUUUU, AUAAAC, AUAAAU, AUAACA, AUAACC, AUAACG, AUAACU, AUAAGA, AUAAGC,

AUAAGG, AUAAGU, AUAAUC, AUAAUG, AUAAUU, AUACAC, AUACAG, AUACAU, AUACCA, AUACCC,

AUACCG, AUACGA, AUACGC, AUACGG, AUACGU, AUACUA, AUACUC, AUACUG, AUACUU, AUAGAA,

AUAGAC, AUAGAU, AUAGCA, AUAGCG, AUAGCU, AUAGGA, AUAGGU, AUAGUA, AUAGUC, AUAGUG,

AUAGUU, AUAUAC, AUAUAG, AUAUCC, AUAUCG, AUAUCU, AUAUGA, AUAUGC, AUAUGG, AUAUGU,

TABLE 3-continued

Hexamers that are not seed sequences of human miRNAs

AUAUUC, AUAUUG, AUAUUU, AUCAAA, AUCAAC, AUCAAG, AUCAAU, AUCACA, AUCACC, AUCACG,
AUCAGC, AUCAGG, AUCCAA, AUCCAU, AUCCCC, AUCCCG, AUCCGA, AUCCGC, AUCCGG, AUCCUA,
AUCCUC, AUCCUG, AUCGAA, AUCGAC, AUCGAG, AUCGAU, AUCGCA, AUCGCC, AUCGCG, AUCGCU,
AUCGGC, AUCGGG, AUCGGU, AUCGUC, AUCGUG, AUCGUU, AUCUAA, AUCUAC, AUCUAG, AUCUAU,
AUCUCC, AUCUCG, AUCUGU, AUCUUG, AUCUUU, AUGAAA, AUGAAC, AUGAAG, AUGAAU, AUGACC,
AUGACU, AUGAGG, AUGAGU, AUGAUA, AUGAUC, AUGAUU, AUGCAA, AUGCAG, AUGCCA, AUGCCC,
AUGCCG, AUGCGA, AUGCGG, AUGCGU, AUGCUC, AUGCUU, AUGGAC, AUGGCC, AUGGGA, AUGGGC,
AUGGGU, AUGGUC, AUGGUG, AUGUAC, AUGUAU, AUGUCA, AUGUCC, AUGUCG, AUGUGU, AUGUUA,
AUGUUC, AUUAAA, AUUAAC, AUUAAG, AUUAAU, AUUACA, AUUACC, AUUACG, AUUACU, AUUAGA,
AUUAGC, AUUAGG, AUUAGU, AUUAUA, AUUAUC, AUUAUG, AUUCAC, AUUCCA, AUUCCG, AUUCCU,
AUUCGA, AUUCGC, AUUCGG, AUUCGU, AUUCUA, AUUCUC, AUUCUU, AUUGAA, AUUGAC, AUUGAU,
AUUGCC, AUUGCG, AUUGCU, AUUGGA, AUUGGC, AUUGGG, AUUGGU, AUUGUA, AUUGUC, AUUGUG,
AUUGUU, AUUUAA, AUUUAG, AUUUAU, AUUUCC, AUUUCG, AUUUCU, AUUUGA, AUUUGC, AUUUGU,
AUUUUA, AUUUUC, AUUUUG, AUUUUU, CAAAAG, CAAACA, CAAACC, CAAACG, CAAACU, CAAAGA,
CAAAGG, CAAAUA, CAAAUU, CAACAC, CAACAU, CAACCA, CAACCC, CAACCG, CAACGA, CAACGC,
CAACGG, CAACGU, CAACUA, CAACUC, CAACUG, CAACUU, CAAGAA, CAAGAC, CAAGAU, CAAGCA,
CAAGCC, CAAGCG, CAAGCU, CAAGGA, CAAGGG, CAAGUC, CAAGUG, CAAGUU, CAAUAA, CAAUAC,
CAAUAG, CAAUCC, CAAUCG, CAAUCU, CAAUGA, CAAUGC, CAAUGG, CAAUGU, CAAUUC, CAAUUG,
CAAUUU, CACAAU, CACACA, CACACG, CACACU, CACAGA, CACAGC, CACAGG, CACAUA, CACAUC,
CACAUU, CACCAA, CACCAC, CACCAU, CACCCA, CACCCC, CACCCG, CACCGA, CACCGC, CACCGG,
CACCGU, CACCUA, CACCUU, CACGAA, CACGAC, CACGAG, CACGAU, CACGCA, CACGCC, CACGCU,
CACGGA, CACGGC, CACGGG, CACGGU, CACGUA, CACGUC, CACGUG, CACGUU, CACUAA, CACUAG,
CACUAU, CACUCA, CACUCG, CACUGA, CACUGC, CACUGG, CACUUA, CACUUC, CACUUU, CAGAAA,
CAGAAG, CAGAAU, CAGACC, CAGACG, CAGAGC, CAGAUA, CAGAUC, CAGCCG, CAGCCU, CAGCGA,
CAGCGC, CAGCGG, CAGCGU, CAGCUC, CAGCUU, CAGGAU, CAGGGG, CAGGGU, CAGGUA, CAGGUC,
CAGGUU, CAGUAC, CAGUCG, CAGUUG, CAUAAA, CAUAAC, CAUAAG, CAUAAU, CAUACA, CAUACC,
CAUACG, CAUACU, CAUAGA, CAUAGG, CAUAGU, CAUAUA, CAUAUC, CAUAUG, CAUCAA, CAUCAC,
CAUCAG, CAUCAU, CAUCCA, CAUCCC, CAUCCG, CAUCGA, CAUCGC, CAUCGG, CAUCGU, CAUCUA,
CAUCUC, CAUCUG, CAUCUU, CAUGAA, CAUGAC, CAUGAG, CAUGAU, CAUGCA, CAUGCC, CAUGCG,
CAUGCU, CAUGGC, CAUGGG, CAUGGU, CAUGUA, CAUGUC, CAUGUU, CAUUAA, CAUUAC, CAUUAG,
CAUUCA, CAUUCC, CAUUCG, CAUUCU, CAUUGA, CAUUGG, CAUUUC, CAUUUG, CAUUUU, CCAAAA,
CCAAAC, CCAAAG, CCAAAU, CCAACA, CCAACC, CCAACG, CCAACU, CCAAGA, CCAAGC, CCAAGG,
CCAAUC, CCAAUG, CCAAUU, CCACAA, CCACAC, CCACAG, CCACAU, CCACCA, CCACCC, CCACCG,
CCACCU, CCACGA, CCACGC, CCACGG, CCACGU, CCACUA, CCACUC, CCACUU, CCAGAA, CCAGAC,
CCAGAG, CCAGCC, CCAGGU, CCAGUC, CCAGUU, CCAUAA, CCAUAC, CCAUAG, CCAUAU, CCAUCA,
CCAUCC, CCAUCU, CCAUGA, CCAUGC, CCAUGG, CCAUUC, CCAUUG, CCAUUU, CCCAAC, CCCAAG,
CCCAAU, CCCACA, CCCAGA, CCCAGC, CCCAGU, CCCAUA, CCCAUC, CCCAUG, CCCAUU, CCCCAA,
CCCCAG, CCCCAU, CCCCCC, CCCCCG, CCCCCU, CCCCGA, CCCCGC, CCCCGU, CCCCUA, CCCCUC,
CCCGAA, CCCGAC, CCCGAU, CCCGCA, CCCGCU, CCCGGA, CCCGGC, CCCGUA, CCCGUG, CCCGUU,

TABLE 3-continued

Hexamers that are not seed sequences of human miRNAs

CCCUAA, CCCUAG, CCCUCA, CCCUCU, CCCUGC, CCCUUA, CCCUUC, CCCUUU, CCGAAA, CCGAAC,
CCGAAU, CCGACA, CCGACC, CCGACG, CCGACU, CCGAGA, CCGAGG, CCGAGU, CCGAUA, CCGAUC,
CCGAUG, CCGAUU, CCGCAA, CCGCAC, CCGCAG, CCGCAU, CCGCCA, CCGCCC, CCGCCG, CCGCCU,
CCGCGA, CCGCGC, CCGCGG, CCGCGU, CCGCUA, CCGCUC, CCGCUG, CCGCUU, CCGGAA, CCGGAU,
CCGGCA, CCGGCC, CCGGCG, CCGGCU, CCGGGA, CCGGGC, CCGGGG, CCGGGU, CCGGUA, CCGGUC,
CCGGUG, CCGUAA, CCGUAG, CCGUAU, CCGUCA, CCGUCC, CCGUCG, CCGUGA, CCGUGU, CCGUUA,
CCGUUC, CCGUUG, CCGUUU, CCUAAC, CCUAAG, CCUAAU, CCUACA, CCUACC, CCUACG, CCUACU,
CCUAGA, CCUAGC, CCUAGG, CCUAGU, CCUAUA, CCUAUC, CCUAUG, CCUAUU, CCUCAA, CCUCAC,
CCUCAG, CCUCAU, CCUCCA, CCUCCC, CCUCCG, CCUCGA, CCUCGC, CCUCGG, CCUCGU, CCUCUA,
CCUCUG, CCUGAC, CCUGAU, CCUGCA, CCUGGG, CCUGGU, CCUGUU, CCUUAA, CCUUAC, CCUUAG,
CCUUAU, CCUUCG, CCUUGA, CCUUGU, CCUUUA, CCUUUC, CCUUUU, CGAAAA, CGAAAC, CGAAAG,
CGAAAU, CGAACA, CGAACC, CGAACG, CGAACU, CGAAGA, CGAAGC, CGAAGG, CGAAGU, CGAAUA,
CGAAUC, CGAAUG, CGAAUU, CGACAA, CGACAC, CGACAU, CGACCA, CGACCU, CGACGA, CGACGC,
CGACGG, CGACGU, CGACUA, CGACUG, CGACUU, CGAGAA, CGAGAC, CGAGAG, CGAGAU, CGAGCA,
CGAGCC, CGAGCG, CGAGCU, CGAGGC, CGAGGG, CGAGGU, CGAGUA, CGAGUC, CGAGUG, CGAGUU,
CGAUAA, CGAUAC, CGAUAG, CGAUAU, CGAUCA, CGAUCC, CGAUCG, CGAUCU, CGAUGA, CGAUGC,
CGAUGG, CGAUGU, CGAUUA, CGAUUC, CGAUUG, CGAUUU, CGCAAA, CGCAAC, CGCAAG, CGCAAU,
CGCACA, CGCACC, CGCACG, CGCAGA, CGCAGC, CGCAGG, CGCAGU, CGCAUA, CGCAUC, CGCAUG,
CGCAUU, CGCCAA, CGCCAC, CGCCAG, CGCCAU, CGCCCA, CGCCCC, CGCCCG, CGCCGA, CGCCGC,
CGCCGG, CGCCGU, CGCCUA, CGCCUG, CGCCUU, CGCGAA, CGCGAC, CGCGAG, CGCGAU, CGCGCA,
CGCGCC, CGCGCG, CGCGCU, CGCGGA, CGCGGC, CGCGGG, CGCGGU, CGCGUA, CGCGUC, CGCGUG,
CGCGUU, CGCUAA, CGCUAC, CGCUAG, CGCUAU, CGCUCA, CGCUCC, CGCUCG, CGCUCU, CGCUGA,
CGCUGC, CGCUGG, CGCUGU, CGCUUA, CGCUUC, CGCUUG, CGGAAA, CGGAAC, CGGAAG, CGGACA,
CGGACC, CGGACG, CGGACU, CGGAGC, CGGAGG, CGGAGU, CGGAUA, CGGAUU, CGGCAA, CGGCAC,
CGGCAG, CGGCCA, CGGCCC, CGGCCG, CGGCGC, CGGCGG, CGGCGU, CGGCUA, CGGCUC, CGGCUG,
CGGCUU, CGGGAA, CGGGAC, CGGGAG, CGGGAU, CGGGCA, CGGGCC, CGGGCG, CGGGCU, CGGGGU,
CGGGUA, CGGGUC, CGGGUG, CGGUAA, CGGUAC, CGGUAG, CGGUAU, CGGUCA, CGGUCG, CGGUCU,
CGGUGA, CGGUGG, CGGUGU, CGGUUA, CGGUUC, CGGUUG, CGGUUU, CGUAAA, CGUAAC, CGUAAG,
CGUAAU, CGUACA, CGUACG, CGUACU, CGUAGA, CGUAGC, CGUAGG, CGUAGU, CGUAUA, CGUAUC,
CGUAUG, CGUAUU, CGUCAA, CGUCAC, CGUCAG, CGUCAU, CGUCCA, CGUCCC, CGUCCG, CGUCCU,
CGUCGA, CGUCGG, CGUCGU, CGUCUA, CGUCUC, CGUCUG, CGUCUU, CGUGAA, CGUGAC, CGUGAG,
CGUGAU, CGUGCC, CGUGCG, CGUGCU, CGUGGA, CGUGGG, CGUGGU, CGUGUA, CGUGUG, CGUUAA,
CGUUAC, CGUUAG, CGUUAU, CGUUCA, CGUUCC, CGUUCG, CGUUCU, CGUUGA, CGUUGC, CGUUGU,
CGUUUA, CGUUUC, CGUUUU, CUAAAA, CUAAAC, CUAAAU, CUAACA, CUAACC, CUAACG, CUAACU,
CUAAGA, CUAAGC, CUAAGU, CUAAUA, CUAAUC, CUAAUG, CUACAC, CUACAU, CUACCA, CUACCC,
CUACCG, CUACCU, CUACGA, CUACGC, CUACGG, CUACGU, CUACUA, CUACUC, CUACUG, CUAGAA,
CUAGAG, CUAGAU, CUAGCA, CUAGCC, CUAGCG, CUAGCU, CUAGGA, CUAGGG, CUAGGU, CUAGUG,
CUAGUU, CUAUAA, CUAUAG, CUAUAU, CUAUCA, CUAUCC, CUAUCG, CUAUCU, CUAUGA, CUAUGC,
CUAUGG, CUAUGU, CUAUUA, CUAUUG, CUCAAC, CUCAAG, CUCAAU, CUCACC, CUCACG, CUCAGC,

TABLE 3-continued

Hexamers that are not seed sequences of human miRNAs

CUCAUA, CUCAUC, CUCAUG, CUCAUU, CUCCAC, CUCCCC, CUCCCG, CUCCGA, CUCCGC, CUCCGG,
CUCCUA, CUCCUC, CUCCUU, CUCGAA, CUCGAC, CUCGAG, CUCGAU, CUCGCA, CUCGCC, CUCGCG,
CUCGGG, CUCGGU, CUCGUA, CUCGUC, CUCGUG, CUCGUU, CUCUAA, CUCUAC, CUCUAU, CUCUCA,
CUCUCC, CUCUCU, CUCUGC, CUCUGU, CUCUUA, CUCUUG, CUGAAG, CUGACC, CUGACG, CUGAGC,
CUGAUA, CUGAUC, CUGCCG, CUGCCU, CUGCGA, CUGCUA, CUGCUU, CUGGAG, CUGGAU, CUGGCG,
CUGGGU, CUGUAC, CUGUCA, CUGUCC, CUGUCG, CUGUGG, CUGUGU, CUGUUA, CUGUUU, CUUAAC,
CUUAAG, CUUAAU, CUUACC, CUUACG, CUUAGA, CUUAGC, CUUAGG, CUUAGU, CUUAUA, CUUAUC,
CUUAUG, CUUAUU, CUUCAG, CUUCAU, CUUCCA, CUUCCC, CUUCCG, CUUCCU, CUUCGA, CUUCGC,
CUUCGG, CUUCGU, CUUCUA, CUUGAC, CUUGAG, CUUGAU, CUUGCA, CUUGCC, CUUGCG, CUUGCU,
CUUGGC, CUUGGU, CUUGUU, CUUUAC, CUUUAG, CUUUAU, CUUUCA, CUUUCG, CUUUCU, CUUUGA,
CUUUGC, CUUUGU, CUUUUA, CUUUUC, CUUUUG, CUUUUU, GAAAAA, GAAAAG, GAAAAU, GAAACC,
GAAACG, GAAAGA, GAAAGC, GAAAGU, GAAAUA, GAAAUC, GAAAUG, GAAAUU, GAACAA, GAACAC,
GAACAG, GAACAU, GAACCA, GAACCC, GAACCG, GAACCU, GAACGA, GAACGC, GAACGG, GAACGU,
GAACUA, GAACUG, GAACUU, GAAGAC, GAAGAG, GAAGCA, GAAGCG, GAAGCU, GAAGUC, GAAUAA,
GAAUAC, GAAUAG, GAAUAU, GAAUCC, GAAUCG, GAAUCU, GAAUGA, GAAUGC, GAAUGU, GAAUUA,
GAAUUC, GAAUUU, GACAAA, GACAAG, GACAAU, GACACC, GACAGA, GACAGG, GACAUA, GACAUG,
GACAUU, GACCAA, GACCAC, GACCAG, GACCCA, GACCCC, GACCCG, GACCGC, GACCGG, GACCGU,
GACCUA, GACCUC, GACCUU, GACGAA, GACGAC, GACGAG, GACGAU, GACGCA, GACGCC, GACGCG,
GACGCU, GACGGA, GACGGC, GACGGG, GACGGU, GACGUA, GACGUC, GACGUG, GACGUU, GACUAA,
GACUAC, GACUAG, GACUAU, GACUCA, GACUCC, GACUCG, GACUGG, GACUGU, GACUUA, GACUUG,
GACUUU, GAGAAU, GAGAGA, GAGAGC, GAGAGG, GAGAUA, GAGAUC, GAGCAA, GAGCAU, GAGCCA,
GAGCGA, GAGCGG, GAGCGU, GAGGGU, GAGGUC, GAGGUG, GAGUAA, GAGUAG, GAGUCC, GAGUUC,
GAGUUU, GAUAAA, GAUAAC, GAUAAG, GAUAAU, GAUACA, GAUACC, GAUACG, GAUACU, GAUAGA,
GAUAGC, GAUAGG, GAUAGU, GAUAUA, GAUCAA, GAUCAC, GAUCAU, GAUCCA, GAUCCC, GAUCCU,
GAUCGC, GAUCGG, GAUCGU, GAUCUA, GAUCUG, GAUCUU, GAUGAA, GAUGAC, GAUGAG, GAUGCA,
GAUGCC, GAUGCG, GAUGCU, GAUGGC, GAUGGG, GAUGGU, GAUGUG, GAUGUU, GAUUAA, GAUUAC,
GAUUAG, GAUUAU, GAUUCA, GAUUCG, GAUUCU, GAUUGA, GAUUGC, GAUUUA, GAUUUC, GAUUUG,
GAUUUU, GCAAAC, GCAAAG, GCAAAU, GCAACA, GCAACC, GCAAGC, GCAAGU, GCAAUA, GCAAUC,
GCAAUG, GCAAUU, GCACAA, GCACAC, GCACAG, GCACCC, GCACCG, GCACCU, GCACGA, GCACGC,
GCACGU, GCACUA, GCACUC, GCACUG, GCACUU, GCAGAU, GCAGCC, GCAGCG, GCAGGC, GCAGUA,
GCAGUC, GCAGUG, GCAGUU, GCAUAA, GCAUAG, GCAUAU, GCAUCG, GCAUCU, GCAUGA, GCAUGC,
GCAUGG, GCAUGU, GCAUUA, GCAUUC, GCAUUG, GCAUUU, GCCAAA, GCCAAC, GCCAAU, GCCACA,
GCCACC, GCCACG, GCCAGA, GCCAGU, GCCAUA, GCCAUC, GCCAUG, GCCAUU, GCCCAA, GCCCAC,
GCCCAG, GCCCCG, GCCCGA, GCCCGG, GCCCGU, GCCGAA, GCCGAC, GCCGAG, GCCGAU, GCCGCA,
GCCGCU, GCCGGA, GCCGGC, GCCGGG, GCCGGU, GCCGUA, GCCGUC, GCCGUG, GCCGUU, GCCUAA,
GCCUAU, GCCUCA, GCCUCC, GCCUCG, GCCUGA, GCCUUA, GCCUUU, GCGAAA, GCGAAC, GCGAAG,
GCGAAU, GCGACC, GCGACG, GCGACU, GCGAGA, GCGAGC, GCGAGG, GCGAGU, GCGAUA, GCGAUC,
GCGAUG, GCGAUU, GCGCAA, GCGCAC, GCGCAG, GCGCAU, GCGCCA, GCGCCC, GCGCCU, GCGCGA,
GCGCGU, GCGCUA, GCGCUC, GCGCUG, GCGCUU, GCGGAA, GCGGAC, GCGGAU, GCGGCA, GCGGCC,

TABLE 3-continued

Hexamers that are not seed sequences of human miRNAs

GCGGCU, GCGGGA, GCGGUA, GCGGUC, GCGGUU, GCGUAA, GCGUAC, GCGUAG, GCGUAU, GCGUCA,
GCGUCC, GCGUCG, GCGUCU, GCGUGA, GCGUGC, GCGUGG, GCGUGU, GCGUUA, GCGUUC, GCGUUG,
GCGUUU, GCUAAA, GCUAAC, GCUAAG, GCUAAU, GCUACC, GCUACG, GCUACU, GCUAGA, GCUAGG,
GCUAGU, GCUAUA, GCUAUC, GCUAUU, GCUCAA, GCUCAC, GCUCAG, GCUCAU, GCUCCA, GCUCCC,
GCUCCG, GCUCGA, GCUCGC, GCUCGU, GCUCUA, GCUCUC, GCUCUU, GCUGAA, GCUGAC, GCUGAU,
GCUGCA, GCUGCC, GCUGCG, GCUGCU, GCUGUG, GCUGUU, GCUUAC, GCUUAG, GCUUAU, GCUUCA,
GCUUCG, GCUUGA, GCUUGG, GCUUGU, GCUUUA, GCUUUG, GGAAAG, GGAACA, GGAACC, GGAACG,
GGAACU, GGAAGU, GGAAUA, GGAAUC, GGAAUU, GGACAA, GGACAC, GGACAG, GGACAU, GGACCG,
GGACGA, GGACGC, GGACGU, GGACUA, GGACUC, GGACUU, GGAGAC, GGAGCA, GGAGCG, GGAGGG,
GGAGUA, GGAUAA, GGAUAC, GGAUCA, GGAUCC, GGAUCG, GGAUCU, GGAUGC, GGAUUA, GGAUUG,
GGCAAU, GGCACA, GGCACU, GGCAGA, GGCAUA, GGCAUC, GGCCAC, GGCCAG, GGCCCC, GGCCGA,
GGCCGC, GGCCGU, GGCCUA, GGCCUG, GGCCUU, GGCGAA, GGCGAG, GGCGAU, GGCGCA, GGCGCU,
GGCGGU, GGCGUA, GGCGUC, GGCGUG, GGCGUU, GGCUAA, GGCUAC, GGCUAG, GGCUAU, GGCUCC,
GGCUCG, GGCUGA, GGCUUA, GGCUUC, GGCUUG, GGGAAU, GGGACA, GGGAGA, GGGAGU, GGGAUA,
GGGAUU, GGGCAA, GGGCAC, GGGCAG, GGGCCG, GGGCGG, GGGGCC, GGGGGG, GGGGGU, GGGGUA,
GGGUAC, GGGUAU, GGGUCA, GGGUCC, GGGUCG, GGGUGA, GGGUGC, GGGUUA, GGGUUG, GGUAAA,
GGUAAC, GGUAAG, GGUAAU, GGUACA, GGUACC, GGUACG, GGUACU, GGUAGC, GGUAGG, GGUAGU,
GGUAUA, GGUAUC, GGUAUG, GGUCAA, GGUCAC, GGUCAG, GGUCAU, GGUCCA, GGUCCG, GGUCCU,
GGUCGA, GGUCGC, GGUCGG, GGUCGU, GGUCUC, GGUCUU, GGUGAA, GGUGAC, GGUGAU, GGUGCA,
GGUGCC, GGUGGC, GGUGUA, GGUGUC, GGUUAA, GGUUAG, GGUUAU, GGUUCA, GGUUCC, GGUUCG,
GGUUGC, GGUUUC, GGUUUU, GUAAAA, GUAAAG, GUAAAU, GUAACC, GUAACG, GUAACU, GUAAGA,
GUAAGC, GUAAGG, GUAAGU, GUAAUA, GUAAUC, GUAAUG, GUAAUU, GUACAA, GUACAC, GUACAG,
GUACAU, GUACCA, GUACCC, GUACCG, GUACCU, GUACGA, GUACGC, GUACGG, GUACGU, GUACUA,
GUACUC, GUACUG, GUACUU, GUAGAA, GUAGAC, GUAGCA, GUAGCC, GUAGCG, GUAGCU, GUAGGA,
GUAGGC, GUAGGG, GUAGGU, GUAGUA, GUAGUC, GUAUAA, GUAUAC, GUAUAG, GUAUAU, GUAUCA,
GUAUCG, GUAUCU, GUAUGA, GUAUGC, GUAUGG, GUAUUA, GUAUUG, GUAUUU, GUCAAA, GUCAAG,
GUCAAU, GUCACA, GUCACC, GUCACG, GUCAGA, GUCAGC, GUCAGG, GUCAUA, GUCAUC, GUCAUG,
GUCCAA, GUCCAC, GUCCAU, GUCCCC, GUCCCU, GUCCGA, GUCCGC, GUCCGG, GUCCGU, GUCCUA,
GUCCUG, GUCCUU, GUCGAA, GUCGAC, GUCGAG, GUCGAU, GUCGCA, GUCGCC, GUCGCG, GUCGCU,
GUCGGA, GUCGGC, GUCGGG, GUCGGU, GUCGUA, GUCGUC, GUCGUU, GUCUAA, GUCUAG, GUCUCA,
GUCUCC, GUCUCG, GUCUGA, GUCUGG, GUCUGU, GUCUUC, GUCUUU, GUGAAA, GUGAAC, GUGAAG,
GUGACC, GUGACG, GUGAGA, GUGAGC, GUGAGU, GUGAUC, GUGAUG, GUGAUU, GUGCAC, GUGCAU,
GUGCCC, GUGCCG, GUGCGA, GUGCGG, GUGCGU, GUGCUA, GUGCUC, GUGCUG, GUGGAG, GUGGCG,
GUGGCU, GUGGGU, GUGGUC, GUGGUG, GUGUAA, GUGUAG, GUGUCG, GUGUGA, GUGUGC, GUGUGU,
GUGUUG, GUGUUU, GUUAAA, GUUAAC, GUUAAG, GUUACA, GUUACC, GUUACG, GUUACU, GUUAGA,
GUUAGC, GUUAGU, GUUAUA, GUUAUC, GUUAUG, GUUAUU, GUUCAA, GUUCAC, GUUCAG, GUUCCA,
GUUCCG, GUUCGA, GUUCGC, GUUCGG, GUUCGU, GUUCUA, GUUCUG, GUUGAA, GUUGAC, GUUGAG,
GUUGAU, GUUGCG, GUUGCU, GUUGGA, GUUGGC, GUUGGU, GUUGUC, GUUGUG, GUUGUU, GUUUAA,
GUUUAC, GUUUAG, GUUUAU, GUUUCA, GUUUCC, GUUUCU, GUUUGA, GUUUGC, GUUUGG, GUUUGU,

TABLE 3-continued

Hexamers that are not seed sequences of human miRNAs

GUUUUA, GUUUUC, GUUUUU, UAAAAA, UAAAAC, UAAAAG, UAAAAU, UAAACA, UAAACC, UAAACG,
UAAACU, UAAAGA, UAAAGG, UAAAGU, UAAAUA, UAAAUC, UAAAUG, UAAAUU, UAACAA, UAACAC,
UAACAG, UAACCA, UAACCC, UAACCG, UAACCU, UAACGA, UAACGC, UAACGG, UAACGU, UAACUA,
UAACUG, UAACUU, UAAGAG, UAAGAU, UAAGCA, UAAGCC, UAAGCG, UAAGCU, UAAGGA, UAAGGC,
UAAGGG, UAAGGU, UAAGUA, UAAGUC, UAAGUG, UAAGUU, UAAUAA, UAAUCA, UAAUCC, UAAUCG,
UAAUCU, UAAUGA, UAAUGG, UAAUGU, UAAUUA, UAAUUC, UAAUUG, UACAAC, UACAAG, UACAAU,
UACACC, UACACG, UACACU, UACAGA, UACAGC, UACAUA, UACAUC, UACAUU, UACCAA, UACCAC,
UACCAG, UACCAU, UACCCC, UACCCG, UACCCU, UACCGA, UACCGC, UACCGG, UACCGU, UACCUA,
UACCUG, UACGAA, UACGAC, UACGAG, UACGAU, UACGCA, UACGCC, UACGCG, UACGCU, UACGGC,
UACGGG, UACGGU, UACGUA, UACGUC, UACGUG, UACGUU, UACUAA, UACUAC, UACUAG, UACUAU,
UACUCA, UACUCC, UACUCG, UACUCU, UACUGA, UACUGC, UACUGG, UACUUA, UACUUG, UACUUU,
UAGAAA, UAGAAG, UAGAAU, UAGACA, UAGACG, UAGAGA, UAGAGC, UAGAGU, UAGAUA, UAGAUC,
UAGAUG, UAGCAU, UAGCCC, UAGCCG, UAGCCU, UAGCGA, UAGCGC, UAGCGU, UAGCUA, UAGCUC,
UAGCUG, UAGGAA, UAGGAU, UAGGCG, UAGGCU, UAGGGU, UAGGUC, UAGGUG, UAGGUU, UAGUAA,
UAGUAC, UAGUAG, UAGUAU, UAGUCA, UAGUCG, UAGUGU, UAGUUA, UAGUUC, UAGUUG, UAGUUU,
UAUAAC, UAUAAG, UAUACU, UAUAGA, UAUAGC, UAUAGG, UAUAGU, UAUAUA, UAUAUC, UAUAUG,
UAUAUU, UAUCAA, UAUCAC, UAUCAU, UAUCCA, UAUCCC, UAUCCG, UAUCCU, UAUCGA, UAUCGC,
UAUCGG, UAUCGU, UAUCUA, UAUCUC, UAUCUG, UAUCUU, UAUGAA, UAUGAC, UAUGAG, UAUGAU,
UAUGCA, UAUGCG, UAUGCU, UAUGGA, UAUGGC, UAUGUC, UAUGUG, UAUGUU, UAUUAG, UAUUCA,
UAUUCC, UAUUCG, UAUUCU, UAUUGA, UAUUGG, UAUUUA, UAUUUC, UAUUUG, UAUUUU, UCAAAA,
UCAAAC, UCAAAG, UCAACC, UCAACU, UCAAGA, UCAAGC, UCAAUA, UCAAUC, UCAAUG, UCAAUU,
UCACCC, UCACCG, UCACCU, UCACGA, UCACGC, UCACGG, UCACGU, UCACUA, UCACUC, UCACUU,
UCAGAA, UCAGAC, UCAGAG, UCAGCG, UCAGCU, UCAGGA, UCAGGC, UCAGGU, UCAGUC, UCAGUU,
UCAUAA, UCAUCA, UCAUCC, UCAUCG, UCAUGC, UCAUGG, UCAUGU, UCAUUA, UCAUUG, UCCAAA,
UCCAAC, UCCAAG, UCCAAU, UCCACA, UCCACC, UCCACG, UCCAGC, UCCAGG, UCCAUA, UCCAUC,
UCCAUU, UCCCAA, UCCCAG, UCCCAU, UCCCCC, UCCCCG, UCCCCU, UCCCGA, UCCCGC, UCCCGG,
UCCCGU, UCCCUA, UCCCUC, UCCGAA, UCCGAC, UCCGAG, UCCGAU, UCCGCA, UCCGCC, UCCGGA,
UCCGGC, UCCGGU, UCCGUA, UCCGUC, UCCGUG, UCCUAA, UCCUCA, UCCUCG, UCCUCU, UCCUGC,
UCCUGU, UCCUUA, UCCUUC, UCCUUU, UCGAAA, UCGAAC, UCGAAG, UCGAAU, UCGACA, UCGACC,
UCGACG, UCGACU, UCGAGA, UCGAGC, UCGAGG, UCGAUA, UCGAUC, UCGAUG, UCGAUU, UCGCAA,
UCGCAC, UCGCAG, UCGCAU, UCGCCA, UCGCCC, UCGCCG, UCGCCU, UCGCGA, UCGCGC, UCGCGU,
UCGCUA, UCGCUC, UCGGAA, UCGGAC, UCGGAG, UCGGAU, UCGGCA, UCGGCU, UCGGGG, UCGGGU,
UCGGUC, UCGGUG, UCGGUU, UCGUAA, UCGUAC, UCGUAG, UCGUAU, UCGUCA, UCGUCC, UCGUCG,
UCGUCU, UCGUGA, UCGUGU, UCGUUA, UCGUUC, UCGUUG, UCGUUU, UCUAAC, UCUAAG, UCUAAU,
UCUACA, UCUACC, UCUACG, UCUACU, UCUAGC, UCUAGG, UCUAGU, UCUAUA, UCUAUC, UCUAUG,
UCUAUU, UCUCAG, UCUCAU, UCUCCG, UCUCGC, UCUCGG, UCUCGU, UCUCUC, UCUGAA, UCUGAU,
UCUGCA, UCUGCG, UCUGCU, UCUGGC, UCUGGU, UCUGUC, UCUGUG, UCUGUU, UCUUAA, UCUUAC,
UCUUAG, UCUUAU, UCUUCA, UCUUCC, UCUUCG, UCUUCU, UCUUGC, UCUUGG, UCUUGU, UCUUUA,
UCUUUC, UCUUUG, UCUUUU, UGAAAA, UGAAAC, UGAACA, UGAACC, UGAAGG, UGAAUC, UGAAUG,

TABLE 3-continued

Hexamers that are not seed sequences of human miRNAs

UGACAA, UGACAC, UGACAG, UGACCA, UGACCC, UGACCG, UGACGA, UGACGC, UGACGG, UGACGU,
UGACUA, UGACUC, UGACUU, UGAGAG, UGAGAU, UGAGCA, UGAGCC, UGAGCU, UGAGGC, UGAGGU,
UGAGUA, UGAGUU, UGAUAC, UGAUAG, UGAUAU, UGAUCA, UGAUCG, UGAUCU, UGAUGA, UGAUGC,
UGAUGG, UGAUGU, UGAUUA, UGAUUC, UGAUUG, UGAUUU, UGCAAC, UGCAAG, UGCACA, UGCACG,
UGCAGG, UGCAGU, UGCAUC, UGCCCA, UGCCCC, UGCCCG, UGCCGA, UGCCGC, UGCCGG, UGCCGU,
UGCCUA, UGCCUC, UGCCUG, UGCCUU, UGCGAA, UGCGAC, UGCGAU, UGCGCC, UGCGCG, UGCGCU,
UGCGGC, UGCGGG, UGCGGU, UGCGUA, UGCGUC, UGCGUG, UGCGUU, UGCUAC, UGCUAU, UGCUCC,
UGCUCG, UGCUGC, UGCUGG, UGCUGU, UGCUUA, UGCUUU, UGGAAC, UGGAAG, UGGAGC, UGGAUC,
UGGAUU, UGGCAA, UGGCAC, UGGCAG, UGGCCG, UGGCCU, UGGCGA, UGGCGC, UGGCGU, UGGCUA,
UGGCUC, UGGCUU, UGGGAA, UGGGCA, UGGGCC, UGGGGC, UGGGUC, UGGUAA, UGGUAG, UGGUAU,
UGGUCC, UGGUCG, UGGUCU, UGGUGA, UGGUGC, UGGUGG, UGGUGU, UGGUUA, UGGUUG, UGUAAA,
UGUAAC, UGUAAG, UGUACC, UGUACG, UGUACU, UGUAGA, UGUAGC, UGUAGU, UGUAUC, UGUAUU,
UGUCAA, UGUCAC, UGUCAG, UGUCAU, UGUCCA, UGUCCC, UGUCCG, UGUCGA, UGUCGC, UGUCGG,
UGUCGU, UGUCUA, UGUCUC, UGUGAC, UGUGAG, UGUGAU, UGUGCA, UGUGGU, UGUGUA, UGUGUU,
UGUUAC, UGUUAG, UGUUAU, UGUUCA, UGUUCC, UGUUCG, UGUUGG, UGUUGU, UGUUUA, UGUUUC,
UGUUUG, UGUUUU, UUAAAA, UUAAAC, UUAAAG, UUAAAU, UUAACC, UUAACG, UUAACU, UUAAGU,
UUAAUA, UUAAUC, UUAAUG, UUAAUU, UUACAA, UUACAC, UUACAG, UUACAU, UUACCA, UUACCC,
UUACCG, UUACCU, UUACGA, UUACGC, UUACGG, UUACGU, UUACUA, UUACUC, UUACUG, UUACUU,
UUAGAA, UUAGAC, UUAGCC, UUAGCG, UUAGCU, UUAGGC, UUAGGU, UUAGUA, UUAGUC, UUAGUU,
UUAUAA, UUAUAC, UUAUAG, UUAUAU, UUAUCC, UUAUCG, UUAUCU, UUAUGA, UUAUGG, UUAUGU,
UUAUUA, UUAUUC, UUAUUG, UUAUUU, UUCAAC, UUCAAU, UUCACA, UUCACC, UUCACG, UUCACU,
UUCAGC, UUCAGG, UUCAGU, UUCAUA, UUCAUC, UUCAUG, UUCAUU, UUCCAA, UUCCCA, UUCCCG,
UUCCGA, UUCCGU, UUCCUU, UUCGAA, UUCGAC, UUCGAG, UUCGAU, UUCGCA, UUCGCC, UUCGCG,
UUCGCU, UUCGGA, UUCGGC, UUCGGG, UUCGGU, UUCGUA, UUCGUC, UUCGUG, UUCGUU, UUCUAC,
UUCUAG, UUCUCA, UUCUCG, UUCUGG, UUCUUA, UUCUUU, UUGAAA, UUGAAC, UUGAAG, UUGAAU,
UUGACC, UUGACG, UUGACU, UUGAGA, UUGAGC, UUGAGU, UUGAUA, UUGAUC, UUGAUG, UUGAUU,
UUGCAA, UUGCAC, UUGCAG, UUGCAU, UUGCCC, UUGCCG, UUGCGA, UUGCGC, UUGCGG, UUGCGU,
UUGCUA, UUGCUC, UUGCUG, UUGCUU, UUGGAA, UUGGAG, UUGGCC, UUGGCG, UUGGCU, UUGGGC,
UUGGGU, UUGGUA, UUGGUG, UUGUAA, UUGUAC, UUGUCA, UUGUCG, UUGUCU, UUGUGC, UUGUGG,
UUGUUA, UUGUUG, UUGUUU, UUUAAA, UUUAAC, UUUAAG, UUUAAU, UUUACA, UUUACC, UUUACG,
UUUACU, UUUAGA, UUUAGC, UUUAGG, UUUAGU, UUUAUA, UUUAUC, UUUAUG, UUUAUU, UUUCAU,
UUUCCA, UUUCCG, UUUCCU, UUUCGA, UUUCGC, UUUCGG, UUUCGU, UUUCUA, UUUCUC, UUUCUG,
UUUCUU, UUUGAA, UUUGAC, UUUGAG, UUUGAU, UUUGCC, UUUGCU, UUUGGA, UUUGGC, UUUGGG,
UUUGGU, UUUGUA, UUUGUC, UUUGUU, UUUUAA, UUUUAG, UUUUAU, UUUUCC, UUUUCG, UUUUCU,
UUUUGA, UUUUGC, UUUUGG, UUUUGU, UUUUUA, UUUUUC, UUUUUU

TABLE 2

A listing of oligonucleotide modifications

| Symbol | Feature Description |
|---|---|
| bio | 5' biotin |
| dAs | DNA w/3' thiophosphate |
| dCs | DNA w/3' thiophosphate |
| dGs | DNA w/3' thiophosphate |
| dTs | DNA w/3' thiophosphate |
| dG | DNA w/3' phosphate |
| dT | DNA w/3' phosphate |
| dU | deoxyuridine w/3' phosphate |
| d5mCs | deoxy-5-methylcytidine w/3' thiophosphate |
| enaAs | ENA w/3' thiophosphate |
| enaCs | ENA w/3' thiophosphate |
| enaGs | ENA w/3' thiophosphate |
| enaTs | ENA w/3' thiophosphate |
| fluAs | 2'-fluoro w/3' thiophosphate |
| fluCs | 2'-fluoro w/3' thiophosphate |
| fluGs | 2'-fluoro w/3' thiophosphate |
| fluUs | 2'-fluoro w/3' thiophosphate |
| lnaAs | LNA w/3' thiophosphate |
| lnaCs | LNA w/3' thiophosphate |
| lnaGs | LNA w/3' thiophosphate |
| lnaTs | LNA w/3' thiophosphate |
| omeAs | 2'-OMe w/3' thiophosphate |
| omeCs | 2'-OMe w/3' thiophosphate |
| omeGs | 2'-OMe w/3' thiophosphate |
| omeTs | 2'-OMe w/3' thiophosphate |
| lnaAs-Sup | LNA w/3' thiophosphate at 3' terminus |

TABLE 2-continued

A listing of oligonucleotide modifications

| Symbol | Feature Description |
|---|---|
| lnaCs-Sup | LNA w/3' thiophosphate at 3' terminus |
| lnaGs-Sup | LNA w/3' thiophosphate at 3' terminus |
| lnaTs-Sup | LNA w/3' thiophosphate at 3' terminus |
| lnaA-Sup | LNA w/3' OH at 3' terminus |
| lnaC-Sup | LNA w/3' OH at 3' terminus |
| lnaG-Sup | LNA w/3' OH at 3' terminus |
| lnaT-Sup | LNA w/3' OH at 3' terminus |
| omeA-Sup | 2'-OMe w/3' OH at 3' terminus |
| omeC-Sup | 2'-OMe w/3' OH at 3' terminus |
| omeG-Sup | 2'-OMe w/3' OH at 3' terminus |
| omeU-Sup | 2'-OMe w/3' OH at 3' terminus |
| dAs-Sup | DNA w/3' thiophosphate at 3' terminus |
| dCs-Sup | DNA w/3' thiophosphate at 3' terminus |
| dGs-Sup | DNA w/3' thiophosphate at 3' terminus |
| dTs-Sup | DNA w/3' thiophosphate at 3' terminus |
| dA-Sup | DNA w/3' OH at 3' terminus |
| dC-Sup | DNA w/3' OH at 3' terminus |
| dG-Sup | DNA w/3' OH at 3' terminus |
| dT-Sup | DNA w/3' OH at 3' terminus |
| dU | deoxyuridine w/3' OH at 3' terminus |
| rA | RNA w/3' phosphate |
| rC | RNA w/3' phosphate |
| rG | RNA w/3' phosphate |
| rU | RNA w/3' phosphate |

TABLE 3

Formatted oligonucleotide sequences made for testing in the lab showing nucleotide modifications.

| Oligo | OligoID | Base Sequence | Formatted Sequence | SeqID |
|---|---|---|---|---|
| 1 | ATP2A2-01 | GCGGTGTTCCCGAGG | lnaGs; omeCs; lnaGs; omeGs; lnaTs; omeGs; lnaTs; omeUs; lnaCs; omeCs; lnaCs; omeGs; lnaAs; omeGs; lnaG-Sup | 59724 |
| 2 | ATP2A2-02 | GTGTTCCCGAGGCGA | lnaGs; omeUs; lnaGs; omeUs; lnaTs; omeCs; lnaCs; omeCs; lnaGs; omeAs; lnaGs; omeGs; lnaCs; omeGs; lnaA-Sup | 59725 |
| 3 | ATP2A2-03 | TGTTCCCGAGGCGAC | lnaTs; omeGs; lnaTs; omeUs; lnaCs; omeCs; lnaCs; omeGs; lnaAs; omeGs; lnaGs; omeCs; lnaGs; omeAs; lnaC-Sup | 59726 |
| 4 | ATP2A2-04 | GCGGCCTCGATCCGG | lnaGs; omeCs; lnaGs; omeGs; lnaCs; omeCs; lnaTs; omeCs; lnaGs; omeAs; lnaTs; omeCs; lnaCs; omeGs; lnaG-Sup | 59727 |
| 5 | ATP2A2-05 | GCGTCCACATGCCGC | lnaGs; omeCs; lnaGs; omeUs; lnaCs; omeCs; lnaAs; omeCs; lnaAs; omeUs; lnaGs; omeCs; lnaCs; omeGs; lnaC-Sup | 59728 |
| 6 | ATP2A2-06 | CACATGCCGCGGCGG | lnaCs; omeAs; lnaCs; omeAs; lnaTs; omeGs; lnaCs; omeCs; lnaGs; omeCs; lnaGs; omeGs; lnaCs; omeGs; lnaG-Sup | 59729 |
| 7 | ATP2A2-07 | GGCAGCGGCCGATAA | lnaGs; omeGs; lnaCs; omeAs; lnaGs; omeCs; lnaGs; omeGs; lnaCs; omeCs; lnaGs; omeAs; lnaTs; omeAs; lnaA-Sup | 59730 |
| 8 | ATP2A2-08 | AGCGGCCGATAAATG | lnaAs; omeGs; lnaCs; omeGs; lnaGs; omeCs; lnaCs; omeGs; lnaAs; omeUs; lnaAs; omeAs; lnaAs; omeUs; lnaG-Sup | 59731 |
| 9 | ATP2A2-09 | CGGCCGATAAATGCT | lnaCs; omeGs; lnaGs; omeCs; lnaCs; omeGs; lnaAs; omeUs; lnaAs; omeAs; lnaAs; omeUs; lnaGs; omeCs; lnaT-Sup | 59732 |
| 10 | ATP2A2-10 | GAGCCGTCCCCGACG | lnaGs; omeAs; lnaGs; omeCs; lnaCs; omeGs; lnaTs; omeCs; lnaCs; omeCs; lnaCs; omeGs; lnaAs; omeCs; lnaG-Sup | 59733 |

TABLE 3-continued

Formatted oligonucleotide sequences made for testing in the lab showing nucleotide modifications.

| Oligo | OligoID | Base Sequence | Formatted Sequence | SeqID |
|---|---|---|---|---|
| 11 | ATP2A2-11 | CCATGGAGAACGCGC | InaCs; omeCs; InaAs; omeUs; InaGs; omeGs; InaAs; omeGs; InaAs; omeAs; InaCs; omeGs; InaCs; omeGs; InaC-Sup | 59734 |
| 12 | ATP2A2-12 | CTTCGGCGTCAACGA | InaCs; omeUs; InaTs; omeCs; InaGs; omeGs; InaCs; omeGs; InaTs; omeCs; InaAs; omeAs; InaCs; omeGs; InaA-Sup | 59735 |
| 13 | ATP2A2-13 | TTCGGCGTCAACGAG | InaTs; omeUs; InaCs; omeGs; InaGs; omeCs; InaGs; omeUs; InaCs; omeAs; InaAs; omeCs; InaGs; omeAs; InaG-Sup | 59736 |
| 14 | ATP2A2-14 | GTCAACGAGAGTACG | InaGs; omeUs; InaCs; omeAs; InaAs; omeCs; InaGs; omeAs; InaGs; omeAs; InaGs; omeUs; InaAs; omeCs; InaG-Sup | 59737 |
| 15 | ATP2A2-15 | TCAACGAGAGTACGG | InaTs; omeCs; InaAs; omeAs; InaCs; omeGs; InaAs; omeGs; InaAs; omeGs; InaTs; omeAs; InaCs; omeGs; InaG-Sup | 59738 |
| 16 | ATP2A2-16 | GGCTCCAACGGTAGG | InaGs; omeGs; InaCs; omeUs; InaCs; omeCs; InaAs; omeAs; InaCs; omeGs; InaGs; omeUs; InaAs; omeGs; InaG-Sup | 59739 |
| 17 | ATP2A2-17 | CCGCATCGGCATCTT | InaCs; omeCs; InaGs; omeCs; InaAs; omeUs; InaCs; omeGs; InaGs; omeCs; InaAs; omeUs; InaCs; omeUs; InaT-Sup | 52310 |
| 18 | ATP2A2-18 | TGGTCCTGGCGGATG | InaTs; omeGs; InaGs; omeUs; InaCs; omeCs; InaTs; omeGs; InaGs; omeCs; InaGs; omeGs; InaAs; omeUs; InaG-Sup | 53734 |
| 19 | ATP2A2-19 | GTCCTGGCGGATGAC | InaGs; omeUs; InaCs; omeCs; InaTs; omeGs; InaGs; omeCs; InaGs; omeGs; InaAs; omeUs; InaGs; omeAs; InaC-Sup | 53736 |
| 20 | ATP2A2-20 | CAGTTCATCCGCTAC | InaCs; omeAs; InaGs; omeUs; InaTs; omeCs; InaAs; omeUs; InaCs; omeCs; InaGs; omeCs; InaTs; omeAs; InaC-Sup | 53811 |
| 21 | ATP2A2-21 | CTACCTCATCTCGTC | InaCs; omeUs; InaAs; omeCs; InaCs; omeUs; InaCs; omeAs; InaTs; omeCs; InaTs; omeCs; InaGs; omeUs; InaC-Sup | 53822 |
| 22 | ATP2A2-22 | ACCATTGATCAGCGG | InaAs; omeCs; InaCs; omeAs; InaTs; omeUs; InaGs; omeAs; InaTs; omeCs; InaAs; omeGs; InaCs; omeGs; InaG-Sup | 54736 |
| 23 | ATP2A2-23 | GCGCTGCTACCGTGG | InaGs; omeCs; InaGs; omeCs; InaTs; omeGs; InaCs; omeUs; InaAs; omeCs; InaCs; omeGs; InaTs; omeGs; InaG-Sup | 56243 |
| 24 | ATP2A2-24 | TGTAACGCCCTCAAC | InaTs; omeGs; InaTs; omeAs; InaAs; omeCs; InaGs; omeCs; InaCs; omeCs; InaTs; omeCs; InaAs; omeAs; InaC-Sup | 56714 |
| 25 | ATP2A2-25 | GTAACGCCCTCAACA | InaGs; omeUs; InaAs; omeAs; InaCs; omeGs; InaCs; omeCs; InaCs; omeUs; InaCs; omeAs; InaAs; omeCs; InaA-Sup | 56715 |
| 26 | ATP2A2-26 | CTTGTCCGAAAACCA | InaCs; omeUs; InaTs; omeGs; InaTs; omeCs; InaCs; omeGs; InaAs; omeAs; InaAs; omeAs; InaCs; omeCs; InaA-Sup | 57349 |
| 27 | ATP2A2-27 | CCGCAACTACCTGGA | InaCs; omeCs; InaGs; omeCs; InaAs; omeAs; InaCs; omeUs; InaAs; omeCs; InaCs; omeUs; InaGs; omeGs; InaA-Sup | 57650 |
| 28 | ATP2A2-28 | CTCGGCATGCACCGA | InaCs; omeUs; InaCs; omeGs; InaGs; omeCs; InaAs; omeUs; InaGs; omeCs; InaAs; omeCs; InaCs; omeGs; InaA-Sup | 57710 |
| 29 | ATP2A2-29 | CCGGATCGAGGCCGC | InaCs; omeCs; InaGs; omeGs; InaAs; omeUs; InaCs; omeGs; InaAs; omeGs; InaGs; omeCs; InaCs; omeGs; InaC-Sup | 1323 |

TABLE 3-continued

Formatted oligonucleotide sequences made for testing in the lab showing nucleotide modifications.

| Oligo | OligoID | Base Sequence | Formatted Sequence | SeqID |
|---|---|---|---|---|
| 30 | ATP2A2-30 | GGAACCCGGATCGAG | InaGs; omeGs; InaAs; omeAs; InaCs; omeCs; InaCs; omeGs; InaGs; omeAs; InaTs; omeCs; InaGs; omeAs; InaG-Sup | 1328 |
| 31 | ATP2A2-31 | CATGTGGACGCCGCT | InaCs; omeAs; InaTs; omeGs; InaTs; omeGs; InaGs; omeAs; InaCs; omeGs; InaCs; omeCs; InaGs; omeCs; InaT-Sup | 1470 |
| 32 | ATP2A2-32 | GCGGCATGTGGACGC | InaGs; omeCs; InaGs; omeGs; InaCs; omeAs; InaTs; omeGs; InaTs; omeGs; InaGs; omeAs; InaCs; omeGs; InaC-Sup | 1474 |
| 33 | ATP2A2-33 | CCGCCGCGGCATGTG | InaCs; omeCs; InaGs; omeCs; InaCs; omeGs; InaCs; omeGs; InaGs; omeCs; InaAs; omeUs; InaGs; omeUs; InaG-Sup | 1479 |
| 34 | ATP2A2-34 | TTATCGGCCGCTGCC | InaTs; omeUs; InaAs; omeUs; InaCs; omeGs; InaGs; omeCs; InaCs; omeGs; InaCs; omeUs; InaGs; omeCs; InaC-Sup | 1507 |
| 35 | ATP2A2-35 | CATTTATCGGCCGCT | InaCs; omeAs; InaTs; omeUs; InaTs; omeAs; InaTs; omeCs; InaGs; omeGs; InaCs; omeCs; InaGs; omeCs; InaT-Sup | 1510 |
| 36 | ATP2A2-36 | AGCATTTATCGGCCG | InaAs; omeGs; InaCs; omeAs; InaTs; omeUs; InaTs; omeAs; InaTs; omeCs; InaGs; omeGs; InaCs; omeCs; InaG-Sup | 1512 |
| 37 | ATP2A2-37 | CACGCCCGACAGCGG | InaCs; omeAs; InaCs; omeGs; InaCs; omeCs; InaCs; omeGs; InaAs; omeCs; InaAs; omeGs; InaCs; omeGs; InaG-Sup | 1593 |
| 38 | ATP2A2-38 | GCGCGTTCTCCATGG | InaGs; omeCs; InaGs; omeCs; InaGs; omeUs; InaTs; omeCs; InaTs; omeCs; InaCs; omeAs; InaTs; omeGs; InaG-Sup | 2068 |
| 39 | ATP2A2-39 | GTGTGCGCGTTCTCC | InaGs; omeUs; InaGs; omeUs; InaGs; omeCs; InaGs; omeCs; InaGs; omeUs; InaTs; omeCs; InaTs; omeCs; InaC-Sup | 2072 |
| 40 | ATP2A2-40 | TCGTTGACGCCGAAG | InaTs; omeCs; InaGs; omeUs; InaTs; omeGs; InaAs; omeCs; InaGs; omeCs; InaCs; omeGs; InaAs; omeAs; InaG-Sup | 2114 |
| 41 | ATP2A2-41 | CTCGTTGACGCCGAA | InaCs; omeUs; InaCs; omeGs; InaTs; omeUs; InaGs; omeAs; InaCs; omeGs; InaCs; omeCs; InaGs; omeAs; InaA-Sup | 2115 |
| 42 | ATP2A2-42 | CGTACTCTCGTTGAC | InaCs; omeGs; InaTs; omeAs; InaCs; omeUs; InaCs; omeUs; InaCs; omeGs; InaTs; omeUs; InaGs; omeAs; InaC-Sup | 2121 |
| 43 | ATP2A2-43 | CCGTACTCTCGTTGA | InaCs; omeCs; InaGs; omeUs; InaAs; omeCs; InaTs; omeCs; InaTs; omeCs; InaGs; omeUs; InaTs; omeGs; InaA-Sup | 2122 |
| 44 | ATP2A2-44 | CCCGTACTCTCGTTG | InaCs; omeCs; InaCs; omeGs; InaTs; omeAs; InaCs; omeUs; InaCs; omeUs; InaCs; omeGs; InaTs; omeUs; InaG-Sup | 2123 |
| 45 | ATP2A2-45 | CCCCGTACTCTCGTT | InaCs; omeCs; InaCs; omeCs; InaGs; omeUs; InaAs; omeCs; InaTs; omeCs; InaTs; omeCs; InaGs; omeUs; InaT-Sup | 2124 |
| 46 | ATP2A2-46 | CCTACCGTTGGAGCC | InaCs; omeCs; InaTs; omeAs; InaCs; omeCs; InaGs; omeUs; InaTs; omeGs; InaGs; omeAs; InaGs; omeCs; InaC-Sup | 2178 |
| 47 | ATP2A2-47 | AAGATGCCGATGCGG | InaAs; omeAs; InaGs; omeAs; InaTs; omeGs; InaCs; omeCs; InaGs; omeAs; InaTs; omeGs; InaCs; omeGs; InaG-Sup | 30028 |

TABLE 3-continued

Formatted oligonucleotide sequences made for testing
in the lab showing nucleotide modifications.

| Oligo | OligoID | Base Sequence | Formatted Sequence | SeqID |
|---|---|---|---|---|
| 48 | ATP2A2-48 | CTTCCCCGACGTTGG | InaCs; omeUs; InaTs; omeCs; InaCs; omeCs; InaCs; omeGs; InaAs; omeCs; InaGs; omeUs; InaTs; omeGs; InaG-Sup | 31563 |
| 49 | ATP2A2-49 | CCACGGTAGCAGCGC | InaCs; omeCs; InaAs; omeCs; InaGs; omeGs; InaTs; omeAs; InaGs; omeCs; InaAs; omeGs; InaCs; omeGs; InaC-Sup | 33970 |
| 50 | ATP2A2-50 | TGGTTTTCGGACAAG | InaTs; omeGs; InaGs; omeUs; InaTs; omeUs; InaTs; omeCs; InaGs; omeGs; InaAs; omeCs; InaAs; omeAs; InaG-Sup | 35076 |
| 51 | ATP2A2-51 | TCCAGGTAGTTGCGG | InaTs; omeCs; InaCs; omeAs; InaGs; omeGs; InaTs; omeAs; InaGs; omeUs; InaTs; omeGs; InaCs; omeGs; InaG-Sup | 35377 |
| 52 | ATP2A2-52 | GCACGCAACCGAACA | InaGs; omeCs; InaAs; omeCs; InaGs; omeCs; InaAs; omeAs; InaCs; omeCs; InaGs; omeAs; InaAs; omeCs; InaA-Sup | 39391 |
| 53 | ATP2A2-53 | TGCACGCAACCGAAC | InaTs; omeGs; InaCs; omeAs; InaCs; omeGs; InaCs; omeAs; InaAs; omeCs; InaCs; omeGs; InaAs; omeAs; InaC-Sup | 39392 |
| 54 | ATP2A2-54 | ATGCACGCAACCGAA | InaAs; omeUs; InaGs; omeCs; InaAs; omeCs; InaGs; omeCs; InaAs; omeAs; InaCs; omeCs; InaGs; omeAs; InaA-Sup | 39393 |
| 55 | ATP2A2-55 | CATGCACGCAACCGA | InaCs; omeAs; InaTs; omeGs; InaCs; omeAs; InaCs; omeGs; InaCs; omeAs; InaAs; omeCs; InaCs; omeGs; InaA-Sup | 39394 |

BRIEF DESCRIPTION OF THE SEQUENCE LISTING

| SEQ ID | Chrom | Gene | Chr. Start | Chr. End | Strand |
|---|---|---|---|---|---|
| 1 | chr12 | ATP2A2 | 110707031 | 110800897 | + |
| 2 | chr12 | ATP2A2 | 110707031 | 110800897 | − |
| 3 | chr5 | Atp2a2 | 122891521 | 122964234 | − |
| 4 | chr5 | Atp2a2 | 122891521 | 122964234 | + |
| 5 | chr12 | ATP2A2 | 110719627 | 110719694 | + |
| 6 | chr12 | ATP2A2 | 110720529 | 110720579 | + |
| 7 | chr12 | ATP2A2 | 110721473 | 110721523 | + |
| 8 | chr12 | ATP2A2 | 110723314 | 110723392 | + |
| 9 | chr12 | ATP2A2 | 110725261 | 110725324 | + |
| 10 | chr12 | ATP2A2 | 110727087 | 110727134 | + |
| 11 | chr12 | ATP2A2 | 110729885 | 110729930 | + |
| 12 | chr12 | ATP2A2 | 110734433 | 110734479 | + |
| 13 | chr12 | ATP2A2 | 110764013 | 110764059 | + |
| 14 | chr12 | ATP2A2 | 110765378 | 110765425 | + |
| 15 | chr12 | ATP2A2 | 110765494 | 110765540 | + |
| 16 | chr12 | ATP2A2 | 110765734 | 110765819 | + |
| 17 | chr12 | ATP2A2 | 110770988 | 110771034 | + |
| 18 | chr12 | ATP2A2 | 110771832 | 110771877 | + |
| 19 | chr12 | ATP2A2 | 110777332 | 110777374 | + |
| 20 | chr12 | ATP2A2 | 110777482 | 110777528 | + |
| 21 | chr12 | ATP2A2 | 110778549 | 110778580 | + |
| 22 | chr12 | ATP2A2 | 110778678 | 110778748 | + |
| 23 | chr12 | ATP2A2 | 110780135 | 110780183 | + |
| 24 | chr12 | ATP2A2 | 110780320 | 110780386 | + |
| 25 | chr12 | ATP2A2 | 110781060 | 110781169 | + |
| 26 | chr12 | ATP2A2 | 110781169 | 110781235 | + |
| 27 | chr12 | ATP2A2 | 110782732 | 110782779 | + |
| 28 | chr12 | ATP2A2 | 110783060 | 110783131 | + |
| 29 | chr12 | ATP2A2 | 110783131 | 110783186 | + |
| 30 | chr12 | ATP2A2 | 110783143 | 110783843 | + |
| 31 | chr12 | ATP2A2 | 110783803 | 110783845 | + |
| 32 | chr12 | ATP2A2 | 110784061 | 110784090 | + |
| 33 | chr12 | ATP2A2 | 110784453 | 110784505 | + |
| 34 | chr12 | ATP2A2 | 110784577 | 110784623 | + |
| 35 | chr12 | ATP2A2 | 110784786 | 110784835 | + |
| 36 | chr12 | ATP2A2 | 110784919 | 110784969 | + |
| 37 | chr12 | ATP2A2 | 110788463 | 110788513 | + |
| 38 | chr12 | ATP2A2 | 110717627 | 110721694 | + |
| 39 | chr12 | ATP2A2 | 110718529 | 110722579 | + |
| 40 | chr12 | ATP2A2 | 110719473 | 110723523 | + |
| 41 | chr12 | ATP2A2 | 110721314 | 110725392 | + |
| 42 | chr12 | ATP2A2 | 110723261 | 110727324 | + |
| 43 | chr12 | ATP2A2 | 110725087 | 110729134 | + |
| 44 | chr12 | ATP2A2 | 110727885 | 110731930 | + |
| 45 | chr12 | ATP2A2 | 110732433 | 110736479 | + |
| 46 | chr12 | ATP2A2 | 110762013 | 110766059 | + |
| 47 | chr12 | ATP2A2 | 110763378 | 110767425 | + |
| 48 | chr12 | ATP2A2 | 110763494 | 110767540 | + |
| 49 | chr12 | ATP2A2 | 110763734 | 110767819 | + |
| 50 | chr12 | ATP2A2 | 110768988 | 110773034 | + |
| 51 | chr12 | ATP2A2 | 110769832 | 110773877 | + |
| 52 | chr12 | ATP2A2 | 110775332 | 110779374 | + |
| 53 | chr12 | ATP2A2 | 110775482 | 110779528 | + |
| 54 | chr12 | ATP2A2 | 110776549 | 110780580 | + |
| 55 | chr12 | ATP2A2 | 110776678 | 110780748 | + |
| 56 | chr12 | ATP2A2 | 110778135 | 110782183 | + |
| 57 | chr12 | ATP2A2 | 110778320 | 110782386 | + |
| 58 | chr12 | ATP2A2 | 110779060 | 110783169 | + |
| 59 | chr12 | ATP2A2 | 110779169 | 110783235 | + |
| 60 | chr12 | ATP2A2 | 110780732 | 110784779 | + |
| 61 | chr12 | ATP2A2 | 110781060 | 110785131 | + |
| 62 | chr12 | ATP2A2 | 110781131 | 110785186 | + |
| 63 | chr12 | ATP2A2 | 110781143 | 110785843 | + |
| 64 | chr12 | ATP2A2 | 110781803 | 110785845 | + |
| 65 | chr12 | ATP2A2 | 110782061 | 110786090 | + |
| 66 | chr12 | ATP2A2 | 110782453 | 110786505 | + |
| 67 | chr12 | ATP2A2 | 110782577 | 110786623 | + |

-continued

| SEQ ID | Chrom | Gene | Chr. Start | Chr. End | Strand |
|---|---|---|---|---|---|
| 68 | chr12 | ATP2A2 | 110782786 | 110786835 | + |
| 69 | chr12 | ATP2A2 | 110782919 | 110786969 | + |
| 70 | chr12 | ATP2A2 | 110786463 | 110790513 | + |
| 71 | chr12 | ATP2A2 | 110764239 | 110764284 | − |
| 72 | chr12 | ATP2A2 | 110771869 | 110771910 | − |
| 73 | chr12 | ATP2A2 | 110777311 | 110777357 | − |
| 74 | chr12 | ATP2A2 | 110778603 | 110778648 | − |
| 75 | chr12 | ATP2A2 | 110781134 | 110781180 | − |
| 76 | chr12 | ATP2A2 | 110783112 | 110783161 | − |
| 77 | chr12 | ATP2A2 | 110783116 | 110783161 | − |
| 78 | chr12 | ATP2A2 | 110784019 | 110784061 | − |
| 79 | chr12 | ATP2A2 | 110784142 | 110784184 | − |
| 80 | chr12 | ATP2A2 | 110762239 | 110766284 | − |
| 81 | chr12 | ATP2A2 | 110769869 | 110773910 | − |
| 82 | chr12 | ATP2A2 | 110775311 | 110779357 | − |
| 83 | chr12 | ATP2A2 | 110776603 | 110780648 | − |
| 84 | chr12 | ATP2A2 | 110779134 | 110783180 | − |
| 85 | chr12 | ATP2A2 | 110781112 | 110785161 | − |
| 86 | chr12 | ATP2A2 | 110781116 | 110785161 | − |
| 87 | chr12 | ATP2A2 | 110782019 | 110786061 | − |
| 88 | chr12 | ATP2A2 | 110782142 | 110786184 | − |

Single Strand Oligonucleotides (Antisense Strand of Target Gene)
SeqID range: 89-41645
SeqIDs w/o G Runs:
93-98, 113-354, 368-536, 556-582, 596-615, 629-665, 680-740, 754-789, 803-846, 868-869, 902-955, 969-1011, 1026-1066, 1080-1107, 1121-1127, 1142-1145, 1159-1178, 1201, 1233-1271, 1306-1426, 1440-1539, 1554-1608, 1622-1632, 1647-1648, 1662-1664, 1678-1685, 1712-1759, 1777-1791, 1809-1830, 1855-1907, 1921-1948, 1962-1966, 1980-1982, 1996-2046, 2062-2203, 2217-2271, 2285-2313, 2328-2354, 2368-2378, 2392-2432, 2447-2474, 2488-2495, 2510-2554, 2568-2615, 2629-2700, 2714-2830, 2844-3090, 3107-3289, 3303-3479, 3493-3548, 3562-3606, 3621-3717, 3731-3999, 4013-4081, 4095-4198, 4212-4322, 4337-4450, 4466-4497, 4511-5609, 5627-5706, 5720-5797, 5811-5966, 5980-6043, 6057-6066, 6080-6165, 6181-6222, 6236-6300, 6314-6772, 6788-6909, 6923-7065, 7079-7144, 7148-7185, 7197-7216, 7242-7419, 7433-7527, 7541-7697, 7710-7725, 7739-7743, 7756-7769, 7782-7840, 7849-7863, 7882-7933, 7947-8012, 8026-8052, 8066-8152, 8165-8177, 8201-8275, 8289-8309, 8319-8412, 8423-8437, 8449-8525, 8534-8611, 8625-8742, 8781-8857, 8871-8930, 8944-8955, 8969-8997, 9012-9030, 9044-9128, 9144-9289, 9303-9343, 9357-9860, 9875-9983, 9997-10092, 10102-10137, 10149-10165, 10179-10374, 10395-10482, 10496-10528, 10542-10551, 10562-10671, 10679-10693, 10705-10743, 10754-10779, 10782-10861, 10882-10896, 10910-10939, 10945-11004, 11018-11039, 11053-11098, 11116-11122, 11136-11246, 11260-11291, 11302-11329, 11343-11761, 11775-11810, 11814-11835, 11848-11866, 11872-11891, 11904-11962, 11979-11984, 11998-12120, 12130-12382, 12397-12464, 12479-12521, 12534-12546, 12557-12592, 12606-12621, 12634-12638, 12656-12661, 12675-12712, 12715-12734, 12748-12756, 12774-12790, 12802-12849, 12869-12891, 12905-13122, 13133-13190, 13195-13220, 13225-13475, 13489-13494, 13508-13513, 13537-13590, 13604-13609, 13621-13628, 13640-13694, 13710-13717, 13727-13777, 13790-13874, 13888-13918, 13929-14023, 14037-14088, 14102-14402, 14416-14565, 14579-14634, 14640-14695, 14709-14833, 14848-15079, 15093-15366, 15380-15639, 15643-15683, 15697-15755, 15767-16058, 16072-16083, 16095-16100, 16126-16243, 16255-16256, 16270-16294, 16309-16395, 16409-16540, 16554-16868, 16882-16913, 16927-16956, 16970-17187, 17201-17233, 17244-17326, 17337-17525, 17539-17588, 17595-17663, 17689-17701, 17715-17906, 17920-18047, 18061-18187, 18201-18260, 18274-18312, 18326-18339, 18349-18375, 18389-18423, 18437-18657, 18671-18694, 18708-18756, 18770-18841, 18855-18882, 18907-19474, 19488-19497, 19511-19593, 19607-19625, 19639-19934, 19948-20124, 20139-20176, 20190-20225, 20239-20284, 20298-20390, 20404, 20418-20820, 20824-20857, 20861-20986, 20997-21034, 21048-21050, 21069-21096, 21111-21172, 21181-21287, 21301-21399, 21413-21677, 21691-21782, 21787-21792, 21806-21846, 21867-21891, 21905-21908, 21916-21919, 21941-22259, 22273-22426, 22435-22443, 22457, 22459-22466, 22480-22485, 22489-22582, 22592-22626, 22641-23094, 23108-23510, 23524-23536, 23552-23583, 23597-23643, 23657-24023, 24037-24098, 24112-24317, 24331-24351, 24367-24518, 24532-24582, 24596-24924, 24938-25223, 25238-25309, 25332-25337, 25351-25386, 25400-25493, 25508-25589, 25596-25602, 25613-25671, 25683-25785, 25799-25965, 25979-26009, 26023-26035, 26049-26137, 26153-26197, 26209-26285, 26300-26335, 26349-26617, 26633, 26647-26722, 26736-26749, 26763-26840, 26854-26861, 26863-26910, 26932-26950, 26964-27364, 27378-27401, 27415, 27433-27517, 27531-27606, 27620-27741, 27755-27786, 27800-27871, 27888-27982, 27996-28024, 28038-28066, 28081-28236, 28250-28265, 28280-28350, 28371-28407, 28421-28534, 28548-28556, 28570-28736, 28750-28819, 28833-28930, 28944-28949, 28963-29037, 29051-29152, 29166-29260, 29275-29666, 29684-30090, 30112-30122, 30136-30145, 30163-30295, 30309-30403, 30417-30427, 30441-30531, 30545-30587, 30602-30605, 30619-30690, 30706-30824, 30839-30870, 30879-30914, 30917-30932, 30937-31131, 31154-31273, 31287-31327, 31341-31342, 31356-31629, 31643-31741, 31755-31766, 31781-31839, 31853-31920, 31934-31954, 31969-31971, 31985-31997, 32011-32044, 32046-32071, 32093-32312, 32337-32402, 32416-32433, 32455-32567, 32581-32594, 32609-32624, 32638-32700, 32714-32755, 32769-32859, 32873-32897, 32911-32925, 32939-32940, 32967-32991, 33014-33099, 33113-33125, 33146-33177, 33191-33423, 33437-33466, 33480-33487, 33501-33502, 33596-33640, 33654-33752, 33767-33825, 33840-33844, 33858-33904, 33918-33943, 33957-34340, 34354-34378, 34399-34435, 34449-34547, 34566-34633, 34647-34698, 34713-34714, 34728-34734, 34748-34770, 34784-34800, 34814-34835, 34849-35040, 35055-35094, 35111-35172, 35186-35250, 35264-35294, 35308-35326, 35340-35363, 35377-35473, 35488-36055, 36075-36081, 36132-36242, 36256-36965, 36987-37094, 37108-37207, 37221-37313, 37344-37416, 37430-37585, 37599-37676, 37690-37710, 37721-37737, 37751-37823, 37837-38059, 38074-38093, 38147-38165, 38179-38254, 38268-38293, 38320-38334, 38354-38420, 38434-38447, 38469-38477, 38491-38502, 38516-38558, 38572-38577, 38591-38606, 38620-38623, 38645-38651, 38665-38780, 38794-38813, 38827-38845, 38859-38927, 38941-38989, 39003-39150, 39164-39422, 39436-39467, 39481-39747, 39761-39787, 39801-40199, 40224-40326, 40368-40540, 40555-40670, 40684-40785, 40795-40836, 40844-40901, 40909-40949, 40960-40969, 40979-41054, 41057-41250, 41264-41559, 41564-41581, 41583-41588, 41592-41597, 41599-41603, 41609-41613, 41616-41630, 41633-41645
SeqIDs w/o miR Seeds:
89-90, 94-98, 100, 104-105, 107, 110-114, 116, 118, 121, 123, 125, 127-130, 133-134, 136, 144, 146, 149, 151, 154-155, 157-159, 163, 166, 168-171, 173-177, 179, 182, 184, 186-188, 190-192, 194, 196-202, 204, 206, 209, 212-216, 219-220, 223, 226-236, 238-239, 241, 243-244, 248, 250-252, 258, 260-267, 270-273, 277-282, 284-285, 289-290, 295-297, 299-300, 306-307, 309-310, 313, 315, 317-320, 322-324, 326-327, 330-331, 333-336, 338-340, 343, 345-348, 351-355, 362, 364, 367, 369-375, 377-378, 380-381, 386-388, 390, 395-396, 398-399, 402-403, 405, 407-412, 414, 416, 419-422, 424-425, 427-431, 434-435, 437-438, 440-441, 443-445, 447, 449-450, 452-456, 459, 461-472, 474, 476-477, 479-480, 485-486, 488, 490-491, 494, 496, 500-501, 506-513, 515, 517-520, 522, 525-526, 530, 532, 535-536, 539-541, 545, 547, 549-550, 552-557, 559-560, 562-566, 568, 575, 578-580, 582-583, 587-588, 590, 593, 598, 600-603, 605-607, 611-613, 618, 620, 622, 625, 628-633, 635, 638-639, 641, 643-644, 646-648, 651, 656-662, 664-666, 669, 671-674, 677, 680, 682-684, 686, 688-691, 694-695, 697-698, 700-701, 703-705, 711-713, 718, 721-722, 724-726, 728-730, 734, 739-740, 744, 747-748, 751-752, 758-762, 765, 769-770, 772-780, 783, 786-787, 789, 797, 801-824, 826-827, 829, 832-840, 842-844, 848, 851, 859, 861-862, 864-866, 868-870, 874-879, 887-888, 894, 896-897, 900-901, 903-909, 912, 914, 916-924, 926-927, 930-931, 933-934, 936, 938, 940-944, 946, 949-953, 955-956, 958, 960-962, 964-970, 972-973, 975, 980, 982, 984-985, 988-990, 992-998, 1001-1004, 1006-1010, 1015, 1017-1020, 1022-1025, 1027-1031, 1035, 1037, 1039, 1041-1042, 1044-1045, 1047, 1049-1054, 1057, 1059-1060, 1062-1064, 1066, 1069-1070, 1072-1080, 1084-1088, 1090, 1092-1098, 1101, 1103, 1105, 1107-1108, 1110, 1112-1113, 1117, 1119, 1121-1123, 1125-1128, 1133-1134, 1136-1139, 1141-1142, 1144, 1146, 1151, 1157-1160, 1162, 1164-1165, 1170-1171, 1173, 1175, 1178, 1180, 1184-1186, 1188-1189, 1197-1201, 1203-1204, 1206, 1208, 1212-1215, 1222-1223, 1225-1229, 1233-1234, 1236, 1238-1240, 1242-1244, 1253-1254, 1262, 1265, 1268-1273, 1275, 1277, 1279, 1283, 1285-1286, 1290, 1297, 1299-1304, 1306, 1310, 1312-1313, 1315-1316, 1318-1320, 1322, 1324-1325, 1327-1329, 1331-1335, 1337-1338, 1340, 1344-1345, 1347-1349, 1351-1352, 1354-1355, 1357-1359, 1362-1366, 1368-1374, 1376-1378, 1380-1381, 1388-1389, 1391-1393, 1395, 1398, 1400-1407, 1409, 1412-1413, 1415-1416, 1418-1419, 1421-1422, 1425, 1428, 1431, 1434, 1436, 1438-1439, 1441-1445, 1447-1466, 1472, 1475-1477, 1479-1480, 1482-1483, 1485-1491, 1493-1504, 1506-1510, 1512, 1514-1516, 1518-1520, 1524, 1526-1527, 1529, 1531-1532, 1534-1539, 1544-1552, 1557-1559, 1562, 1564-1566, 1569, 1571-1572, 1579, 1582, 1584-1586, 1589-1599, 1601-1608, 1610-1612, 1614-1621, 1624, 1626, 1628, 1633-1634, 1639-1642, 1644-1647, 1653, 1655, 1658-1659, 1661-1664, 1666, 1671-1672, 1675, 1677, 1679-1685, 1692, 1696, 1698, 1700-1702, 1704-1706, 1708-1710, 1713, 1715, 1718-1719, 1721, 1723, 1725, 1727, 1729-1737, 1739-1740, 1744, 1747-1748, 1750, 1752-1754, 1756-1757, 1759, 1764, 1766-1770, 1773-1774, 1776-1777, 1779-1781, 1784-1786, 1788, 1790-1791, 1796, 1802-1808, 1810-1813, 1815, 1817, 1819, 1821, 1823-1825, 1827, 1831, 1839, 1843, 1847-1852, 1854, 1857-1859, 1861-1862, 1864-1867, 1869, 1871-1876, 1878, 1880-1882, 1884-1886, 1888-1889, 1891-1892, 1894, 1896-1900, 1903, 1905-1908, 1911-1917, 1919, 1922, 1924-1934, 1936-1937, 1940, 1943-1945, 1947-1948, 1951-1953, 1955-1957, 1960, 1964-1965, 1969-1970, 1973-1976, 1979, 1981-1983, 1985, 1987-1988, 1990-1995, 1997, 1999-2002, 2004, 2006-2008, 2010-2014, 2016, 2019-2021, 2023-2027, 2029-2032, 2034-2037, 2040-2041, 2043-2046, 2049, 2052-2057, 2059-2060, 2066-2070, 2073, 2075-2078, 2080, 2082-2087, 2089, 2091, 2093, 2097-2098, 2103, 2105, 2107-2117, 2119-2122, 2124-2126, 2130, 2133, 2136, 2138-2139, 2141-2142, 2145-2146, 2151, 2153, 2155-2158, 2160-2161, 2163-2166, 2171-2173, 2175-2182, 2185-2186, 2189-2190, 2192-2193, 2195-2197, 2200-2201, 2204, 2206-2209, 2212, 2214-2219, 2221-2222, 2224, 2230-2231, 2233-2236, 2239-2242, 2244, 2248-2249, 2251, 2253-2256, 2258-2260, 2262, 2264-2265, 2268, 2270, 2277, 2279-2281, 2283, 2286-2288, 2290-2291, 2293-2294, 2296, 2299-2301, 2306-2308, 2311-2313, 2315-2316, 2319-2320, 2322-2323, 2325-2326, 2328-2331, 2336-2342, 2346-2347, 2349, 2351-2352, 2360, 2362-2373, 2375-2376, 2378, 2383-2386, 2390-2395, 2399-2401, 2406, 2408-2413, 2415, 2418, 2421, 2423, 2425-2426, 2428, 2430-2432, 2434-2435, 2437, 2439-2443, 2445, 2447, 2449-2455, 2457, 2459-2460, 2464, 2466-2470, 2472-2474, 2477-2483, 2485-2488, 2491, 2493-2496, 2499-2500, 2503-2505, 2507-2512, 2514-2517, 2519-2531, 2534, 2537, 2539-2546, 2548-2551, 2554-2555, 2558-2559, 2561-2569, 2573, 2579-2581, 2583-2587, 2589-2594, 2596-2597, 2603, 2605-2610, 2616, 2618, 2620-2624, 2628, 2630-2638, 2641-2644, 2646-2648, 2651-2654, 2656-2661, 2663-2666, 2668, 2670, 2673-2677, 2680-2681, 2683, 2686-2687, 2689, 2692-2699, 2701, 2705, 2708, 2711-2726, 2729-2749, 2751-2755, 2757-2759, 2761-2765, 2767, 2769-2771, 2775-2779, 2782-2785, 2788-2799, 2802-2808, 2810-2815, 2817-2828, 2835-2836, 2838-2840, 2843-2846, 2848-2856, 2858, 2860-2862, 2864-2869, 2872, 2876-2882, 2884-2886, 2890, 2892-2897, 2899, 2901-2904, 2907-2908, 2910-2915, 2917-2920, 2927, 2929-2932, 2934-2935, 2939-2940, 2942-2945, 2947, 2949-2962, 2964, 2967-2970, 2972, 2974-2975, 2977-2978, 2981, 2983-2987, 2989, 2997-2998, 3000-3001, 3004, 3007-3009, 3012-3013, 3015, 3019-3021, 3023-3024, 3027, 3030-3034, 3038, 3040-3043, 3046, 3049-3050, 3052-3053, 3055, 3057-3059, 3061-3064, 3066, 3068-3078, 3081-3083, 3085-3088, 3090-3091, 3098-3100, 3102-3105, 3107-3110, 3112-3113, 3116-3125, 3127, 3129-3136, 3139, 3142, 3144-3152, 3155-3156, 3158-3159, 3161-3164, 3167-3168, 3170-3172, 3175-3178, 3180, 3182-3183, 3185, 3188-3197, 3199, 3202-3205, 3207, 3209-3213, 3216, 3218-3220, 3222-3225, 3227-3228, 3235-3237, 3240-3246, 3249, 3251-3254, 3256-3261, 3263-3271, 3275-3277, 3279-3288, 3290-3291, 3298-3301, 3303-3306, 3311-3312, 3314-3318, 3320-3321, 3323, 3325, 3327-3329, 3331-3333, 3336-3339, 3343-3346, 3348, 3350-3352, 3355-3363, 3365-3367, 3369-3372, 3375-3376, 3378, 3380, 3382-3383, 3389-3401, 3403-3404, 3406, 3408-3417, 3419, 3422, 3424-3430, 3432, 3434-3435, 3438-3440, 3442-3445, 3447, 3449, 3451, 3454-3465, 3467-3469, 3474, 3476-3477, 3479-3480, 3490-3493, 3495, 3498, 3501-3512, 3515-3524, 3526, 3528-3529, 3532-3541, 3543-3546, 3549-3553, 3555, 3559, 3562, 3564, 3566-3572, 3576-3577, 3580, 3583-3584, 3586-3589, 3591, 3593-3596, 3598, 3600-3601, 3603-3608, 3610-3613, 3618-3621, 3625, 3628-3631, 3633-3634, 3636-3638, 3642-3643, 3645-3653, 3655-3661, 3665-3667, 3669, 3671, 3673-3682, 3686, 3688-3692, 3694-3695, 3697-3704, 3707-3710, 3712-3718, 3721-3723, 3726, 3728-3730, 3732-3741, 3744-3751, 3753-3755, 3758-3759, 3761, 3763-3765, 3768, 3770, 3773, 3777-3783, 3785, 3787-3794, 3797-3802, 3804-3805, 3807, 3809-3812, 3815-3819, 3822-3829, 3831, 3833-3834, 3836-3839, 3841-3844, 3847, 3849, 3852-3854, 3856, 3859-3868, 3870-3877, 3879-3881, 3884, 3887, 3892, 3894-3899, 3902, 3904, 3907-3908, 3910, 3912, 3916-3923, 3925, 3927-3937, 3939-3942, 3944-3947, 3950-3951, 3953-3955, 3957-3958, 3962-3971, 3974-3978, 3980-3981, 3984, 3986-3993, 3996-3997, 4000-4001, 4003-4006, 4010-4011, 4013, 4015-4016, 4018-4020, 4024-4033, 4035-4041, 4043-4044, 4047-4050, 4053-4054, 4057-4059, 4061-4064, 4066, 4068-4069, 4071, 4073-4075, 4079-4080, 4090, 4092-4094, 4097, 4099, 4104-4105, 4110, 4116-4118, 4121-4125, 4128, 4130, 4132, 4134, 4137, 4139-4156, 4159-4161, 4163-4166, 4168-4170, 4172, 4175, 4177, 4179, 4181, 4183-4192, 4195-4196, 4198-4199, 4202-4204, 4206-4209, 4211-4212, 4214-4220, 4224-4225, 4227-4230, 4232-4235, 4238-4239, 4241-4242, 4244-4246, 4249, 4252-4254, 4257-4260, 4263, 4267, 4271-4274, 4276, 4278-4279, 4281-4283, 4286-4287, 4290-4295, 4297-4298, 4300, 4302, 4305, 4307-4308, 4311-4313, 4315, 4318, 4329, 4333-4334, 4336-4342, 4344, 4348-4363, 4365, 4367-4370, 4373, 4375-4378, 4382, 4384, 4386, 4389-4393, 4396-4397, 4403, 4405, 4407-4411, 4413, 4415, 4419-4423, 4425, 4427-4428, 4431-4435, 4437-4446, 4450, 4458-4465, 4467, 4471-4485, 4489-4490, 4492-4496, 4500-4502, 4504-4505, 4507-4511, 4513-4517, 4519-4529, 4531-4534, 4536-4544, 4548-4553, 4555-4556, 4558-4561, 4563, 4565-4566, 4568, 4570-4571, 4573, 4576-4581, 4583-4584, 4587-4589, 4591-4592, 4594-4601, 4604-4611, 4615-4618, 4620-4621, 4623-4628, 4630-4636, 4638, 4641-4642, 4645-4648, 4651-4654, 4656-4657, 4659-4664, 4667-4669, 4671-4672, 4676-4685, 4688-4690, 4693, 4696-4698, 4702-4705, 4707-4708, 4710-4714, 4716, 4718-4724, 4726, 4728-4729, 4732-4733, 4740, 4742, 4744, 4747-4750, 4752-4758, 4763, 4765-4771, 4773, 4775, 4778-4779, 4781, 4787, 4791-4792, 4794, 4797, 4803-4804, 4807-4808, 4810-4813, 4816-4819, 4821, 4823, 4825, 4827-4830, 4832, 4835, 4837-4839, 4841-4844, 4848-4852, 4855, 4858, 4860-4863, 4865-4867, 4869-4874, 4876-4879, 4881, 4883-4888, 4890, 4892, 4894, 4896, 4898, 4901-4908, 4910, 4912, 4915-4918, 4921-4924, 4927-4929, 4931-4932, 4935-4937, 4940, 4942-4944, 4946, 4948-4954, 4956, 4958-4960, 4962-4966, 4968-4969, 4971-4972, 4975-4978, 4981, 4983, 4986-4987, 4992-4994, 4996-5001, 5003, 5005-5007, 5009, 5011, 5014, 5017-5018, 5022-5024, 5026, 5030, 5032-5034, 5036, 5038-5039, 5042, 5044, 5046-5047, 5049-5059, 5061, 5063-5077, 5079-5081, 5083-5084, 5086-5088, 5090, 5092-5097, 5099, 5101-5107, 5109, 5112-5114, 5117, 5119-5120, 5122-5127, 5129-5133, 5136, 5138-5140, 5142-5143, 5145-5147, 5149, 5154-5155, 5157-5158, 5161-5163, 5166-5168, 5170-5171, 5173-5178, 5180, 5182-5183, 5191, 5193-5196, 5199, 5201-5202, 5205, 5207-5210, 5212, 5218, 5221-5225, 5227-5238, 5240, 5242, 5247, 5251-5252, 5254-5255, 5257, 5261, 5264, 5266-5278, 5280-5285, 5287-5292, 5294, 5296-5302, 5304-5305, 5309, 5311, 5314-5315, 5317-5318, 5323-5325, 5327-5328, 5330, 5332-5337, 5340-5341, 5343-5344, 5346, 5348, 5350, 5352-5355, 5357-5365, 5367-5369, 5371-5372, 5375-5383, 5385, 5387-5390, 5392, 5394-5397, 5400-5404, 5406-5413, 5415, 5417-5422, 5424, 5426, 5428-5433, 5435-5438, 5441-5443, 5449-5451, 5453, 5455-5456, 5458-5459, 5461, 5464, 5466, 5468, 5470-5474, 5477-5480, 5484, 5486, 5488-5491, 5494-5501, 5503, 5507, 5510, 5513-5514, 5516-5518, 5520-5521, 5523-5524, 5526, 5529-5537, 5540-5545, 5547-5555, 5558, 5560-5562, 5569-5570, 5573-5575, 5577, 5579-5580, 5582-5584, 5586-5590, 5592-5593, 5595-5598, 5600-5601, 5603, 5606-5610, 5613, 5618, 5621-5626, 5628-5629, 5631, 5633, 5636-5644, 5646-5647, 5649-5659, 5664, 5666, 5669-5671, 5673-5677, 5679-5694, 5696-5697, 5699, 5701, 5703-5704, 5706, 5710-5711, 5713-5714, 5719, 5721-5722, 5728, 5731, 5733, 5735-5736, 5738-5748, 5750, 5752, 5755-5756, 5758, 5760-5761, 5764, 5767-5768, 5770-5771, 5773, 5777-5778, 5780-5791, 5794-5795, 5798, 5801-5808, 5810, 5812-5815, 5817-5818, 5820, 5824-5838, 5842, 5844-5845, 5847-5851, 5853-5855, 5858-5862, 5864, 5866-5868, 5870-5871, 5874, 5877, 5881-5893, 5895, 5897, 5899, 5901-5904, 5906-5910, 5912, 5914-5921, 5923-5934, 5937, 5939-5940, 5942, 5944, 5946-5948, 5951-5953, 5957-5958, 5960-5964, 5968, 5970-5972, 5975, 5977-5994, 5996-5998, 6002-6006, 6008, 6011-6013, 6015-6023, 6026, 6036-6043, 6046-6048, 6050, 6053-6057, 6059-6068, 6070, 6072-6076, 6078, 6080-6087, 6089-6091, 6094-6095, 6097, 6099, 6101-6102, 6104, 6106, 6109-6110, 6112-6113, 6115, 6118-6122, 6124-6125, 6128-6129, 6131-6132, 6135, 6137-6139, 6142, 6144, 6147, 6149-6150, 6152-6155, 6159-6162, 6164-6165, 6169, 6172, 6174, 6176, 6178, 6180-6183, 6185-6197, 6199-6206, 6209-6210, 6213, 6217, 6219-6220, 6222, 6224-6226, 6228, 6231, 6234-6237, 6239-6240, 6243, 6246, 6248-6249, 6251-6254, 6256, 6258, 6260, 6264-6265, 6267, 6273, 6279, 6282-6283, 6286-6288, 6290, 6294-6295, 6297-6301, 6304-6311, 6315-6317, 6319-6320, 6323-6324, 6327-6328, 6335-6336, 6338-6340, 6343-6344, 6350, 6353, 6356-6358, 6360, 6366-6367, 6369, 6373, 6376-6377, 6379-6381, 6383-6386, 6388-6392, 6397, 6400, 6402-6405, 6407-6410, 6413-6416, 6418, 6420, 6423-6427, 6431-6434, 6438-6446, 6449, 6451-6456, 6461, 6463, 6465, 6472, 6476-6477, 6479, 6481-6489, 6492-6495, 6500, 6503, 6506, 6508, 6513-6517, 6519-6521, 6524-6529, 6531-6537, 6541-6543, 6546-6555, 6557-6561, 6564, 6567-6570, 6572-6573, 6579-6581, 6583-6588, 6591-6595, 6598, 6601, 6604-6607, 6610-6614, 6617, 6619, 6621, 6625-6630, 6632, 6634-6636, 6638-6640, 6642-6643, 6645, 6648-6662, 6664, 6668, 6671, 6673-6674, 6676, 6678-6683, 6685, 6688-6689, 6691-6693, 6696, 6698-6699, 6705-6707, 6711, 6713-6714, 6718, 6722-6724, 6726, 6728, 6730-6733, 6735-6736, 6738-6739, 6741-6746, 6748-6749, 6753, 6755-6760, 6762, 6764-6765, 6767-6770, 6780-6783, 6785-6799, 6801-6808, 6812-6827, 6829-6835, 6839, 6841, 6846, 6848, 6850, 6852-6870, 6872-6873, 6875-6877, 6881, 6883, 6886-6887, 6889-6895, 6897-6898, 6900-6904, 6907-6908, 6913-6914, 6917-6918, 6924, 6926-6930, 6932-6934, 6936-6939, 6941-6942, 6944, 6946, 6948-6955, 6957-6962, 6964, 6967-6971, 6974, 6980-6984, 6986-6990, 6993-6994, 6996-6998, 7000-7001, 7003-7012, 7014-7016, 7019-7021, 7024, 7027, 7031-7033, 7036-7039, 7041-7042, 7046-7047, 7049, 7051, 7053, 7055-7057, 7059-7060, 7062, 7067, 7070, 7073, 7075, 7078, 7082-7088, 7090-7095, 7098-7106, 7109-7110, 7112, 7116, 7118-7120, 7122-7124, 7126-7127, 7131, 7135-7136, 7139-7140, 7142, 7146, 7149, 7156-7157, 7159, 7161-7162, 7167, 7170, 7172-7174, 7176-7178, 7189, 7193-7206, 7209-7213, 7215-7216, 7219, 7221, 7223, 7225-7227, 7232, 7234-7237, 7239, 7241-7247, 7250, 7253, 7255, 7257-7260, 7262-7263, 7267, 7271, 7274-7275, 7277-7283, 7286-7287, 7290-7292, 7294, 7296-7298, 7300-7304, 7309-7313, 7317, 7321-7330, 7332-7333, 7336, 7338-7341, 7343, 7347-7350, 7352, 7355, 7357, 7359-7360, 7362, 7365, 7367-7368, 7372-7374, 7377-7378, 7380, 7382, 7386-7393, 7395-7396, 7398-7400, 7402, 7406-7408, 7411-7414, 7416-7417, 7419, 7421-7422, 7424-7428, 7430, 7432, 7434-7436, 7438, 7440, 7442-7445, 7447-7449, 7451-7453, 7455-7456, 7458-7464, 7466-7468, 7470, 7472-7474, 7476, 7479, 7482-7483, 7486-7487, 7490, 7495-7496, 7501, 7503-7508, 7511-7515, 7517-7518, 7520, 7523-7529, 7533, 7535-7536, 7540-7541, 7543, 7546-7547, 7549, 7551-7555, 7557, 7559, 7561-7566, 7568, 7571-7572, 7575, 7577-7580, 7583, 7585-7591, 7594-7595, 7597-7603, 7605, 7607-7608, 7611, 7614, 7618, 7620-7624, 7627-7629, 7631-7632, 7639-7643, 7645-7648, 7650-7653, 7655-7656, 7659-7665, 7670-7674, 7676, 7679-7680, 7682, 7684-7686, 7695, 7703-7706, 7710, 7714, 7716, 7718-7719, 7721-7724, 7731, 7733, 7735, 7737, 7739, 7743, 7745, 7747-7752, 7755-7756, 7758-7759, 7761-7764, 7766-7770, 7772, 7775-7779, 7782, 7784, 7787-7789, 7796, 7799, 7805, 7807, 7814, 7817, 7819-7825, 7827, 7829, 7831, 7835, 7838, 7840, 7843, 7845-7847, 7849, 7852-7855, 7857-7860, 7862, 7865, 7867, 7875-7879, 7882-7889, 7892, 7894-7899, 7903-7908, 7910, 7915, 7918-7920, 7923, 7925, 7928, 7931, 7939-7945, 7948, 7952, 7955, 7957-7962, 7964-7966, 7968-7969, 7973, 7975, 7979, 7982, 7985-7986, 7988, 7990-7991, 7994-7998, 8000-8001, 8004, 8006-8009, 8011, 8019, 8021-8022, 8025-8026, 8030-8036, 8040-8041, 8043-8044, 8046, 8048-8049, 8052, 8054, 8056-8067, 8069, 8072, 8075, 8081-8082, 8084-8088, 8092-8093, 8095-8100, 8102, 8106, 8108-8113, 8115, 8117, 8119-8121, 8123-8125, 8128, 8130-8133, 8135, 8139, 8141-8143, 8145, 8147-8151, 8154, 8156-8162, 8164, 8166-8167, 8169-8170, 8176-8177, 8184, 8186-8187, 8190-8191, 8194-8207, 8211-8212, 8215, 8218-8222, 8224, 8226, 8229, 8232-8233, 8239-8243, 8246, 8248-8249, 8253-8255, 8257-8258, 8262, 8265, 8267-8269, 8273, 8275, 8278, 8280, 8282-8285, 8287-8290, 8292-8293, 8295-8298, 8300-8303, 8305-8308, 8311, 8313-8314, 8316-8323, 8325-8326, 8329-8336, 8339-8340, 8342, 8345-8347, 8350-8351, 8356, 8358, 8360-8362, 8364-8365, 8371-8372, 8378, 8381-8384, 8386-8394, 8396-8403, 8407, 8410, 8416-8422, 8424-8428, 8431, 8435, 8437, 8443-8447, 8449-8451, 8455-8456, 8458-8460, 8464-8472, 8475, 8477, 8480-8487, 8490, 8493, 8496-8499, 8501, 8503-8508, 8512-8513, 8515, 8517, 8519, 8521-8522, 8524-8526, 8528, 8533, 8535, 8537-8538, 8542, 8544, 8548, 8550, 8560-8562, 8565-8572, 8574, 8579, 8581-8582, 8584-8585, 8587, 8591, 8593-8595, 8600-8601, 8604-8606, 8609, 8611, 8614, 8616, 8618-8619, 8621-8622, 8624, 8627-8635, 8638, 8642-8643, 8645, 8647-8650, 8653-8654, 8659-8660, 8662-8666, 8669-8672, 8674-8681, 8683-8684, 8686-8690, 8692-8693, 8695-8696, 8699-8700, 8702-8703, 8706-8707, 8709, 8711-8712, 8714-8716, 8719-8722, 8724, 8727, 8730-8731, 8746, 8748, 8750, 8753-8756, 8758, 8761-8762, 8765, 8768, 8772-8773, 8778-8781, 8783-8787, 8791, 8793-8795, 8799, 8801-8802, 8805, 8807-8811, 8814, 8816, 8818-8820, 8822, 8824, 8827-8828, 8830-8842, 8844, 8847, 8850, 8853-8855, 8857, 8860, 8862-8866, 8868, 8870, 8875-8882, 8887-8888, 8892, 8894-8895, 8897-8898, 8900-8902, 8904-8908, 8910-8911, 8913-8916, 8918, 8920, 8922, 8925, 8927-8928, 8934-8937, 8942-8944, 8946, 8949-8952, 8955-8956, 8960-8962, 8964, 8966-8975, 8978-8986, 8989, 8991-8995, 8997-8998, 9006-9007, 9009-9010, 9012, 9014, 9016-9018, 9020-9021, 9024-9026, 9028-9031, 9034-9036, 9038-9040, 9042-9044, 9046-9047, 9050, 9052-9053, 9055-9057, 9060-9062, 9065-9066, 9068, 9071-9073, 9075, 9077, 9083-9084, 9087-9092, 9094-9096, 9098-9104, 9106-9109, 9111, 9113-9123, 9126-9127, 9130, 9136-9146, 9148-9150, 9152-9157, 9159-9161, 9165-9168, 9170, 9172, 9174-9175, 9179-9182, 9184-9185, 9189-9192, 9196-9201, 9206, 9209-9210, 9212-9214, 9216, 9219-9229, 9232-9233, 9235-9236, 9238, 9240, 9242-9244, 9249-9251, 9254-9261, 9263, 9266-9270, 9274, 9277, 9279, 9283, 9285-9289, 9294-9295, 9298, 9300, 9302-9305, 9310-9313, 9315-9319, 9322-9323, 9325-9335, 9337, 9339-9343, 9345, 9348-9350, 9352-9353, 9359-9368, 9370, 9373-9374, 9376-9378, 9381-9382, 9384, 9386-9389, 9391-9395, 9397, 9410-9412, 9414, 9416, 9418, 9420-9422, 9424-9425, 9427-9429, 9435-9447, 9449, 9451-9453, 9455-9456, 9461, 9463-9464, 9466-9476, 9479-9493, 9495-9502, 9505-9506, 9508, 9510-9511, 9513, 9515-9516, 9518-9520, 9523, 9525-9530, 9532, 9534-9537, 9539-9543, 9545-9546, 9548, 9550-9551, 9553, 9555-9556, 9558-9561, 9563-9564, 9566, 9568, 9570-9571, 9574, 9576-9577, 9580-9582, 9584, 9587-9600, 9602-9606, 9608, 9611, 9613-9631, 9633-9636, 9641, 9643, 9645-9647, 9650-9659, 9665, 9667, 9669-9670, 9673, 9675, 9678-9681, 9686-9690, 9692, 9694-9696, 9699-9700, 9704, 9706-9709, 9712, 9714, 9716-9722, 9725-9728, 9730, 9732-9737, 9739, 9743, 9745, 9748-9750, 9752-9757, 9759-9764, 9766, 9768-9771, 9773-9785, 9789-9791, 9793-9794, 9797-9801, 9804, 9807, 9809, 9812-9819, 9821, 9823-9829, 9831, 9833-9836, 9838, 9840-9847, 9849-9854, 9858, 9861, 9869-9875, 9877, 9879-9881, 9883, 9886-9887, 9889-9890, 9893, 9895-9897, 9899-9900, 9904-9916, 9918-9919, 9921, 9923-9927, 9930-9935, 9938-9939, 9941-9943, 9945-9946, 9949-9953, 9955, 9957-9961, 9963-9964, 9967-9972, 9977, 9979-9980, 9982-9983, 9985, 9989, 9991-9992, 9996-10002, 10004, 10007-10010, 10013, 10016, 10018-10023, 10029, 10032-10041, 10044-10046, 10048, 10050-10052, 10056, 10058, 10060, 10062-10063, 10065-10066, 10069-10071, 10074, 10076, 10078-10079, 10081, 10083-10087, 10091-10092, 10094-10095, 10100-10104, 10113-10117, 10119, 10122-10123, 10134, 10140, 10142-10153, 10155-10158, 10160, 10163, 10165-10166, 10168-10170, 10172, 10175-10177, 10179-10184, 10186, 10188-10189, 10192, 10194-10197, 10199, 10201-10203, 10206-10207, 10209-10211, 10214, 10217-10228, 10230-10231, 10235-10236, 10238, 10240-10244, 10247, 10252-10255, 10257-10259, 10262-10263, 10265, 10267, 10269-10270, 10273-10274, 10276-10279, 10282, 10284-10289, 10291, 10293-10297, 10300-10304, 10307-10311, 10313-10319, 10322, 10324-10326, 10328-10330, 10332, 10334, 10336, 10338-10345, 10347-10352, 10354-10355, 10357-10360, 10362, 10364-10366, 10368-10369, 10371-10375, 10379-10380, 10382, 10388-10389, 10391, 10393, 10395-10409, 10411-10417, 10421-10432, 10435-10437, 10439-10440, 10442-10443, 10445, 10447-10448, 10451-10456, 10458-10459, 10461, 10464-10465, 10467, 10470-10471, 10473, 10476, 10478, 10480-10483, 10490-10491, 10494, 10496-10497, 10500, 10503, 10505-10507, 10510, 10512-10513, 10517-10518, 10520-10522, 10524-10525, 10527, 10536-10538, 10540-10541, 10543-10546, 10550, 10555-10561, 10563-10564, 10566-10567, 10569-10570, 10572, 10574-10576, 10578-10583, 10587, 10589, 10592-10593, 10595-10596, 10599-10604, 10606-10608, 10610-10614, 10618, 10620-10621, 10629-10631, 10634-10641, 10643-10648, 10651, 10653-10657, 10661, 10663, 10666-10670, 10676, 10678-10680, 10682, 10685-10686, 10690-10692, 10700-10704, 10706-10707, 10710-10711, 10714, 10716, 10718-10720, 10722-10723, 10725, 10727, 10730-10731, 10736, 10738-10740, 10743, 10745-10746, 10751, 10754, 10756, 10758-10762, 10764-10765, 10767, 10769-10773, 10775, 10778, 10780-10781, 10783-10786, 10789, 10796-10798, 10801, 10803, 10805-10806, 10808-10814, 10817-10818, 10821, 10823-10826, 10828-10837, 10839-10840, 10842-10845, 10848-10849, 10851, 10853-10855, 10858, 10860-10862, 10870, 10873, 10886-10888, 10890, 10892-10896, 10898-10911, 10913, 10915-10916, 10918, 10921-10928, 10930, 10933, 10937, 10939, 10941-10942, 10948, 10950-10957, 10959, 10962, 10964-10965, 10968, 10971, 10976-10982, 10984, 10986, 10990-10991, 10993, 10997, 10999, 11002, 11010-11015, 11019-11022, 11026, 11029, 11031-11039, 11042, 11046-11050, 11053-11054, 11056, 11059-11066, 11068, 11070-11075, 11080-11081, 11083, 11085-11086, 11089-11091, 11093, 11095-11098, 11100, 11102, 11104, 11107, 11112-11113, 11115, 11117, 11120, 11122-11125, 11128, 11130-11133, 11135-11136, 11139-11140, 11143-11145, 11148, 11150, 11154, 11156-11157, 11160-11163, 11165, 11167-11168, 11172-11173, 11175-11176, 11180-11185, 11188, 11190, 11193, 11195, 11197, 11199-11202, 11204-11206, 11208-11210, 11212, 11214, 11220-11227, 11229-11232, 11235-11249, 11251-11252, 11254-11257, 11259, 11262-11263, 11265, 11268-11274, 11277-11278, 11281-11286, 11294, 11299-11300, 11302, 11304-11306, 11310-11312, 11317-11321, 11323-11324, 11328-11329, 11337-11339, 11341, 11343, 11346, 11349-11353, 11356-11358, 11360-11361, 11365-11370, 11373, 11375-11380, 11383-11388, 11391, 11394-11396, 11398-11399, 11402-11406, 11408-11412, 11415, 11417-11420, 11422, 11424, 11429, 11433, 11436, 11440-11449, 11451-11453, 11456-11458, 11460, 11463-11464, 11466-11473, 11475-11476, 11478-11483, 11485-11494, 11498-11508, 11510, 11514, 11518-11519, 11521, 11523-11526, 11529-11536, 11542, 11546-11549, 11551, 11553-11560, 11566, 11568-11569, 11572-11574, 11576-11577, 11579-11581, 11583, 11585-11586, 11588-11595, 11598-11608, 11610, 11613-11625, 11629-11637, 11639, 11641-11643, 11647-11652, 11654-11655, 11658, 11660-11672, 11674-11676, 11679-11682, 11686-11689, 11691-11704, 11706, 11708-11710, 11712, 11716-11718, 11720, 11722-11723, 11725, 11727-11729, 11731-11734, 11738-11750, 11752, 11754-11755, 11757-11761, 11766-11767, 11769-11771, 11774-11777, 11780-11782, 11784-11787, 11789-11793, 11796, 11798, 11802, 11808, 11810, 11812-11815, 11817, 11820, 11822-11825, 11827-11828, 11830-11832, 11843-11844, 11846, 11848, 11850-11852, 11854-11857, 11861, 11864, 11871, 11873-11874, 11880-11883, 11885-11886, 11888-11892, 11896, 11898, 11900, 11905, 11908-11911, 11913-11919, 11922, 11928-11935, 11938-11942, 11947-11952, 11954-11955, 11957, 11959-11960, 11962, 11964, 11967, 11973, 11979-11984, 11987-11989, 11991, 11994, 11996-12007, 12009, 12011, 12013-12014, 12019-12022, 12024, 12026-12028, 12031-12033, 12035-12038, 12041, 12045-12049, 12051-12053, 12055-12056, 12058-12060, 12063-12068, 12071-12073, 12075-12077, 12080-12081, 12090-12092, 12097-12102, 12106-12107, 12109, 12111, 12113-12118, 12120-12121, 12124-12126, 12128-12129, 12132, 12134, 12137, 12139, 12141, 12143, 12145-12146, 12148-12154, 12159, 12165, 12167, 12170-12176, 12178-12179, 12181-12183, 12185, 12188, 12196-12200, 12203-12211, 12214-12221, 12223-12224, 12227-12237, 12239-12240, 12243-12244, 12248-12249, 12252-12253, 12255-12261, 12263-12267, 12269, 12273, 12278-12281, 12284-12285, 12287-12290, 12293, 12295-12296, 12298, 12300-12302, 12307, 12309-12315, 12317-12321, 12323, 12325-12326, 12328-12330, 12333, 12337, 12339-12342, 12344, 12346-12349, 12351, 12354-12355, 12357-12376, 12378-12381, 12386, 12390, 12392-12401, 12404-12405, 12409, 12411-12413, 12415-12419, 12421, 12423-12426, 12429-12432, 12434, 12436-12437, 12440-12443, 12445-12446, 12448-12450, 12452-12455, 12457-12459, 12461-12466, 12468, 12470-12472, 12474-12475, 12477, 12479-12482, 12485, 12488, 12491-12495, 12497, 12499-12500, 12503, 12505-12506, 12508, 12510-12512, 12516, 12519, 12528, 12530, 12532, 12534, 12538, 12542, 12545, 12554-12555, 12557-12561, 12564, 12567, 12570, 12573, 12575, 12577-12580, 12584-12586, 12588-12591, 12596, 12598-12603, 12607, 12609-12611, 12613-12614, 12616-12617, 12619, 12623-12624, 12626-12637, 12642, 12644, 12646-12650, 12656-12659, 12663-12666, 12668, 12671-12678, 12680, 12682-12684, 12686-12690, 12692-12699, 12701, 12703-12704, 12707, 12709-12710, 12712-12714, 12722-12723, 12725-12728, 12731, 12733, 12735, 12737-12738, 12740-12742, 12744-12746, 12748-12749, 12752-12754, 12756, 12758-12761, 12763-12764, 12767-12770, 12773-12774, 12776-12777, 12779-12782, 12784, 12786-12790, 12794-12807, 12810-12812, 12814-12816, 12819-12827, 12831, 12834-12837, 12839-12840, 12845, 12848, 12850, 12855, 12861, 12865, 12867-12868, 12870, 12872-12873, 12876-12883, 12885-12892, 12896-12898, 12900-12901, 12904-12910, 12912, 12914-12919, 12924, 12927, 12930-12938, 12940-12957, 12959, 12963-12968, 12970-12971, 12973-12976, 12978-12988, 12990-12996, 13000-13001, 13003-13006, 13010, 13012, 13014, 13016, 13018-13022, 13024-13026, 13028, 13030, 13032, 13034, 13036, 13038, 13040, 13042, 13046, 13048-13049, 13052-13053, 13055-13063, 13065-13068, 13071-13072, 13074, 13077, 13082-13087, 13091-13094, 13096-13098, 13100-13102, 13104, 13108-13109, 13111-13112, 13114-13115, 13117, 13124, 13126-13131, 13133-13138, 13140, 13142, 13144-13148, 13150, 13156-13157, 13160-13162, 13164-13166, 13168, 13170-13171, 13173-13174, 13176, 13178-13179, 13181-13182, 13185, 13188, 13191-13192, 13194, 13196-13198, 13200, 13203-13204, 13206-13211, 13216, 13219, 13223-13231, 13233-13238, 13240-13245, 13250-13266, 13269-13278, 13281, 13283-13284, 13288-13291, 13294, 13296-13301, 13304, 13306-13307, 13309-13311, 13313-13314, 13317-13320, 13322-13327, 13329-13330, 13332-13334, 13339-13340, 13343-13346, 13348-13353, 13356, 13358-13359, 13361, 13363-13365, 13367-13372, 13374-13378, 13380, 13382-13383, 13385-13386, 13388-13391, 13394-13395, 13397, 13399, 13401-13404, 13407-13409, 13411, 13413-13417, 13419, 13424-13425, 13428, 13430, 13432-13436, 13438, 13440, 13442, 13444-13446, 13448-13452, 13455-13456, 13458, 13460, 13462, 13465-13466, 13471, 13473-13474, 13480, 13483, 13485, 13491, 13493, 13497-13498, 13500-13502, 13504-13505, 13507, 13511-13513, 13515, 13519, 13521, 13523, 13528, 13533, 13535-13537, 13539-13546, 13548-13552, 13557-13562, 13565, 13567, 13571, 13573-13574, 13577-13582, 13584-13586, 13588-13589, 13592, 13597, 13599, 13602, 13604-13607, 13609, 13611, 13615, 13617, 13620, 13624, 13626-13628, 13630, 13634, 13636-13644, 13646-13648, 13650, 13652-13654, 13656-13657, 13659-13661, 13663, 13672, 13678-13680, 13682-13685, 13688-13694, 13702, 13707, 13709, 13711-13712, 13715, 13719-13720, 13725-13728, 13730, 13732-13738, 13740-13741, 13743-13744, 13749-13750, 13752, 13754, 13757, 13760, 13767-13772, 13774-13775, 13783, 13785, 13788, 13797, 13800-13804, 13806-13807, 13809-13810, 13812-13817, 13820-13823, 13825, 13828, 13830-13833, 13835, 13841, 13843, 13846-13852, 13855, 13857, 13859, 13863-13869, 13871-13872, 13874-13875, 13883-13885, 13887-13888, 13890-13893, 13895-13898, 13900-13901, 13907-13911, 13913, 13916, 13921-13922, 13924-13926, 13929-13930, 13932-13938, 13942-13943, 13945-13946, 13948, 13950, 13954, 13956-13958, 13961, 13966, 13968, 13970-13974, 13978-13979, 13981, 13983-13986, 13988-13993, 13995-13999, 14001, 14004-14005, 14008, 14015-14018, 14020-14021, 14027, 14029, 14031-14032, 14034, 14037-14038, 14042-14050, 14052-14053, 14055, 14059, 14061-14062, 14065-14067, 14070, 14072, 14074-14075, 14077, 14079, 14081-14082, 14084, 14088, 14091, 14093-14101, 14104-14106, 14109-14111, 14114-14123, 14125-14127, 14129, 14131-14134, 14136, 14138, 14140-14141, 14143-14144, 14146-14151, 14153-14154, 14157, 14160, 14162-14164, 14166-14168, 14172, 14174, 14178-14179, 14181-14182, 14184, 14186, 14189-14192, 14194, 14198-14199, 14201-14204, 14207, 14210, 14213, 14215-14217, 14221-14228, 14230-14232, 14235-14236, 14241-14242, 14244-14251, 14253-14260, 14262-14265, 14267, 14270, 14275, 14277-14284, 14286-14294, 14298-14299, 14302-14305, 14307, 14311-14316, 14318, 14327-14333, 14337-14340, 14342-14344, 14347, 14349, 14351-14356, 14359-14360, 14362, 14365-14366, 14371-14372, 14374-14376, 14378-14382, 14386-14388, 14390, 14392-14396, 14400-14411, 14413, 14415, 14418-14424, 14427, 14430-14431, 14433-14434, 14436-14438, 14440-14443, 14447, 14450, 14453, 14456-14458, 14460-14461, 14465, 14467, 14469-14470, 14472, 14475, 14478, 14480, 14483, 14486-14487, 14489, 14491, 14493-14499, 14502, 14504-14505, 14510-14511, 14515-14518, 14520, 14526-14529, 14531, 14533-14535, 14537-14540, 14542, 14546-14555, 14557-14558, 14560, 14563-14566, 14574-14577, 14579-14582, 14584-14590, 14593-14595, 14597, 14599-14600, 14602, 14604-14605, 14607, 14609-14610, 14612-14613, 14615-14623, 14625-14626, 14628-14632, 14634, 14636-14637, 14643-14652, 14654, 14658, 14660, 14665, 14668, 14670-14673, 14675-14679, 14681-14682, 14684, 14688, 14690, 14693, 14701-14702, 14704-14705, 14707-14708, 14711-14717, 14721-14723, 14725, 14727-14730, 14732, 14736-14739, 14742-14745, 14747-14748, 14752, 14754-14757, 14760-14762, 14764-14771, 14773, 14775-14785, 14788, 14792-14798, 14800, 14803, 14806, 14808-14810, 14812, 14814, 14816, 14818-14819, 14824-14831, 14833-14835, 14837, 14839, 14841-14844, 14846-14847, 14849-14855, 14857-14869, 14872-14874, 14876-14877, 14879-14881, 14883-14884, 14886-14888, 14890-14892, 14894-14895, 14900, 14902-14903, 14905, 14907, 14909, 14911-14915, 14917-14918, 14920-14934, 14941, 14943, 14945-14947, 14951-14952, 14954-14955, 14957-14961, 14963-14969, 14971-14973, 14976-14978, 14980, 14982, 14984-14992, 14994-14996, 14998-15001, 15005, 15009-15010, 15012, 15014-15015, 15017, 15019, 15021, 15024-15028, 15030-15033, 15035-15039, 15041-15042, 15044-15045, 15048, 15052, 15054, 15056-15061, 15065, 15068-15070, 15074-15080, 15083-15084, 15086-15091, 15095-15096, 15098, 15100-15101, 15104-15106, 15108-15122, 15124-15125, 15127-15128, 15130-15132, 15134, 15136-15139, 15141-15143, 15145-15149, 15151-15152, 15154-15158, 15161-15166, 15173-15174, 15176, 15179, 15181-15187, 15196-15199, 15201-15206, 15208, 15212-15214, 15216-15217, 15219-15222, 15225-15230, 15232-15233, 15235-15236, 15239, 15241-15244, 15247-15251, 15254-15256, 15260, 15262-15264, 15266-15267, 15271-15278, 15282-15285, 15287-15290, 15292-15299, 15303-15306, 15308, 15310-15314, 15318-15321, 15324-15326, 15329-15330, 15333-15336, 15338, 15340-15342, 15345-15346, 15348, 15350, 15354-15355, 15357-15361, 15363, 15365, 15376-15377, 15379-15383, 15385-15387, 15389-15395, 15400, 15402-15403, 15405-15412, 15416-15418, 15420, 15424-15427, 15431-15445, 15447-15449, 15452, 15455, 15457-15458, 15460-15461, 15464, 15466, 15468-15469, 15471-15472, 15474, 15476-15477, 15480, 15482-15483, 15487-15493, 15496-15499, 15501-15505, 15507-15511, 15513-15515, 15517-15518, 15520, 15523, 15526-15529, 15531-15535, 15537, 15539, 15543, 15548-15550, 15552, 15554, 15556-15559, 15563-15566, 15568-15570, 15572-15575, 15577-15580, 15582-15588, 15590-15594, 15598, 15601, 15603, 15605, 15607-15611, 15619-15626, 15628-15632, 15637, 15639-15641, 15643, 15645, 15647, 15649, 15651-15654, 15659-15667, 15669-15670, 15672, 15676-15678, 15680-15683, 15686-15687, 15690, 15692-15694, 15696-15701, 15704-15707, 15709-15710, 15713-15718, 15720, 15722, 15724, 15728-15737, 15739-15740, 15742-15743, 15746-15748, 15754-15755, 15761, 15763, 15765, 15769-15773, 15776-15777, 15780, 15782-15783, 15785-15792, 15794-15797, 15799, 15801-15802, 15804, 15806-15808, 15810-15813, 15815-15816, 15820, 15828, 15830-15839, 15842, 15845-15846, 15848, 15850-15852, 15854-15857, 15859-15869, 15872-15873, 15875-15877, 15879-15891, 15893-15894, 15896-15897, 15904, 15909-15911, 15913, 15916, 15919-15920, 15923-15924, 15931-15936, 15938-15941, 15943, 15945, 15947, 15949-15950, 15952, 15954, 15958, 15963-15964, 15968, 15970-15971, 15973, 15975-15976, 15978-15980, 15982-15983, 15986, 15990, 15992, 15995-15999, 16009, 16011-16019, 16022-16024, 16026-16027, 16029, 16031-16032, 16034, 16036, 16040-16043, 16045-16047, 16050, 16056-16057, 16059, 16061-16062, 16064, 16067, 16072, 16076-16077, 16080, 16082-16083, 16087, 16090-16094, 16096-16098, 16105-16106, 16109, 16111, 16117, 16119, 16121-16122, 16126-16128, 16131-16137, 16139-16140, 16147-16148, 16151-16159, 16162, 16167-16168, 16170, 16172, 16175-16176, 16178, 16180-16181, 16183-16185, 16190, 16192, 16194-16200, 16202, 16204-16205, 16207-16208, 16211-16215, 16217-16218, 16221, 16223-16226, 16228, 16230-16231, 16233, 16238, 16240-16244, 16248, 16250-16253, 16256-16259, 16262, 16264, 16268-16269, 16271-16272, 16274-16280, 16284-16290, 16292-16294, 16298-16299, 16302, 16305, 16307, 16309, 16311, 16313-16318, 16321-16324, 16326, 16328-16333, 16335-16336, 16338-16340, 16343, 16345, 16347-16353, 16355-

16356, 16358-16362, 16364-16367, 16371-16374, 16377, 16379-16382, 16384, 16386, 16388-16396, 16398-16399, 16402-16403, 16406, 16408-16418, 16420-16423, 16426, 16429-16430, 16432-16433, 16435-16436, 16439-16440, 16442-16444, 16446-16447, 16449-16454, 16458-16460, 16462-16463, 16469-16471, 16473, 16475-16478, 16480-16481, 16483, 16485-16487, 16490-16492, 16495, 16497-16498, 16500-16501, 16504-16509, 16512-16517, 16520-16522, 16524-16525, 16527-16529, 16532, 16534, 16536-16538, 16540-16542, 16544-16548, 16550, 16552, 16555, 16559-16560, 16564, 16566, 16569-16579, 16583-16584, 16587-16591, 16593-16594, 16596, 16601-16604, 16609, 16613-16615, 16620, 16622-16630, 16632-16635, 16638, 16640, 16643-16644, 16646-16648, 16652-16653, 16655-16663, 16665-16666, 16668, 16672, 16674, 16676-16677, 16681-16683, 16686, 16689-16690, 16693, 16695-16696, 16699, 16702-16703, 16708, 16710-16712, 16714-16716, 16718, 16721-16722, 16724-16728, 16731, 16734, 16736-16738, 16740, 16742-16746, 16748, 16750, 16755, 16757-16758, 16760-16763, 16765-16766, 16768, 16771-16772, 16774-16776, 16780-16787, 16789, 16793-16795, 16797-16798, 16805-16811, 16813-16814, 16816, 16819-16820, 16824-16827, 16829, 16831-16832, 16834-16835, 16837, 16841-16844, 16846-16849, 16851-16852, 16855, 16857-16862, 16864, 16866, 16868-16869, 16872-16874, 16877-16878, 16883, 16886-16889, 16893-16896, 16898-16899, 16902-16911, 16913, 16919, 16924-16925, 16927-16928, 16931, 16937, 16939-16944, 16946-16949, 16951-16953, 16955-16956, 16960, 16965-16967, 16969-16971, 16973-16974, 16977, 16980-16986, 16988, 16992, 16994-16995, 16999-17002, 17005, 17009, 17011-17013, 17015-17018, 17020, 17023-17024, 17028-17029, 17031-17035, 17037, 17039-17043, 17046-17047, 17050-17052, 17054, 17056, 17058-17060, 17062-17067, 17069-17070, 17072-17073, 17075, 17078-17081, 17083-17097, 17099-17101, 17104-17107, 17109-17110, 17112-17117, 17119, 17123-17124, 17126-17132, 17134-17135, 17137-17143, 17145-17147, 17151-17154, 17156-17160, 17162-17164, 17166, 17168, 17170, 17172, 17175-17178, 17181-17184, 17186-17189, 17193-17201, 17203, 17206, 17210-17218, 17223, 17228, 17230-17233, 17235-17236, 17238, 17240-17241, 17243, 17245-17247, 17249-17250, 17253, 17255-17256, 17258-17259, 17262, 17266, 17268-17271, 17273, 17275-17278, 17282, 17288-17289, 17291-17293, 17295, 17298-17299, 17301, 17303-17305, 17307-17309, 17311-17318, 17320-17326, 17329, 17331-17333, 17335, 17338, 17341-17344, 17346, 17348-17353, 17355-17358, 17361-17362, 17364, 17367-17368, 17370, 17372, 17374, 17378, 17382-17390, 17393-17395, 17397-17400, 17402-17410, 17412-17413, 17416, 17420-17422, 17425, 17427, 17429-17442, 17444-17445, 17447, 17449, 17451, 17453-17455, 17457-17461, 17463-17464, 17468-17471, 17474-17479, 17481-17482, 17484-17485, 17487-17489, 17491-17493, 17495-17507, 17510-17511, 17514, 17516, 17523-17526, 17530-17531, 17534-17535, 17537-17544, 17547, 17551, 17554-17556, 17559-17560, 17562-17566, 17568-17575, 17578, 17581, 17583, 17586, 17590-17591, 17593-17594, 17597, 17599, 17603-17604, 17606, 17608-17609, 17611-17612, 17614-17616, 17618-17620, 17622, 17627, 17629, 17631-17632, 17635, 17641-17645, 17649-17659, 17661-17663, 17669, 17671, 17673-17674, 17678, 17681, 17683-17686, 17690-17701, 17705, 17709, 17711-17713, 17715-17722, 17724-17728, 17730-17741, 17744-17749, 17752-17758, 17760-17761, 17763-17767, 17769, 17772, 17775-17778, 17780, 17782-17796, 17799-17801, 17803, 17807-17809, 17811-17816, 17818-17819, 17821-17822, 17825-17827, 17830-17831, 17833-17842, 17844-17845, 17847-17848, 17850-17851, 17853-17857, 17860-17861, 17863, 17866-17872, 17874-17879, 17881-17883, 17885, 17888, 17890-17891, 17893-17899, 17903-17908, 17910, 17912-17915, 17918, 17920-17924, 17926-17930, 17932, 17936-17939, 17941-17943, 17946-17947, 17949-17950, 17953-17957, 17961, 17964, 17968, 17972-17975, 17977-17979, 17981, 17984, 17988, 17991-17993, 17995, 17997, 18001-18003, 18005-18006, 18008-18011, 18013, 18015, 18017, 18020-18021, 18024-18026, 18033, 18035-18039, 18042-18044, 18046-18051, 18053-18058, 18060-18062, 18064-18066, 18069-18070, 18072-18085, 18092-18093, 18096, 18103-18105, 18107, 18110-18112, 18114, 18116, 18118, 18120-18121, 18124, 18126, 18128-18131, 18133-18139, 18141-18143, 18147-18149, 18154, 18158-18159, 18161, 18164-18167, 18169, 18174-18176, 18178-18179, 18181, 18183-18188, 18195, 18199, 18201-18203, 18207-18208, 18213, 18215-18217, 18224-18226, 18228-18229, 18231-18239, 18243-18244, 18247, 18249, 18251-18254, 18257-18260, 18263-18264, 18267-18269, 18273, 18275-18278, 18280-18281, 18284-18287, 18289, 18291, 18293-18299, 18301-18304, 18306-18308, 18311, 18313-18314, 18316-18326, 18328-18331, 18337, 18339-18345, 18351, 18353-18356, 18358-18365, 18367-18369, 18371-18375, 18383-18394, 18396, 18398, 18401-18403, 18406-18408, 18410, 18413, 18416-18417, 18420-18421, 18426-18427, 18430-18436, 18440-18443, 18446, 18449-18473, 18475, 18480, 18482-18484, 18486-18492, 18494-18498, 18502-18508, 18510, 18512-18514, 18516-18517, 18520-18521, 18524, 18527, 18531-18535, 18538-18545, 18548-18551, 18554, 18557-18562, 18565-18569, 18573, 18575-18578, 18580-18581, 18583, 18585-18590, 18592-18599, 18601-18606, 18614, 18616, 18619-18620, 18623-18625, 18627, 18629, 18631-18638, 18640-18641, 18643-18644, 18648, 18650-18656, 18658, 18660-18664, 18666, 18669-18673, 18675-18679, 18683-18689, 18691-18692, 18697, 18700, 18702-18705, 18710-18712, 18715, 18717, 18720-18723, 18728-18729, 18732, 18734, 18736-18737, 18739-18741, 18744-18746, 18748, 18750-18752, 18755-18758, 18762-18764, 18766, 18768-18771, 18773, 18775-18776, 18778-18783, 18785, 18787-18789, 18791, 18793-18794, 18797-18801, 18803-18807, 18809-18812, 18814-18815, 18817-18818, 18822-18823, 18825-18827, 18829-18834, 18838-18839, 18841, 18843, 18847-18857, 18860, 18863, 18866-18867, 18869-18873, 18877, 18883, 18885, 18887, 18890, 18893-18898, 18900-18904, 18906, 18908, 18910, 18912-18922, 18925-18928, 18931-18933, 18935-18939, 18941-18943, 18945, 18947, 18949-18952, 18954-18956, 18958-18960, 18962, 18964, 18966-18968, 18971, 18974-18976, 18979-18980, 18982, 18984-18994, 18997-18999, 19001-19002, 19004-19007, 19011, 19013, 19015, 19017-19019, 19023, 19027-19038, 19040-19047, 19052-19057, 19059, 19066-19072, 19077, 19080-19081, 19084-19097, 19099-19100, 19102-19107, 19109, 19112-19116, 19118-19119, 19122-19125, 19128, 19130, 19132-19133, 19135, 19137-19138, 19140-19143, 19146, 19148-19149, 19151-19157, 19159, 19165-19176, 19179, 19181-19182, 19184-19190, 19193, 19195, 19197-19200, 19202, 19204-19211, 19214-19216, 19218-19241, 19244, 19246-19250, 19252-19254, 19256, 19261-19262, 19264-19265, 19268-19271, 19273-19276, 19279, 19281-19290, 19292-19297, 19299, 19301-19308, 19310-19311, 19313-19317, 19319, 19321, 19324-19325, 19329-19332, 19334, 19339, 19343-19344, 19347-19350, 19352, 19354-19360, 19362, 19364, 19367-19370, 19373-19378, 19380, 19382-19384, 19387-19396, 19398, 19400, 19403-19404, 19406-19407, 19410-19411, 19414, 19416-19418, 19420-19421, 19423-19425, 19428, 19431-19432, 19434-19439, 19441-19445, 19447, 19449-19451, 19453, 19455, 19458, 19460-19462, 19465-19471, 19473-19475, 19478, 19480-19483, 19485-19488, 19490, 19492-19495, 19497-19501, 19503, 19506-19507, 19509-19512, 19514-19516, 19518, 19520-19521, 19523, 19528-19534, 19537, 19539, 19542-19546, 19548-19550, 19553-19557, 19560-19561, 19563, 19565, 19568-19570, 19572-19573, 19576-19577, 19579, 19581, 19583-19586, 19591-19595, 19597-19600, 19602, 19605-19610, 19612, 19614-19616, 19618, 19620, 19622-19626, 19629-19633, 19636-19637, 19640, 19643, 19647-19651, 19653, 19661-19664, 19666, 19668, 19670, 19672, 19677, 19679-19682, 19684-19685, 19687-19689, 19691-19692, 19694-19696, 19698, 19701-19703, 19705-19709, 19712-19715, 19717-19721, 19723-19727, 19732-19733, 19735-19739, 19741, 19743-19749, 19751-19757, 19759, 19764-19766, 19769, 19771-19772, 19776, 19779-19780, 19782-19786, 19789-19793, 19795, 19797-19800, 19802-19806, 19808-19810, 19813-19816, 19818, 19820-19821, 19826-19835, 19837-19838, 19840, 19842, 19849-19854, 19856-19859, 19863, 19865, 19868-19871, 19873-19876, 19878, 19880-19886, 19888-19889, 19893-19896, 19899, 19903-19916, 19918, 19921-19923, 19926-19928, 19931, 19933-19934, 19936, 19939-19945, 19947-19948, 19952-19956, 19958-19963, 19965-19970, 19972-19975, 19977-19980, 19982-19984, 19986-19987, 19990-19991, 19994, 19996-19997, 20000, 20005-20009, 20012-20022, 20025-20026, 20033-20035, 20039, 20041, 20043-20045, 20047, 20049, 20051-20056, 20058-20062, 20066, 20068-20069, 20073-20081, 20084-20088, 20090-20097, 20099-20100, 20102-20104, 20110, 20112, 20115-20116, 20119-20120, 20128, 20132-20133, 20135-20137, 20139-20145, 20147, 20151-20152, 20154, 20158, 20160-20161, 20164-20165, 20167-20168, 20170-20175, 20178, 20181-20183, 20185-20186, 20188, 20190-20191, 20198, 20201, 20203-20210, 20213-20216, 20221-20224, 20226-20229, 20231-20236, 20239, 20241, 20244, 20247, 20249, 20251-20252, 20254-20255, 20257, 20260-20261, 20263-20267, 20271-20275, 20277-20278, 20282, 20285, 20293-20294, 20298-20299, 20306, 20308-20310, 20312-20315, 20317, 20320, 20326-20332, 20334, 20343-20345, 20347-20354, 20357, 20360-20362, 20365-20374, 20379-20389, 20393, 20395, 20397-20401, 20403-20405, 20408-20418, 20420-20426, 20428-20430, 20432-20433, 20435, 20437, 20439, 20441, 20443-20447, 20451-20454, 20456-20459, 20463, 20465-20466, 20477-20478, 20480-20484, 20486-20495, 20498-20499, 20501-20503, 20505-20506, 20509-20516, 20519-20520, 20522-20525, 20528-20535, 20537-20539, 20543-20544, 20549-20553, 20555-20556, 20559-20562, 20565, 20567, 20569-20571, 20573-20575, 20577-20580, 20582-20588, 20590-20596, 20599-20601, 20603, 20606, 20608, 20610-20613, 20615-20618, 20620-20622, 20626, 20628-20632, 20634-20638, 20640-20647, 20649-20653, 20655, 20657, 20661-20665, 20668-20671, 20673-20674, 20676-20681, 20687-20690, 20692-20693, 20695, 20697-20703, 20705-20706, 20709, 20711, 20713-20714, 20717-20719, 20721, 20725-20727, 20730-20747, 20750, 20754-20757, 20759-20760, 20764-20769, 20771, 20773-20776, 20778-20780, 20782, 20784-20786, 20788-20795, 20799-20801, 20803, 20805-20809, 20812-20816, 20818, 20820, 20823, 20825-20830, 20832-20834, 20836, 20840-20841, 20843-20844, 20846-20847, 20849-20852, 20854-20858, 20860, 20865-20866, 20868-20871, 20874, 20878, 20880-20881, 20883-20886, 20888-20892, 20894-20896, 20899-20900, 20902-20906, 20908-20909, 20916-20918, 20920, 20922-20931, 20933, 20935-20937, 20939, 20945, 20947-20968, 20970, 20972, 20974-20975, 20979-20984, 20986, 20988-20989, 20991-20992, 20994, 20996-20998, 21001, 21004, 21007-21009, 21011-21014, 21016-21018, 21020-21023, 21029, 21031, 21033, 21043-21048, 21064, 21066, 21069-21070, 21072-21073, 21077, 21079-21080, 21082-21083, 21085, 21087, 21090-21091, 21095-21096, 21102, 21107, 21110-21112, 21114, 21116, 21118-21121, 21123, 21126-21128, 21130-21131, 21133, 21135-21136, 21139, 21142-21143, 21145, 21148-21149, 21151, 21154-21155, 21157, 21163-21165, 21170-21171, 21174, 21176-21178, 21180-21181, 21183-21185, 21187-21194, 21196, 21200-21202, 21208, 21214, 21216-21221, 21223, 21227-21228, 21230, 21236, 21239-21249, 21253, 21255-21256, 21258-21259, 21261-21264, 21271-21272, 21274-21275, 21279, 21282-21285, 21292-21293, 21295-21299, 21301, 21305-21306, 21308-21310, 21314-21319, 21321, 21324-21326, 21328, 21330, 21332-21340, 21342-21345, 21348-21350, 21352, 21354, 21356-21365, 21367-21369, 21372-21375, 21377-21382, 21386-21392, 21396-21399, 21408-21417, 21422, 21424-21433, 21435, 21437, 21441, 21443-21444, 21446-21447, 21449-21451, 21454-21455, 21457, 21459-21464, 21466-21467, 21469, 21472-21476, 21482, 21484-21489, 21495-21496, 21498, 21503, 21506-21513, 21517-21519, 21523-21527, 21530, 21534-21536, 21540, 21542, 21544-21546, 21548, 21550-21556, 21558, 21560-21562, 21564-21567, 21569-21570, 21572-21579, 21581, 21583-21586, 21588-21592, 21595-21596, 21599, 21601-21602, 21604, 21606-21615, 21617-21622, 21625-21628, 21630-21633, 21636-21639, 21641, 21643-21644, 21649, 21651-21652, 21655-21659, 21661-21662, 21664-21669, 21671-21675, 21677-21678, 21681, 21683, 21685-21689, 21691-21693, 21698-21704, 21706-21707, 21709, 21711-21718, 21720, 21724-21730, 21732-21734, 21736-21738, 21740-21742, 21744, 21747-21748, 21751, 21753-21755, 21757, 21759, 21762-21766, 21768, 21772, 21774-21776, 21779, 21781-21785, 21788, 21791-21792, 21795, 21797-21801, 21804, 21806, 21810, 21814, 21817, 21820, 21824-21826, 21829-21831, 21833, 21835-21836, 21840-21844, 21858-21860, 21863-21867, 21873-21879, 21881-21882, 21884-21885, 21887, 21889-21890, 21894, 21897, 21899-21901, 21904, 21907, 21913, 21915-21919, 21926, 21931-21932, 21934-21936, 21939-21942, 21944-21945, 21947, 21949-21951, 21953-21955, 21957, 21961-21962, 21964-21972, 21975-21979, 21982, 21987-21990, 21992-21994, 21996-22005, 22007-22012, 22015, 22017, 22020, 22023-22024, 22026, 22030, 22035-22038, 22040, 22042, 22046-22047, 22049, 22052-22053, 22055-22056, 22058-22059, 22061-22064, 22069-22070, 22072-22077, 22079, 22081-22085, 22087-22089, 22091-22094, 22096-22101, 22103-22104, 22106-22107, 22109-22111, 22114-22116, 22120, 22122-22124, 22126, 22128-22129, 22131-22133, 22135, 22137-22138, 22140-22142, 22144-22149, 22151, 22153-22158, 22160, 22162-22163, 22170, 22173-22177, 22180-22181, 22183-22186, 22188-22194, 22196-22197, 22199-22200, 22202, 22204-22205, 22207-22208, 22210, 22212, 22214-22216, 22219-22229, 22231-22233, 22235-22239, 22241-22242, 22244-22246, 22248, 22251-22252, 22263, 22267, 22269, 22271-22277, 22280-22281, 22283-22285, 22288, 22290, 22292, 22294-22295, 22297-22301, 22303-22306, 22308-22322, 22324-22330, 22333-22339, 22341, 22343, 22348, 22350, 22353-22354, 22356, 22359, 22363-22368, 22370-22372, 22374-22381, 22383-22384, 22386-22387, 22389-22390, 22393, 22397, 22399-22400, 22403-22411, 22413-22415, 22420, 22424, 22429-22431, 22435, 22439, 22442, 22444, 22448, 22451-22452, 22454-22455, 22457, 22463, 22466, 22468, 22473, 22475, 22480, 22483-22488, 22490-22492, 22495-22496, 22498-22500, 22503-22512, 22514-22516, 22518, 22523, 22529-22533, 22539-22540, 22544-22545, 22548, 22550, 22553-22555, 22557, 22560, 22565-22567, 22569-22572, 22575-22576, 22578-22579, 22581-22582, 22584, 22586-22594, 22598-22605, 22607, 22609-22610, 22612-22614, 22616-22617, 22620-22624, 22626-22627, 22630, 22632, 22634-22635, 22638-22639, 22642, 22646-22650, 22652-22659, 22661, 22663-22664, 22666-22667, 22669-22670, 22673, 22677-22678, 22680, 22682, 22684-22693, 22695-22696, 22699-22702, 22704-22705, 22707, 22709-22714, 22716-22717, 22720-22723, 22725-22728, 22730-22733, 22735, 22737, 22739-22742, 22744-22746, 22749-22751, 22754, 22756, 22759-22761, 22763-22766, 22769-22782, 22785, 22788-22791, 22793-22797, 22799-22801, 22805-22806, 22808-22809, 22811-22813, 22816-22819, 22821, 22823-22828, 22830-22832, 22836-22839, 22842-22843, 22846-22848, 22850-22855, 22857-22865, 22868, 22871-22881, 22884-22887, 22890, 22892, 22894, 22896-22904, 22909, 22912-22915, 22917-22919, 22921-22923, 22926-22932, 22935-22938, 22940-22941, 22943, 22946-22948, 22955-22957, 22961, 22963, 22965, 22967-22969, 22971-22975, 22978, 22981, 22983-22986, 22988, 22990-23002, 23005-23006, 23008-23018, 23021-23022, 23024-23025, 23027, 23030, 23036-23038, 23040-23043, 23046-23047, 23049-23055, 23057-23058, 23060-23062, 23064-23068, 23070, 23072, 23074, 23076, 23080-23082, 23086-23092, 23097, 23100, 23104-23106, 23108-23114, 23116-23117, 23119-23123, 23125-23127, 23129-23130, 23134-23136, 23138, 23144-23146, 23148, 23163, 23165-23166, 23168, 23170-23174, 23178-23181, 23184-23186, 23188-23197, 23199, 23201, 23204-23205, 23207, 23209-23210, 23213-23214, 23219-23222, 23224-23228, 23232-23235, 23237-23238, 23240-23242, 23246, 23249-23252, 23254-23256, 23262, 23265-23268, 23271, 23281, 23283-23289, 23291, 23293, 23295, 23297, 23299-23300, 23303, 23305, 23308-23310, 23312-23317, 23321-23334, 23336-23337, 23340-23343, 23345-23349, 23351-23352, 23356-23358, 23360, 23362, 23364-23366, 23370, 23373-23382, 23384-23387, 23389, 23391-23392, 23397, 23399, 23402, 23404-23405, 23407, 23409, 23411, 23413-23414, 23418-23419, 23421, 23423-23426, 23428-23434, 23436-23440, 23444-23447, 23450, 23453-23457, 23459, 23462-23465, 23469-23470, 23473-23478, 23480, 23482-23483, 23485-23488, 23490-23491, 23495, 23499-23500, 23503-23510, 23512-23513, 23515-23523, 23525, 23527, 23529, 23531-23533, 23535-23536, 23538, 23543, 23547-23558, 23561-23564, 23567, 23570, 23572-23579, 23581-23584, 23588, 23590-23597, 23599-23600, 23603-23604, 23607, 23610, 23612-23614, 23616-23619, 23621-23627, 23629, 23634-23637, 23641-23643, 23645, 23647-23648, 23655-23656, 23658-23660, 23662-23663, 23665-23667, 23669, 23671, 23673-23674, 23677-23678, 23680-23684, 23686-23688, 23691-23695, 23698, 23701-23702, 23704-23710, 23712-23719, 23724, 23727-23730, 23733, 23735-23737, 23739-23747, 23749, 23752-23763, 23765-23768, 23771, 23773-23774, 23776-23784, 23786-23788, 23791, 23794-23797, 23799, 23801, 23804, 23807-23816, 23819, 23821-23823, 23825-23827, 23831-23833, 23837-23841, 23844-23849, 23851, 23853, 23856, 23858-23859, 23861, 23864, 23867-23870, 23872-23875, 23878, 23880, 23884-23885, 23888, 23891-23893, 23895-23896, 23898, 23900-23902, 23905-23910, 23913, 23915-23918, 23922-23926, 23932-23934, 23936, 23938-23939, 23942-23944, 23946, 23950-23952, 23955-23957, 23959-23961, 23963-23965, 23967-23968, 23971-23977, 23979, 23982-23985, 23987-23988, 23990-24006, 24010-24011, 24016-24019, 24021, 24024-24025, 24029-24039, 24041-24063, 24065, 24068, 24070, 24072-24073, 24075-24077, 24080, 24082-24089, 24091-24096, 24098-24099, 24101-24102, 24107, 24109-24112, 24114, 24116-24117, 24119, 24122, 24124-24125, 24127-24128, 24136-24140, 24143, 24145-24146, 24150-24151, 24153-24154, 24156-24159, 24161-24162, 24164-24167, 24170-24171, 24175-24182, 24184, 24186, 24188-24189, 24191-24196, 24198-24199, 24202, 24204-24205, 24207, 24209-24210, 24212, 24217-24218, 24221-24226, 24228-24229, 24231-24232, 24234, 24236-24240, 24242-24244, 24246-24250, 24254, 24256, 24258-24264, 24266-24269, 24271-24273, 24275, 24277, 24279, 24281, 24283, 24286-24288, 24290-24293, 24295-24296, 24298-24303, 24306, 24308, 24310, 24322-24325, 24328-24334, 24336, 24338, 24342-24343, 24348, 24350, 24362, 24364, 24366, 24368, 24370-24375, 24377-24378, 24382, 24386, 24388-24394, 24397-24399, 24401-24404, 24406-24412, 24414-24415, 24419, 24422-24423, 24426, 24431, 24433-24434, 24436, 24440-24443, 24447-24449, 24452-24459, 24461-24465, 24467-24472, 24474, 24476-24477, 24479-24480, 24484-24488, 24491-24495, 24497-24509, 24512, 24514-24519, 24522, 24525-24528, 24530-24534, 24536, 24538-24539, 24542-24543, 24545, 24547-24550, 24552, 24554-24557, 24559-24560, 24562-24565, 24569-24571, 24573, 24575-24577, 24580, 24582, 24585, 24587-24589, 24595, 24597, 24600, 24602, 24604-24605, 24607-24610, 24612-24613, 24616, 24619, 24621-24626, 24629-24631, 24635-24638, 24641-24645, 24647-24649, 24651, 24655, 24660, 24662-24663, 24667-24669, 24671-24673, 24675, 24677-24682, 24686, 24688-24689, 24691-24692, 24695-24697, 24699-24702, 24705-24706, 24709-24714, 24718-24721, 24723-24724, 24729-24730, 24732-24734, 24737-24739, 24741-24742, 24746-24747, 24749-24750, 24752-24754, 24756-24758, 24760-24765, 24767-24771, 24773-24776, 24779, 24781-24783, 24785, 24789-24791, 24794, 24797-24800, 24802-24803, 24805-24811, 24813, 24815, 24817-24821, 24824-24825, 24827, 24829, 24831-24833, 24836-24845, 24849-24851, 24855, 24857, 24859-24860, 24863-24867, 24870-24879, 24881-24883, 24885-24886, 24888-24897, 24899-24900, 24902-24907, 24910-24912, 24914, 24916-24917, 24919-24921, 24923, 24926, 24929-24936, 24940-24946, 24950-24954, 24956-24959, 24965-24966, 24968-24969, 24971, 24975-24976, 24978-24979, 24981-24982, 24984-24987, 24993, 24995-24996, 24999, 25002, 25004, 25008-25010, 25012, 25014, 25016, 25019-25023, 25027, 25029, 25031, 25033, 25035-25039, 25041-25045, 25047-25052, 25055-25056, 25058, 25061-25068, 25070, 25072-25078, 25080-25082, 25084, 25086, 25088, 25090, 25092, 25094-25095, 25099-25100, 25102-25103, 25106-25110, 25112, 25114-25117, 25119-25123, 25125, 25129-25132, 25134-25135, 25137-25146, 25148-25155, 25158, 25165, 25167, 25170-25173, 25175-25179, 25181-25190, 25192-25193, 25196-25198, 25200, 25202, 25206-25212, 25216, 25218-25219, 25222, 25230, 25232, 25235, 25239, 25242-25246, 25248-25251, 25253-25254, 25259-25260, 25262-25265, 25267-25268, 25271, 25274-25281, 25283-25299, 25302-25303, 25305-25311, 25313-25314, 25316-25318, 25324, 25331, 25339, 25341, 25343-25347, 25350, 25352-25354, 25358, 25360, 25363, 25366, 25370-25371, 25373, 25378-25382, 25392, 25394, 25397-25399, 25404, 25407-25412, 25414, 25419, 25421-25422, 25425, 25427-25432, 25437-25438, 25441-25443, 25445-25447, 25450-25452, 25455-25457, 25460, 25463-25468, 25470-25471, 25474-25476, 25478-25479, 25481-25487, 25489-25491, 25493, 25497-25501, 25503-25508, 25510, 25515-25517, 25519-25520, 25525-25534, 25537, 25539-25546, 25549, 25551, 25554-25555, 25558-25559, 25561-25562, 25564, 25566-25568, 25572-25574, 25576-25578, 25580-25583, 25585-25586, 25588-25589, 25594-25595, 25598, 25600-25601, 25607-25609, 25612-25613, 25615, 25618-25629, 25635-25637, 25639-25646, 25649-25661, 25664, 25669-25670, 25672, 25676, 25678-25682, 25684, 25688-25696, 25699-25700, 25702, 25705-25706, 25708-25710, 25714-25721, 25724, 25726, 25728-25730, 25732, 25734-25735, 25737-25739, 25742-25743, 25745-25750, 25752, 25754-25756, 25758-25763, 25766-25767, 25772-25773, 25780-25782, 25785-25787, 25789, 25792-25800, 25802, 25804, 25810-25812, 25814-25821, 25823, 25826, 25828, 25832-25833, 25835-25839, 25841, 25845-25846, 25852, 25855-25856, 25859-25860, 25867, 25869-25875, 25878, 25880-25882, 25885-25886, 25888-25890, 25892, 25899-25901, 25903-25904, 25909-25911, 25913-25916, 25920, 25922, 25928-25936, 25939-25940, 25942-25943, 25945-25946, 25950-25955, 25957-25959, 25970, 25975, 25977-25978, 25980-25982, 25984-25985, 25987-25988, 25993-25995, 25997-25998, 26005-26006, 26008-26009, 26013-26014, 26016-26020, 26022-26027, 26030, 26032, 26035-26036, 26038-26039, 26042-26047, 26049-26050, 26052-26054, 26056-26064, 26069, 26071, 26073-26078, 26085, 26087, 26089-26092, 26095-26096, 26100-26103, 26105-26106, 26108-26111, 26113, 26115, 26117, 26120-26121, 26124, 26128-26133, 26135-26137, 26143, 26149-26150, 26152-26153, 26157-26160, 26162, 26164, 26166-26168, 26172, 26176-26178, 26180-26182, 26184, 26188, 26190-26191, 26193-26195, 26197, 26201-26202, 26207, 26209-26211, 26213-26215, 26217-26218, 26220-26221, 26223, 26225-26226, 26229-26231, 26236, 26240-26242, 26244-26245, 26247-26248, 26250-26251, 26253-26255, 26259, 26265-26266, 26268, 26272-26274, 26278-26279, 26282, 26285, 26291-26292, 26294-26297, 26299-26300, 26303-26307, 26310-26315, 26319-26324, 26329, 26331-26333, 26337, 26340-26341, 26343, 26346-26351, 26354, 26356-26357, 26359-26361, 26363-26367, 26370, 26372, 26374-26383, 26385-26387, 26389, 26391-26392, 26395, 26397-26400, 26402-26408, 26411-26412, 26414, 26417-26420, 26422-26430, 26434-26435, 26438-26443, 26445-26447, 26449, 26451, 26454, 26456, 26458, 26460, 26465-26466, 26469, 26474-26475, 26479-26480, 26487-26488, 26491-26493, 26496-26501, 26503, 26505-26508, 26510, 26512-26514, 26518-26519, 26521-26522, 26524, 26526, 26529, 26531-26533, 26535-26536, 26538-26539, 26541-26542, 26544-26545, 26552, 26560, 26562, 26564, 26570-26571, 26573, 26575-26588, 26590-26591, 26594-26602, 26604-26605, 26607-26608, 26610-26614, 26625, 26627, 26632-26633, 26637, 26641-26643, 26645-26646, 26648-26649, 26651, 26653, 26656-26663, 26666-26667, 26669-26670, 26672-26673, 26675, 26684-26686, 26690-26692, 26703-26704, 26707, 26709-26712, 26714-26722, 26727, 26730, 26732, 26734-26737, 26739-26742, 26745-26748, 26752-26754, 26757-26760, 26772-26773, 26777, 26779, 26782, 26787, 26790, 26795-26800, 26805, 26807-26808, 26810-26812, 26815, 26817, 26819, 26821, 26823-26826, 26830-26832, 26838-26843, 26845, 26847, 26852, 26854-26856, 26858-26861, 26868, 26870-26872, 26874, 26876-26877, 26880, 26885, 26891-26892, 26895, 26898-26905, 26908-26909, 26923-26926, 26928-26929, 26932-26933, 26935-26937, 26939-26940, 26942, 26945, 26953, 26955-26960, 26963-26974, 26978, 26980-26981, 26984-26987, 26989-26990, 26992, 26994-26996, 26999-27000, 27002, 27006-27009, 27011-27012, 27014, 27017, 27020, 27025-27032, 27034, 27036-27037, 27039, 27041-27042, 27044-27046, 27048-27050, 27052-27053, 27055, 27057, 27059-27065, 27067-27074, 27076-27080, 27082-27084, 27086, 27088-27094, 27097-27099, 27102-27112, 27114-27116, 27119-27120, 27122-27130, 27132, 27134-27139, 27141-27143, 27146, 27149-27160, 27162-27163, 27165-27167, 27169-27174, 27177-27183, 27185-27193, 27197-27199, 27201, 27203-27205, 27207, 27209-27212, 27216-27217, 27222-27223, 27226, 27228, 27230, 27232, 27236, 27238-27241, 27243, 27246-27249, 27251-27252, 27254-27256, 27258-27263, 27265-27266, 27268, 27271-27272, 27278, 27281-27284, 27286-27287, 27289, 27291-27293, 27295-27305, 27307-27309, 27311-27313, 27316-27324, 27327, 27331-27337, 27340-27342, 27344, 27346, 27349-27351, 27357, 27359, 27361-27365, 27369-27370, 27372-27373, 27376, 27380, 27382-27384, 27386-27388, 27392-27393, 27398, 27400-27402, 27405, 27407-27409, 27411, 27413, 27415, 27417, 27420, 27426, 27429-27431, 27433-27441, 27444-

27445, 27449, 27452, 27454-27455, 27458, 27460, 27464, 27466, 27468-27469, 27471, 27475, 27477-27478, 27485, 27487-27490, 27497, 27502, 27504-27506, 27508-27511, 27513-27515, 27517-27519, 27521-27523, 27525, 27527-27530, 27532-27535, 27540-27550, 27552-27558, 27562-27568, 27570-27574, 27578-27580, 27582-27583, 27589-27594, 27598, 27600-27601, 27603-27607, 27611-27612, 27614, 27616-27617, 27619, 27622-27626, 27628-27636, 27640-27646, 27648-27650, 27654, 27658-27659, 27661, 27667, 27671-27673, 27676-27681, 27683-27684, 27686-27687, 27689, 27692-27693, 27697, 27699-27700, 27702-27706, 27708, 27710, 27713-27718, 27720, 27722-27724, 27726-27728, 27730-27732, 27736-27737, 27739-27742, 27746-27747, 27749-27751, 27753-27755, 27758-27759, 27761, 27763-27765, 27767-27768, 27771, 27773-27774, 27776-27782, 27784-27785, 27788, 27793-27795, 27797-27800, 27802, 27804-27806, 27808-27809, 27811, 27813-27817, 27819, 27821, 27823-27827, 27834-27836, 27839-27840, 27842-27844, 27846-27853, 27855-27856, 27858-27859, 27865, 27867, 27869, 27872, 27878, 27882-27883, 27885, 27888-27893, 27896, 27902-27906, 27910, 27913-27914, 27918, 27920, 27922-27925, 27928-27937, 27941, 27944, 27946, 27952-27958, 27960, 27964, 27968-27972, 27975, 27981, 27983-27990, 27992, 27996-27998, 28000-28002, 28004, 28006-28014, 28017-28018, 28020-28022, 28024-28025, 28028-28031, 28033-28034, 28036, 28038, 28040-28048, 28050-28052, 28056-28058, 28061-28063, 28065-28066, 28073-28074, 28076, 28078, 28082-28083, 28085-28088, 28092-28094, 28096-28098, 28101-28105, 28107, 28109, 28116-28117, 28120-28124, 28129, 28132, 28135-28136, 28139-28140, 28142-28143, 28145-28151, 28153-28155, 28161, 28163-28167, 28173, 28175-28179, 28181, 28188-28192, 28194, 28200-28201, 28206, 28208, 28210-28211, 28216, 28222, 28224-28226, 28228, 28230-28233, 28235-28236, 28240-28241, 28244, 28247-28249, 28251, 28253, 28255-28256, 28259-28262, 28265-28266, 28268, 28271-28274, 28276, 28278-28280, 28282-28283, 28285-28286, 28288-28293, 28296-28297, 28299-28300, 28304-28307, 28311, 28313, 28315-28321, 28323-28324, 28326-28329, 28331-28337, 28340, 28342-28343, 28346-28350, 28352, 28362-28366, 28369, 28371-28375, 28379, 28382-28383, 28386, 28389, 28392-28394, 28396-28400, 28402-28403, 28406-28407, 28409, 28412-28415, 28417, 28419-28422, 28425-28427, 28429-28431, 28433, 28435, 28438-28440, 28442-28443, 28445, 28447, 28450-28453, 28455, 28457-28462, 28465-28467, 28469-28474, 28477-28478, 28481-28482, 28484-28485, 28487, 28490-28494, 28496-28501, 28503, 28505-28515, 28517-28519, 28521-28522, 28525, 28527-28533, 28535, 28538-28546, 28549-28550, 28552-28554, 28556-28557, 28561-28563, 28566-28568, 28570-28579, 28581, 28583-28586, 28588-28595, 28598, 28601-28602, 28607, 28610-28619, 28621-28632, 28634, 28636, 28638, 28642, 28645-28648, 28650-28653, 28657-28658, 28660, 28662-28663, 28665, 28667-28673, 28675-28684, 28687, 28691, 28693-28699, 28704-28706, 28708, 28711-28713, 28716-28719, 28722, 28725, 28731-28734, 28736-28737, 28739-28740, 28742-28746, 28749-28759, 28761-28767, 28769, 28771-28774, 28777-28781, 28783-28784, 28792, 28798-28800, 28802-28806, 28808-28813, 28815, 28817, 28819-28821, 28823, 28826-28838, 28840, 28842-28849, 28851-28853, 28855-28859, 28861, 28865-28872, 28875, 28877-28883, 28885-28887, 28889-28893, 28896, 28898, 28901-28904, 28906, 28910-28911, 28913-28915, 28917, 28921-28927, 28931, 28937, 28943-28944, 28946-28949, 28951, 28953-28954, 28958-28959, 28961, 28966, 28968-28971, 28973-28975, 28979-28981, 28983-28984, 28988-28989, 28991, 28995, 28997-29003, 29006, 29008, 29010-29020, 29022, 29024-29025, 29027-29028, 29030-29033, 29040-29041, 29047-29055, 29057-29064, 29067, 29070-29071, 29075, 29077, 29079-29085, 29087-29091, 29093-29095, 29098, 29100, 29103, 29106, 29108-29109, 29111-29113, 29116, 29118, 29120, 29122-29125, 29127-29128, 29130-29131, 29133-29135, 29137, 29140, 29142, 29145, 29147-29149, 29151, 29153-29157, 29159-29161, 29164-29165, 29170-29171, 29173-29176, 29178, 29181, 29183-29188, 29190, 29193-29194, 29196-29201, 29203-29204, 29206-29208, 29210-29217, 29219-29222, 29224-29235, 29237-29240, 29242-29243, 29245-29247, 29249, 29251, 29255-29260, 29272, 29274-29276, 29278-29280, 29282-29287, 29290, 29294-29300, 29302-29305, 29307-29312, 29314, 29317-29319, 29321-29322, 29324-29328, 29330-29331, 29335-29336, 29338-29339, 29341-29349, 29353-29356, 29359, 29361-29364, 29366, 29370, 29373-29376, 29378-29379, 29384-29388, 29390-29391, 29394-29395, 29399-29403, 29407-29408, 29410-29412, 29416, 29418-29421, 29423, 29426, 29428, 29430-29433, 29435-29437, 29441, 29445-29448, 29450, 29453-29456, 29458-29459, 29463, 29465-29467, 29469, 29471-29473, 29476-29477, 29479-29483, 29485, 29489-29490, 29492-29495, 29497-29501, 29503, 29505-29509, 29511-29516, 29520-29529, 29531, 29533, 29535-29539, 29541, 29546, 29548-29551, 29553-29559, 29561, 29565, 29567-29568, 29571, 29573-29576, 29582-29586, 29588, 29590-29596, 29599-29600, 29605-29607, 29611-29613, 29616-29619, 29622, 29624, 29627-29628, 29631-29635, 29639-29641, 29646, 29648, 29650-29655, 29657-29659, 29661, 29665-29666, 29670-29671, 29673-29674, 29676, 29678-29681, 29683-29687, 29691, 29693, 29695, 29697-29698, 29700, 29702-29706, 29708-29713, 29715-29716, 29719-29723, 29726-29729, 29731, 29733-29735, 29740, 29745-29753, 29755-29756, 29758, 29761, 29763, 29765-29773, 29776, 29778-29780, 29782, 29784, 29788, 29790-29791, 29793-29797, 29799-29803, 29805, 29808-29821, 29823-29824, 29826-29832, 29835-29836, 29838, 29841, 29844, 29846, 29848-29850, 29852-29854, 29856, 29858-29859, 29861-29864, 29866-29868, 29870, 29872, 29874, 29876, 29879-29881, 29884-29890, 29892-29896, 29898-29903, 29908-29909, 29913-29914, 29916-29924, 29926-29928, 29935-29939, 29941-29953, 29956, 29961-29962, 29964-29965, 29967-29971, 29973, 29976-29978, 29982-29983, 29985-29986, 29988-29992, 29996, 30003-30006, 30008-30010, 30013, 30019-30028, 30031, 30033-30035, 30038-30039, 30041-30042, 30044, 30046-30051, 30053-30058, 30060, 30063, 30065, 30070, 30072-30079, 30081-30084, 30087-30090, 30092, 30094, 30096-30097, 30100, 30104, 30106-30111, 30114, 30118-30123, 30128-30132, 30136-30146, 30149-30150, 30155, 30157-30159, 30161-30172, 30175, 30177, 30180, 30186-30193, 30196-30197, 30201-30203, 30205-30207, 30210, 30212-30217, 30220-30224, 30226, 30228, 30230, 30232-30234, 30239, 30241-30245, 30248, 30253-30260, 30262, 30265-30267, 30270-30272, 30274, 30278, 30284-30285, 30287-30289, 30291-30292, 30294, 30301-30309, 30311-30314, 30316, 30319, 30322, 30324-30326, 30329-30331, 30334-30335, 30337-30338, 30340-30349, 30351-30352, 30355-30358, 30361-30364, 30368-30370, 30372-30373, 30376-30377, 30379-30380, 30383-30384, 30386-30387, 30389-30391, 30396-30404, 30407, 30409, 30412, 30423-30426, 30434-30435, 30438, 30440, 30442, 30445, 30448-30449, 30451-30452, 30454-30455, 30457-30458, 30460-30466, 30469-30478, 30480, 30482-30483, 30485-30486, 30488-30490, 30493-30495, 30499, 30501-30506, 30508-30510, 30512-30513, 30515, 30520-30529, 30531-30535, 30538, 30540-30542, 30544-30547, 30550-30551, 30553-30557, 30563-30571, 30573-30576, 30581-30582, 30584-30585, 30591, 30596, 30598-30599, 30603-30607, 30609, 30612-30620, 30624-30625, 30628-30631, 30633-30635, 30640, 30642-30658, 30660, 30663, 30666-30667, 30669, 30671-30682, 30684, 30687, 30690, 30692, 30699-30700, 30702-30704, 30706-30716, 30718-30720, 30722-30724, 30726-30729, 30731-30736, 30738, 30740-30741, 30743, 30745-30746, 30749-30751, 30754, 30758, 30760-30761, 30763, 30765, 30767, 30769, 30773, 30775, 30780-30784, 30786-30788, 30793, 30796, 30798-30799, 30801, 30803-30804, 30806, 30809-30811, 30815, 30819-30820, 30822-30824, 30826, 30831-30832, 30837-30838, 30840-30841, 30847-30852, 30854, 30857-30861, 30863, 30866-30867, 30870, 30872-30882, 30884-30885, 30887-30888, 30892, 30894-30895, 30897, 30899-30906, 30908, 30912, 30914-30917, 30919, 30921-30927, 30929, 30934-30937, 30940, 30943, 30945-30949, 30951-30953, 30955-30956, 30960, 30965, 30973-30976, 30978-30981, 30984, 30989, 30991, 30995-31004, 31007-31008, 31010-31012, 31014-31015, 31020, 31022-31023, 31025, 31027-31029, 31031-31035, 31043, 31045-31048, 31054-31055, 31057, 31059, 31062, 31064-31067, 31072, 31074-31076, 31078, 31080, 31084-31088, 31090, 31093-31095, 31098, 31100-31101, 31103-31107, 31109, 31111-31113, 31115-31116, 31119-31123, 31126, 31130, 31132, 31135, 31137-31142, 31145-31146, 31148, 31150-31159, 31161-31168, 31170-31172, 31174-31176, 31179-31185, 31187-31190, 31192-31194, 31196, 31199-31200, 31202-31205, 31208-31218, 31220, 31222-31232, 31234-31235, 31237, 31239-31241, 31244-31251, 31253-31254, 31256-31257, 31259-31260, 31263, 31272-31273, 31276-31277, 31280, 31283, 31286-31291, 31294, 31297-31299, 31301-31303, 31305, 31307, 31309-31311, 31313-31315, 31321-31324, 31327-31331, 31334, 31336-31338, 31340, 31342-31343, 31347, 31351-31353, 31355-31360, 31362-31363, 31365-31375, 31384, 31386-31387, 31389-31390, 31393-31394, 31396-31397, 31399-31401, 31403, 31405-31406, 31409, 31411-31412, 31414, 31416, 31418-31419, 31425-31430, 31433-31441, 31443, 31445, 31447, 31449-31450, 31454, 31458-31459, 31461-31468, 31471, 31475, 31477-31484, 31487, 31489, 31492, 31494-31497, 31500, 31502-31503, 31506-31510, 31513, 31516-31519, 31521-31527, 31529-31530, 31532-31533, 31536-31537, 31539-31540, 31543-31546, 31548-31551, 31554, 31556-31562, 31564-31568, 31570, 31572-31579, 31581, 31584, 31586-31588, 31590, 31592-31594, 31596-31599, 31603-31606, 31610, 31612, 31614, 31616-31617, 31619-31620, 31622-31626, 31629-31630, 31634, 31636-31637, 31639-31640, 31643-31644, 31646-31647, 31649, 31651, 31654, 31657-31659, 31662-31663, 31665, 31670-31672, 31676-31677, 31679-31680, 31683, 31686-31692, 31695-31699, 31701, 31703-31707, 31711, 31713-31716, 31718, 31720-31724, 31726, 31729-31731, 31734, 31737, 31740-31741, 31746-31747, 31749-31751, 31753, 31755-31756, 31758, 31763, 31772-31775, 31777-31778, 31780-31784, 31789, 31791-31798, 31800-31801, 31803, 31806-31811, 31813-31814, 31816-31817, 31819, 31821-31825, 31827, 31830-31832, 31834-31836, 31838, 31841, 31844, 31846-31849, 31851-31857, 31860, 31862-31863, 31865, 31869-31870, 31872, 31874, 31876, 31879, 31882-31884, 31886, 31888, 31890, 31892, 31894-31896, 31898, 31900-31901, 31903, 31906-31907, 31909-31910, 31913-31917, 31928, 31930, 31932-31934, 31936-31937, 31942, 31944-31946, 31949, 31951, 31953, 31955-31956, 31958, 31960, 31962, 31964, 31969-31970, 31974, 31976-31978, 31980-31981, 31984-31985, 31987-31989, 31991-31995, 31999, 32004, 32010-32011, 32013, 32016-32028, 32030, 32032, 32034-32041, 32043-32044, 32046-32048, 32050-32051, 32053, 32057, 32059, 32061-32062, 32064, 32068, 32072, 32074, 32077, 32080, 32082-32083, 32087, 32089, 32091-32093, 32095-32096, 32098, 32100, 32102, 32105, 32107, 32110-32112, 32119-32120, 32122-32125, 32127-32133, 32135-32137, 32139, 32141-32145, 32149-32152, 32154-32157, 32159-32162, 32164, 32166-32170, 32172-32176, 32179-32193, 32197, 32199, 32201-32203, 32205, 32207-32210, 32213, 32215, 32220, 32222-32228, 32230, 32232-32233, 32235, 32237-32241, 32243-32245, 32247, 32250-32251, 32253, 32255-32257, 32260, 32262-32263, 32265-32268, 32270-32273, 32275, 32277, 32279-32286, 32288-32294, 32297, 32299-32301, 32305-32308, 32310, 32312, 32316-32321, 32323, 32326, 32328-32333, 32335-32337, 32339-32340, 32343-32345, 32347-32348, 32355-32356, 32358-32363, 32366, 32369-32375, 32379, 32383, 32385, 32390, 32395-32402, 32404, 32406-32407, 32410-32411, 32414, 32418-32419, 32421, 32423, 32425, 32427-32430, 32438, 32441-32442, 32445-32446, 32449-32450, 32452, 32455-32469, 32471-32473, 32475-32477, 32479-32480, 32482-32483, 32485, 32489, 32492-32493, 32495-32496, 32498-32499, 32503-32509, 32512-32514, 32520-32521, 32529-32539, 32541-32543, 32547-32551, 32554, 32558, 32560-32561, 32564, 32566-32567, 32570, 32572, 32574-32576, 32579-32584, 32586-32589, 32592-32594, 32596, 32599-32601, 32604, 32606-32609, 32611-32616, 32619-32620, 32623-32625, 32629-32633, 32636-32643, 32646-32649, 32651, 32656-32662, 32664, 32668, 32670-32671, 32674, 32678-32680, 32683-32685, 32691-32693, 32696-32697, 32699, 32704-32708, 32711-32720, 32723, 32725-32726, 32728-32729, 32731-32735, 32737-32738, 32740, 32744, 32747, 32749, 32751-32755, 32760, 32763-32766, 32768, 32770, 32773-32779, 32782, 32784, 32786-32795, 32798, 32804, 32806-32808, 32812-32818, 32822, 32824-32828, 32830-32834, 32837-32839, 32841-32844, 32846-32853, 32856-32859, 32862, 32864-32866, 32871-32875, 32880-32881, 32883-32886, 32889-32890, 32895, 32897, 32900, 32902-32904, 32908, 32910, 32912-32916, 32918, 32920-32921, 32923, 32925-32926, 32931-32933, 32942, 32944-32945, 32948-32950, 32960, 32962-32972, 32975-32977, 32979-32980, 32982-32983, 32986-32988, 32990, 32992, 32998, 33000-33001, 33004, 33006-33007, 33010, 33013, 33016-33018, 33020-33022, 33024-33028, 33031, 33034, 33040-33042, 33044, 33046-33050, 33052-33054, 33056, 33058, 33061, 33064, 33066-33067, 33069, 33071-33072, 33074-33077, 33079, 33081-33083, 33085, 33087, 33089, 33094, 33097-33098, 33100, 33104, 33106-33108, 33111, 33113-33115, 33117, 33120, 33122-33123, 33125-33134, 33136, 33140-33145, 33148-33149, 33153, 33155-33157, 33160-33165, 33167, 33171-33175, 33178-33179, 33181-33182, 33184-33185, 33187, 33190, 33194, 33201-33205, 33209-33210, 33217-33218, 33221-33233, 33235-33236, 33239-33241, 33245, 33247, 33249, 33254-33258, 33262-33263, 33265-33266, 33268-33269, 33272, 33274, 33276-33281, 33283, 33285-33286, 33288-33289, 33291, 33293, 33295-33297, 33299, 33303-33304, 33307-33309, 33312-33314, 33316-33320, 33322, 33326-33327, 33329-33335, 33337, 33339-33344, 33346, 33348-33349, 33352-33353, 33355-33359, 33363, 33368-33369, 33373, 33375-33380, 33382-33383, 33385, 33388-33392, 33394, 33397-33399, 33401-33407, 33409-33413, 33416-33417, 33419-33420, 33425, 33429, 33432-33433, 33438-33440, 33445, 33449-33452, 33457-33461, 33463-33465, 33469-33473, 33478-33481, 33483, 33485-33487, 33492-33498, 33500, 33507-33508, 33512, 33515-33516, 33518, 33520-33530, 33533-33534, 33536, 33538, 33540-33543, 33545-33550, 33552-33559, 33562-33564, 33566-33567, 33573-33575, 33577-33578, 33580, 33582, 33585, 33589-33591, 33593, 33595-33596, 33598, 33601-33604, 33606, 33611-33613, 33615-33616, 33618, 33620, 33624-33625, 33627, 33630, 33635, 33637, 33639-33641, 33644-33645, 33649-33653, 33659, 33661, 33663-33666, 33670, 33674-33676, 33678-33679, 33685-33686, 33688-33689, 33691-33695, 33697-33699, 33701-33704, 33707-33709, 33711-33716, 33719, 33722-33724, 33726-33730, 33735-33736, 33740-33743, 33748-33752, 33756-33760, 33762, 33765-33766, 33768-33770, 33773, 33777, 33782, 33784-33785, 33788-33789, 33792-33794, 33796, 33799-33803, 33807, 33809-33816, 33818, 33820-33823, 33826, 33828, 33830, 33832-33836, 33838-33840, 33843, 33845-33846, 33848-33849, 33851-33852, 33855-33858, 33862-33868, 33871-33872, 33875, 33878-33880, 33883, 33885-33888, 33892-33893, 33895-33897, 33900-33901, 33903-33905, 33912-33914, 33916, 33918-33919, 33921, 33924-33925, 33927, 33930-33932, 33935, 33937-33941, 33943-33944, 33946, 33951-33959, 33961-33963, 33966-33971, 33973-33975, 33983-33996, 34003-34010, 34015-34017, 34019, 34021, 34023, 34026-34027, 34029, 34032, 34036-34037, 34040, 34042, 34046-34047, 34051-34052, 34054-34061, 34063-34065, 34067-34071, 34073-34075, 34077, 34082-34083, 34089-34091, 34095-34099, 34101, 34103-34120, 34122, 34124, 34126-34127, 34129, 34134, 34136-34137, 34139-34143, 34145-34148, 34152, 34154-34155, 34157, 34160, 34162-34164, 34166, 34168-34171, 34173, 34177, 34179, 34183, 34185-34198, 34202-34203, 34205, 34207, 34209, 34212-34213, 34217, 34219-34220, 34223, 34225-34226, 34228, 34230-34234, 34236-34237, 34239-34254, 34256-34258, 34261, 34263-34265, 34267-34269, 34271-34276, 34279-34281, 34286, 34290-34291, 34293, 34295-34296, 34298-34301, 34304-34307, 34309, 34311-34312, 34315-34317, 34319, 34322-34323, 34328-34333, 34336, 34340, 34342, 34344, 34346-34348, 34351, 34356-34360, 34362-34368, 34370-34375, 34378, 34380, 34385-34386, 34388-34396, 34398-34402, 34404-34406, 34409-34410, 34415-34423, 34425-34429, 34432-34436, 34442, 34445-34446, 34448-34449, 34451-34452, 34454-34456, 34460-34465, 34469, 34471-34473, 34475-34483, 34485-34486, 34488, 34490, 34496-34497, 34499, 34502, 34505-34508, 34510, 34513-34516, 34518-34520, 34522-34525, 34527-34532, 34534-34535, 34538-34539, 34541-34545, 34555, 34557-34566, 34572, 34576, 34578, 34580, 34582, 34586-34590, 34592-34600, 34603-34608, 34612, 34616-34617, 34620, 34622, 34626, 34628-34634, 34638-34642, 34644-34645, 34647-34650, 34652, 34654-34656, 34659-34660, 34662-34673, 34678, 34680-34682, 34684-34685, 34687, 34691, 34695-34704, 34706-34707, 34709, 34713-34714, 34716, 34718, 34720, 34725, 34727-34728, 34730-34731, 34733, 34736-34739, 34742, 34744, 34746-34748, 34750-34754, 34756-34758, 34761, 34767-34769, 34771, 34773-34781, 34783-34786, 34788-34790, 34792, 34794-34798, 34800-34801, 34804, 34807-34808, 34812, 34817-34818, 34820-34824, 34826, 34828-34829, 34833, 34835-34836, 34839-34840, 34843-34844, 34846-34853, 34855, 34857, 34859-34860, 34863-34864, 34866, 34868-34874, 34880, 34886, 34888-34891, 34896, 34899-34902, 34904-34908, 34910-34911, 34913-34915, 34919, 34921, 34925, 34928-34934, 34936-34938, 34940-34943, 34946-34948, 34950-34952, 34954, 34957, 34961-34963, 34966-34967, 34969-34970, 34972, 34974-34976, 34979-34987, 34991-34992, 34994, 34998, 35001-35002, 35004, 35006, 35010, 35013-35014, 35017-35019, 35026, 35029-35031, 35034-35036, 35039-35040, 35047, 35049-35050, 35052, 35054, 35057, 35063, 35066-35076, 35079-35080, 35083-35084, 35089-35092, 35095, 35101, 35104, 35110-35111, 35115, 35117-35121, 35123-35124, 35127, 35130, 35132-35133, 35137-35138, 35140, 35143, 35146, 35150, 35152, 35154, 35157-35158, 35160, 35166, 35168-35173, 35176-35177, 35180, 35183-35184, 35186-35188, 35190-35196, 35201-35205, 35208, 35213-35215, 35227-35233, 35236-35237, 35239-35243, 35246-35250, 35255-35258, 35261, 35263-35264, 35266, 35268-35269, 35277-35281, 35283, 35285-35300, 35307-35308, 35310, 35315, 35318-35320, 35323, 35325, 35328-35333, 35336-35337, 35340-35341, 35343-35352, 35354-35360, 35362-35364, 35366, 35368-35372, 35374, 35376-35378, 35380-35384, 35386-35390, 35392, 35394-35395, 35397-35399, 35401, 35405, 35407, 35409-35412, 35414, 35417, 35421-35425, 35427-35433, 35435-35436, 35438-35440, 35442-35443, 35445, 35447, 35453-35455, 35458-35459, 35461-35462, 35467, 35469-35471, 35473, 35478, 35483-35484, 35486, 35488, 35490-35491, 35493-35498, 35501-35502, 35505-35506, 35508-35510, 35512, 35514-35520, 35523, 35526-35528, 35531-35534, 35536, 35538-35541, 35548-35553, 35555, 35557-35578, 35581-35583, 35585-35586, 35588-35592, 35594-35600, 35603-35605, 35607, 35609, 35611, 35614, 35619-35621, 35625-35626, 35628-35630, 35632, 35635, 35638, 35642-35645, 35647-35648, 35650-35656, 35658-35660, 35662-35664, 35667, 35669-35670, 35674, 35676-35683, 35687, 35689, 35694-35700, 35702, 35705-35710, 35713, 35716-35719, 35721-35723, 35725-35727, 35729, 35731-35739, 35741, 35743, 35745, 35750-35753, 35756-35758, 35760-35761, 35763-35764, 35766, 35768-35773, 35775-35776, 35778, 35781-35783, 35785-35786, 35788-35789, 35791-35794, 35796, 35798, 35801, 35803, 35806-35811, 35813-35814, 35816-35818, 35822, 35824, 35827-35835, 35837-35842, 35844, 35847, 35853-35857, 35859, 35861-35864, 35866-35868, 35870-35871, 35874-35875, 35879-35880, 35882-35883, 35885, 35887-35889, 35891, 35893, 35895, 35897, 35899-35900, 35902, 35906-35921, 35923-35924, 35926-35927, 35929-35931, 35933, 35936, 35939-35940, 35943-35945, 35947-35948, 35950-35951, 35953-35956, 35958-35963, 35965-35966, 35969, 35971, 35974, 35977-35980, 35983, 35985-35986, 35988-35998, 36001-36003, 36015, 36018, 36020, 36024-36025, 36028, 36030, 36035-36036, 36038, 36040-36042, 36044-36046, 36049, 36052-36053, 36056, 36063, 36065-36067, 36070-36071, 36076-36077, 36079, 36081-36083, 36098, 36100-36101, 36103, 36108, 36110-36112, 36114-36115, 36119, 36124-36126, 36128-36129, 36131-36132, 36135, 36137, 36140-36141, 36143-36145, 36147-36149, 36151-36157, 36159-36162, 36164, 36167, 36169-36170, 36173-36179, 36182, 36185, 36187-36188, 36192-36193, 36195-36200, 36202-36203, 36205, 36207-36210, 36213-36218, 36222-36234, 36237-36245, 36249, 36252-36256, 36259-36260, 36262-36267, 36269-36271, 36273-36276, 36278-36284, 36286-36291, 36293-36294, 36296-36302, 36305-36310, 36314, 36316-36317, 36320-36323, 36326, 36328, 36332, 36337-36340, 36342-36345, 36348, 36350-36363, 36366, 36368-36371, 36373-36379, 36382-36388, 36391, 36395-36398, 36401-36404, 36406-36413, 36416-36422, 36424, 36428-36433, 36436-36439, 36442, 36446-36447, 36450, 36453, 36456-36457, 36460-36462, 36464-36465, 36468, 36472, 36474, 36476-36480, 36482, 36485-36493, 36495-36496, 36512, 36515-36516, 36518-36529, 36532-36536, 36538-36540, 36544-36545, 36547-36548, 36550, 36558-36559, 36561-36563, 36565-36566, 36569, 36571-36572, 36574-36575, 36577-36579, 36581, 36583-36584, 36586-36590, 36592-36593, 36595, 36599, 36604-36605, 36608-36609, 36614-36619, 36622-36624, 36626-36627, 36630-36633, 36635, 36637, 36640-36643, 36645-36648, 36650, 36652-36653, 36655-36657, 36660-36662, 36664, 36666-36668, 36672-36674, 36677, 36679, 36681, 36683-36686, 36690, 36694, 36696, 36698-36700, 36702, 36704, 36706, 36708, 36712, 36714-36716, 36722-36724, 36727-36728, 36730-36731, 36733-36737, 36739-36742, 36744-36749, 36751-36755, 36758-36764, 36766-36767, 36769-36772, 36775, 36777-36780, 36784-36785, 36788, 36790-36796, 36799, 36801, 36807, 36809, 36811, 36813-36814, 36816-36817, 36824-36827, 36829, 36834-36836, 36838, 36843-36854, 36856-36857, 36859-36863, 36870, 36872, 36875-36878, 36880-36881, 36885-36897, 36899, 36901, 36903-36906, 36909, 36913-36915, 36918, 36920-36923, 36926, 36929-36940, 36942, 36948-36949, 36954-36956, 36962-36964, 36971-36972, 36974, 36978-36979, 36982, 36984, 36987, 36990-36993, 36995, 36998-37002, 37004, 37006, 37008, 37010, 37014-37015, 37017-37018, 37020-37023, 37025-37026, 37028-37029, 37031-37032, 37038, 37041-37042, 37044, 37046-37047, 37049-37051, 37053-37056, 37059-37060, 37063, 37065, 37069-37070, 37075, 37077, 37081-37083, 37085-37086, 37089, 37098, 37100-37102, 37104-37105, 37107-37110, 37113-37117, 37119, 37123, 37125-37127, 37130, 37133-37134, 37137-37138, 37141-37142, 37144, 37146-37147, 37149, 37152, 37154-37155, 37157-37158, 37160-37165, 37167, 37169, 37171-37174, 37178-37181, 37183, 37185-37186, 37188-37191, 37193, 37198, 37203-37207, 37213-37214, 37216, 37218-37219, 37222-37223, 37225-37227, 37229-37237, 37239, 37241-37248, 37250-37252, 37254, 37256-37263, 37265-37268, 37271-37272, 37274-37275, 37277-37278, 37280-37281, 37284-37290, 37292-37299, 37302-37304, 37306-37309, 37312, 37314, 37319, 37322, 37330, 37335, 37338-37342, 37345-37348, 37350-37356, 37359-37361, 37363, 37365-37368, 37370, 37375-37376, 37378-37382, 37385, 37387-37388, 37393-37395, 37397-37399, 37401-37406, 37408-37409, 37414, 37416, 37420-37422, 37424-37425, 37429, 37431-37436, 37438, 37440-37442, 37448, 37452-37453, 37457-37464, 37466-37467, 37471-37485, 37487, 37489-37493, 37497-37498, 37500-37502, 37507-37514, 37516-37517, 37520, 37522-37523, 37525-37528, 37531-37534, 37536, 37538-37539, 37541, 37543-37547, 37549-37550, 37552-37556, 37558, 37560-37561, 37565, 37567-37568, 37575, 37577, 37581, 37583-37584, 37590-37593, 37595, 37597, 37601-37603, 37605-37606, 37608-37609, 37611-37616, 37619-37624, 37627-37628, 37630-37632, 37634, 37639, 37641-37652, 37654, 37656-37658, 37660-37661, 37663-37664, 37666-37668, 37670-37672, 37677, 37680-37684, 37686-37687, 37689, 37692-37694, 37700, 37703-37704, 37706-37710, 37714-37715, 37718-37721, 37731-37732, 37736-37737, 37742-37744, 37746-37747, 37749-37755, 37757-37758, 37760-37763, 37768, 37770-37772, 37776, 37781-37782, 37785-37786, 37792-37793, 37796-37799, 37801-37805, 37807-37809, 37811, 37814-37818, 37820, 37823, 37825-37826, 37829, 37832, 37836-37837, 37839, 37841, 37843, 37845, 37848, 37850, 37852-37854, 37862, 37867, 37870, 37872-37874, 37876, 37878, 37880, 37882-37889, 37891-37895, 37898-37900, 37902-37904, 37908-37909, 37911-37912, 37914-37915, 37918-37919, 37921, 37924-37925, 37927, 37929-37932, 37934, 37936, 37938-37939, 37941, 37943, 37945, 37947, 37949-37951, 37958-37961, 37964-37967, 37969-37970, 37972-37973, 37975-37979, 37981-37983, 37986, 37989-37990, 37994-37996, 38000-38003, 38005-38006, 38008-38009, 38011-38015, 38017, 38021-38026, 38028-38033, 38035-38037, 38040, 38042-38045, 38048, 38055-38056, 38059, 38065-38066, 38068-38073, 38075-38079, 38081-38082, 38087, 38089, 38091-38093, 38097, 38099, 38101, 38108-38113, 38115, 38118-38120, 38123, 38125-38126, 38128-38132, 38134, 38138-38141, 38146, 38150, 38153-38154, 38156, 38158, 38160, 38162-38166, 38170, 38176-38178, 38180, 38182, 38186, 38192, 38194, 38196, 38198, 38200, 38202, 38204-38205, 38208-38209, 38213-38214, 38216, 38220, 38222-38224, 38227-38229, 38234-38235, 38238-38239, 38242, 38250, 38253-38254, 38256, 38258, 38260-38266, 38268, 38275-38276, 38279-38283, 38286-38287, 38293, 38296, 38300, 38303, 38306-38307, 38314-38315, 38318-38319, 38324-38329, 38331, 38337, 38345-38347, 38349-38350, 38352, 38355, 38360, 38362-

38363, 38365-38366, 38369-38370, 38374, 38376-38377, 38379-38385, 38387, 38392-38394, 38397-38398, 38401-38405, 38407, 38410, 38412-38413, 38417-38418, 38421, 38429-38430, 38432-38434, 38436, 38439-38442, 38444, 38446, 38448, 38451-38453, 38462-38463, 38466-38468, 38470, 38473, 38477, 38479-38480, 38483, 38485-38488, 38490-38493, 38495-38498, 38500, 38503, 38505-38506, 38509, 38511-38513, 38515, 38517-38519, 38527, 38530-38531, 38534, 38536, 38539-38541, 38543, 38545-38547, 38550, 38553, 38555-38557, 38559-38561, 38563, 38565-38567, 38569-38572, 38575-38576, 38586, 38589, 38591, 38594-38596, 38599-38601, 38603-38607, 38613, 38615-38616, 38618-38619, 38630, 38634, 38636-38640, 38642, 38645-38646, 38648, 38650-38652, 38657-38658, 38660, 38662-38663, 38665, 38667-38668, 38673-38674, 38676-38677, 38679-38682, 38684-38690, 38692-38698, 38700-38704, 38706-38708, 38710-38713, 38715-38720, 38722-38723, 38726, 38728, 38737, 38741-38745, 38747-38751, 38756-38758, 38762, 38765, 38769, 38772, 38775, 38777-38779, 38782, 38785-38786, 38788-38789, 38791, 38793-38794, 38796, 38799-38801, 38803-38807, 38810-38813, 38816, 38819-38820, 38824-38827, 38829-38831, 38835-38839, 38841-38842, 38845-38850, 38853-38856, 38860-38862, 38865-38866, 38869, 38871-38875, 38877-38880, 38886, 38889, 38894-38896, 38898, 38900, 38903-38904, 38908-38911, 38913, 38917-38918, 38921-38924, 38926-38927, 38929-38930, 38933, 38940, 38942-38944, 38946, 38948, 38952-38956, 38961-38962, 38965, 38968, 38971-38972, 38974, 38976, 38982-38984, 38986, 38988, 38991-38994, 38999-39001, 39005-39007, 39009-39010, 39012-39013, 39017-39018, 39022, 39026, 39029, 39032-39036, 39038, 39040, 39042, 39045-39046, 39050, 39052-39058, 39061, 39064, 39067-39075, 39083, 39088-39089, 39091, 39093-39098, 39101-39102, 39104-39110, 39112-39119, 39121-39123, 39125, 39127, 39133, 39136-39142, 39145-39151, 39153-39163, 39165-39168, 39170, 39175-39178, 39180-39181, 39183-39184, 39186, 39188-39191, 39196, 39199-39200, 39203-39204, 39206, 39212-39219, 39221-39223, 39225, 39228-39229, 39231-39238, 39241, 39245-39247, 39250-39251, 39256-39261, 39263-39267, 39269-39271, 39273-39283, 39288-39289, 39292-39296, 39298-39299, 39301-39306, 39310, 39315-39319, 39321-39322, 39324-39328, 39330, 39332-39333, 39335-39336, 39342-39344, 39346-39350, 39353, 39355-39356, 39360, 39367, 39369-39374, 39376-39378, 39380, 39382-39383, 39385-39393, 39395-39396, 39399, 39402, 39405-39407, 39409-39410, 39412-39415, 39417, 39420-39422, 39424, 39426-39430, 39432-39435, 39437, 39439, 39441-39445, 39449-39456, 39458-39460, 39462-39466, 39468, 39470, 39475-39476, 39478, 39481, 39484-39493, 39496-39500, 39503-39504, 39506-39524, 39526-39539, 39544-39545, 39549-39553, 39555-39564, 39566-39568, 39570, 39572-39573, 39576, 39578-39579, 39582, 39588-39594, 39596-39598, 39600-39601, 39606-39609, 39611, 39613-39614, 39616, 39618-39619, 39621, 39624-39626, 39629-39632, 39634, 39636-39638, 39642, 39644-39646, 39648-39655, 39657-39658, 39660-39662, 39664-39665, 39668-39670, 39677, 39679-39683, 39686-39687, 39689-39693, 39695, 39697-39698, 39700-39702, 39704, 39707, 39709, 39711-39717, 39719-39720, 39723-39724, 39726, 39729, 39731-39736, 39738-39739, 39741-39743, 39745, 39747-39748, 39750, 39752-39753, 39756, 39758, 39761-39776, 39780-39784, 39786-39787, 39792, 39794, 39796, 39798, 39800-39801, 39803-39806, 39808-39809, 39811-39813, 39815, 39817-39826, 39828, 39830, 39833, 39835, 39837, 39839, 39841-39842, 39844-39854, 39856, 39861, 39864, 39866-39867, 39870-39871, 39874-39877, 39879-39883, 39886-39890, 39892, 39897-39900, 39902-39907, 39909, 39911-39912, 39914-39916, 39918-39926, 39928-39934, 39936-39937, 39939, 39944-39948, 39950, 39952-39960, 39963, 39966-39967, 39969-39973, 39976, 39978-39979, 39981, 39984-39987, 39990, 39992, 39994-39999, 40001, 40003-40004, 40006-40007, 40010-40015, 40021-40022, 40025-40029, 40031-40032, 40035, 40038-40039, 40041, 40043-40044, 40046, 40048-40049, 40053-40056, 40058-40059, 40061, 40063-40064, 40066-40072, 40076-40081, 40083-40086, 40088-40092, 40095-40096, 40099, 40101-40102, 40104-40105, 40108-40111, 40113-40118, 40120-40126, 40129, 40131-40132, 40134-40136, 40139-40143, 40145-40148, 40150-40151, 40153, 40155, 40158-40161, 40164, 40166-40169, 40172, 40174-40176, 40178-40183, 40192, 40196, 40199, 40201-40203, 40205, 40209, 40215, 40218, 40224, 40227, 40229, 40231-40235, 40237-40239, 40243-40246, 40249, 40252-40254, 40256-40257, 40261-40263, 40265, 40267-40273, 40275, 40278-40279, 40281-40282, 40284-40289, 40291-40294, 40296, 40301-40302, 40304, 40309, 40311-40312, 40314-40315, 40318-40319, 40322, 40325-40326, 40328, 40330-40331, 40335, 40337-40338, 40344-40345, 40349, 40354-40355, 40357-40361, 40363-40364, 40367-40369, 40371, 40373, 40375-40378, 40380-40382, 40384, 40386-40387, 40389-40390, 40392-40393, 40397-40399, 40403-40408, 40412, 40414, 40417, 40421-40425, 40427-40430, 40432, 40434, 40436, 40438-40439, 40442-40445, 40447, 40450, 40452, 40454, 40456-40457, 40461-40467, 40469-40470, 40475, 40477, 40479-40483, 40488-40489, 40492, 40494-40495, 40497-40498, 40501-40502, 40504-40507, 40509-40510, 40512-40520, 40522, 40524-40526, 40528-40529, 40531-40532, 40534, 40539-40540, 40545-40549, 40552-40554, 40556-40557, 40559-40562, 40564-40566, 40569, 40571, 40573-40576, 40578, 40580, 40583-40586, 40588-40589, 40592-40593, 40595-40600, 40602-40603, 40606, 40611-40613, 40615, 40617, 40619-40626, 40628-40630, 40633-40634, 40637-40639, 40642, 40644, 40646, 40648-40652, 40654, 40658-40660, 40667, 40669-40670, 40676-40677, 40679, 40682, 40684, 40687, 40689, 40693, 40695-40703, 40705, 40707, 40709-40710, 40712, 40715, 40718-40721, 40726-40727, 40729, 40731-40739, 40742-40744, 40747-40761, 40763-40764, 40767-40768, 40770, 40772, 40774-40777, 40779, 40781, 40783, 40785-40787, 40791-40792, 40795-40796, 40799, 40802-40803, 40805, 40807, 40809-40811, 40813-40817, 40820, 40825-40827, 40830-40837, 40840-40842, 40844-40848, 40850-40855, 40857-40870, 40872, 40874-40875, 40878, 40882, 40884-40886, 40888-40892, 40895, 40897-40899, 40901-40902, 40905, 40909-40912, 40914, 40916-40917, 40919-40920, 40924-40941, 40946-40947, 40949, 40955-40959, 40961-40968, 40970, 40973, 40975-40980, 40982-40984, 40987, 40990, 40992-40995, 40997-41001, 41008-41009, 41013-41029, 41031-41032, 41034, 41038-41039, 41043-41045, 41048, 41053-41054, 41057-41059, 41061, 41063-41066, 41068-41075, 41077, 41082-41083, 41085, 41095-41100, 41102-41104, 41106-41109, 41112, 41119-41124, 41127, 41131-41133, 41137-41143, 41146, 41148-41149, 41151-41153, 41156-41158, 41160-41161, 41165, 41168-41175, 41178-41185, 41187-41189, 41192, 41194-41197, 41199-41202, 41204-41206, 41209-41211, 41213-41214, 41216, 41218-41222, 41227, 41230, 41232-41233, 41235, 41238, 41241-41242, 41248, 41252-41253, 41255, 41258-41264, 41267, 41269, 41275-41276, 41278, 41281, 41283-41284, 41287-41291, 41293-41299, 41301-41303, 41306-41314, 41316, 41319-41323, 41325, 41327, 41329-41330, 41332, 41336-41340, 41344-41349, 41352, 41354-41359, 41361-41362, 41364-41368, 41371, 41374-41377, 41379, 41381, 41383-41384, 41386-41388, 41390-41392, 41394-41397, 41399-41404, 41406, 41408, 41415-41416, 41418-41422, 41424, 41426-41427, 41429-41432, 41434, 41436, 41438-41442, 41444, 41446, 41448-41451, 41457, 41459, 41461-41465, 41468-41472, 41474-41477, 41480, 41482-41487, 41489, 41491, 41494-41498, 41500-41501, 41503-41504, 41506, 41510-41512, 41514-41515, 41518, 41521-41522, 41527, 41529-41532, 41536-41538, 41540, 41542-41543, 41545, 41547-41549, 41552-41557, 41559-41560, 41562, 41564, 41567-41568, 41572, 41574, 41578-41586, 41591-41593, 41597, 41603, 41611, 41615, 41618, 41620, 41622, 41624-41626, 41631, 41633-41636, 41639, 41641-41644

Single Strand Oligonucleotides (Sense Strand of Target Gene)

SeqID range: 41548-59739

SeqIDs w/o G Runs:

41548-41559, 41564-41581, 41583-41588, 41592-41597, 41599-41603, 41609-41613, 41616-41630, 41633-41723, 41736-41763, 41769-41800, 41802-41845, 41859-41979, 41994-42042, 42052-42108, 42111-42372, 42380-42389, 42405-42446, 42448-42454, 42457-42469, 42483-42519, 42525-42677, 42691-42739, 42753-42772, 42785-42838, 42851-43007, 43022-43131, 43145-43182, 43200-43219, 43233-43538, 43554-43637, 43651-43847, 43873-43965, 43979-44020, 44035-44041, 44056-44078, 44093-44146, 44172-44194, 44208-44216, 44230-44340, 44354-44378, 44392-44423, 44437-44442, 44467-44500, 44514-44562, 44577-44622, 44636-44649, 44663-44887, 44901-44995, 45009-45161, 45175-45180, 45192-45292, 45306-45329, 45343-45440, 45454-45496, 45510-45524, 45538-45605, 45630-45649, 45669-46112, 46126-46131, 46145-46332, 46361-46399, 46413-46553, 46576-46608, 46622-46652, 46667-46971, 46985-47015, 47029-47088, 47102-47241, 47255-47328, 47342-47590, 47614-47717, 47733-47885, 47892-47913, 47928-47954, 47968-48049, 48063-48130, 48144-48160, 48174-48177, 48192-48307, 48322-48385, 48399-48466, 48484-48525, 48536-48678, 48692-48695, 48709-48712, 48726-48750, 48764-48808, 48822-48829, 48843-48951, 48965-48966, 48980-49020, 49034-49135, 49148-49214, 49228-49291, 49306-49327, 49341-49583, 49598-49757, 49771-50022, 50037-50136, 50150-50254, 50262-50528, 50542-50549, 50563-50578, 50593-50723, 50738-50740, 50754-51033, 51047-51094, 51108-51204, 51219-51759, 51773-51800, 51814-51877, 51882-51894, 51914-51991, 51997-52030, 52034-52080, 52094-52097, 52112-52177, 52191-52245, 52259-52262, 52287-52313, 52327-52353, 52367-52603, 52617-52660, 52674-52692, 52706-53020, 53034-53117, 53128-53137, 53152-53168, 53192-53193, 53204-53245, 53265-53556, 53584-53683, 53697-53770, 53789-53831, 53846-53891, 53905-53966, 53987-54019, 54037-54203, 54217-54241, 54246-54255, 54264-54432, 54446-54488, 54506-54532, 54546-54627, 54641-54666, 54681-54736, 54750-54876, 54890-54982, 54996-55012, 55026-55041, 55055-55090, 55104-55151, 55165-55217, 55231-55241, 55255-55268, 55282-55353, 55373-55553, 55575-55597, 55612-55687, 55704-55711, 55730-55778, 55792-55921, 55936-55939, 55954-56045, 56059-56143, 56158-56243, 56257-56445, 56459-56463, 56478-56519, 56534-56538, 56564-56764, 56786-56894, 56908-56945, 56961-56993, 57007-57085, 57107-57119, 57134-57266, 57280-57301, 57317-57374, 57388-57393, 57407-57464, 57489-57496, 57511-57713, 57727-57759, 57773-57962, 57977-58505, 58519-58694, 58708-58762, 58777-58890, 58904-59140, 59154-59259, 59274-59290, 59304-59364, 59378-59391, 59406-59456, 59470-59552, 59566-59647, 59662-59716, 59724-59739

SeqIDs w/o miR Seeds:

41548-41549, 41552-41557, 41559-41560, 41562, 41564, 41567-41568, 41572, 41574, 41578-41586, 41591-41593, 41597, 41603, 41611, 41615, 41618, 41620, 41622, 41624-41626, 41631, 41633-41636, 41639, 41641-41644, 41648-41649, 41651, 41653, 41656-41658, 41662-41664, 41668-41674, 41676-41677, 41681-41683, 41685-41687, 41689-41691, 41697, 41699, 41702-41703, 41705-41706, 41710, 41712-41716, 41720-41721, 41723, 41728, 41731, 41734-41739, 41741, 41743-41745, 41747-41756, 41758, 41760-41766, 41769, 41771, 41775-41780, 41782-41783, 41786-41788, 41791-41792, 41794-41795, 41797, 41799, 41801-41802, 41804, 41808, 41810, 41812-41815, 41818-41819, 41821-41826, 41832-41837, 41841, 41843, 41846-41847, 41850-41852, 41854, 41862, 41864-41866, 41868, 41870-41872, 41874-41875, 41877, 41879, 41881, 41887, 41889-41899, 41903, 41906-41909, 41911, 41914-41916, 41918-41923, 41925-41934, 41938, 41941, 41943, 41945, 41947, 41950-41952, 41957-41958, 41961, 41964-41968, 41976-41978, 41980-41981, 41983, 41986, 41989-41990, 41993-41994, 41998-42001, 42003-42008, 42010-42011, 42013-42015, 42017-42022, 42024, 42027-42029, 42034-42036, 42038-42040, 42042-42046, 42048, 42051, 42053-42054, 42057, 42059, 42061, 42066-42067, 42070-42071, 42073-42074, 42078, 42082, 42084, 42087, 42089-42094, 42097, 42099-42100, 42104-42105, 42108, 42110-42111, 42113-42115, 42117-42122, 42124-42128, 42131-42132, 42134-42140, 42143-42144, 42146-42147, 42150-42152, 42154-42156, 42159-42168, 42173-42181, 42183, 42186, 42188, 42191, 42193-42197, 42200-42214, 42217, 42219, 42221, 42223-42227, 42229, 42231-42233, 42235-42244, 42246, 42249-42255, 42257-42259, 42261-42262, 42265-42266, 42268-42272, 42274-42275, 42279-42280, 42283-42287, 42289-42292, 42295-42299, 42301-42302, 42304, 42309, 42311-42312, 42314-42315, 42317-42318, 42321-42323, 42325-42327, 42332-42336, 42338-42340, 42342, 42344, 42346, 42348-42354, 42357-42372, 42374, 42377, 42380-42384, 42386-42394, 42396, 42404-42407, 42409-42410, 42412-42415, 42419, 42421-42422, 42426-42427, 42430-42432, 42436, 42442, 42444, 42448-42450, 42453-42454, 42459, 42462, 42470, 42472, 42474-42477, 42479-42480, 42485, 42488, 42491-42492, 42494, 42497-42501, 42503-42506, 42508-42509, 42515, 42519-42520, 42522-42523, 42526, 42529, 42532, 42534-42540, 42546, 42549-42554, 42556-42568, 42570, 42574-42578, 42580-42582, 42584, 42586, 42588-42589, 42591-42593, 42597, 42600-42602, 42607, 42611, 42617-42619, 42621, 42623, 42629-42634, 42642-42645, 42647-42648, 42650-42651, 42653-42662, 42664-42671, 42674-42675, 42680-42682, 42688-42689, 42691-42693, 42695, 42697-42700, 42702-42703, 42705, 42707, 42709-42710, 42713, 42715-42716, 42718-42724, 42726-42727, 42730-42735, 42737-42742, 42744, 42746-42749, 42751-42752, 42755-42757, 42759-42760, 42763-42764, 42766, 42768-42769, 42774-42775, 42778, 42783, 42786-42790, 42792-42795, 42797-42798, 42803, 42806-42807, 42809, 42815, 42819-42820, 42822-42823, 42825-42831, 42834-42835, 42838, 42843, 42846, 42848-42851, 42853, 42855, 42858, 42860-42865, 42867-42868, 42870-42879, 42882-42884, 42889-42891, 42893-42896, 42898-42900, 42902-42908, 42910-42912, 42914-42916, 42919, 42923-42925, 42928-42929, 42932-42934, 42936, 42939-42940, 42942, 42944-42945, 42950-42951, 42954, 42956, 42958-42959, 42962, 42965-42971, 42974-42975, 42977, 42979-42985, 42987-42990, 42992-42999, 43003-43007, 43009-43015, 43020, 43022-43025, 43027-43028, 43030-43032, 43036-43039, 43041-43051, 43053, 43055-43056, 43058-43059, 43061-43071, 43073, 43075-43077, 43079-43080, 43082-43083, 43086-43088, 43090, 43092, 43094-43095, 43097-43099, 43101, 43103-43113, 43115-43117, 43119, 43121-43123, 43125, 43127-43128, 43130-43136, 43139-43141, 43144-43149, 43152-43153, 43155-43161, 43165, 43167, 43169-43170, 43174, 43176, 43178-43180, 43182, 43187-43190, 43192, 43197, 43201-43205, 43207-43209, 43211, 43213-43218, 43222-43225, 43229-43235, 43238-43250, 43252, 43254-43255, 43260-43268, 43270-43272, 43274-43278, 43280, 43283-43300, 43302-43304, 43306-43308, 43311, 43313-43315, 43317-43320, 43322, 43324-43325, 43327-43332, 43335, 43337-43339, 43343-43346, 43348-43354, 43358-43361, 43363-43370, 43372-43384, 43386-43389, 43391-43399, 43401-43409, 43412, 43414, 43416-43418, 43420-43422, 43425, 43427-43428, 43431-43434, 43436-43437, 43440, 43443-43447, 43450-43451, 43455-43456, 43458-43462, 43464, 43466-43468, 43470, 43472-43476, 43478, 43480, 43482, 43484-43485, 43487-43489, 43491-43496, 43498-43499, 43501, 43503, 43509-43517, 43519-43520, 43522, 43524, 43529-43537, 43539, 43541-43544, 43546-43547, 43554-43556, 43558, 43560, 43562-43568, 43570, 43573-43575, 43577-43580, 43582, 43586-43587, 43589-43596, 43599-43601, 43604-43611, 43618-43626, 43629-43632, 43634-43637, 43639-43640, 43642-43643, 43645-43648, 43651-43653, 43657, 43661, 43663, 43666, 43668-43670, 43672, 43674, 43677-43680, 43682-43684, 43686, 43690, 43693-43695, 43697, 43699-43700, 43702-43704, 43707, 43709-43711, 43713-43716, 43718-43726, 43729-43730, 43732, 43734-43737, 43739, 43741, 43743, 43746, 43749-43758, 43760, 43763-43769, 43772, 43775-43783, 43785-43786, 43788, 43790-43791, 43793-43796, 43798, 43801-43803, 43805-43808, 43810-43816, 43819-43821, 43826-43831, 43833-43835, 43843, 43845-43853, 43860-43865, 43867, 43869, 43873-43874, 43877-43878, 43882-43883, 43885-43886, 43888-43894, 43897-43908, 43910, 43913, 43915-43918, 43923-43925, 43927-43928, 43930-43931, 43934-43936, 43938-43939, 43941-43942, 43947-43953, 43956-43966, 43968, 43973-43975, 43977, 43979-43980, 43984, 43987, 43990-44001, 44003, 44006-44007, 44009-44010, 44018-44020, 44023-44029, 44031, 44033, 44035-44040, 44042-44043, 44045-44046, 44048-44050, 44056-44059, 44061-44067, 44069-44070, 44073, 44075, 44078, 44081-44082, 44086-44087, 44090, 44092, 44094-44097, 44099-44105, 44107, 44109-44112, 44114, 44116, 44119-44126, 44128-44129, 44131-44133, 44135-44136, 44138-44150, 44153-44155, 44157, 44159-44163, 44166, 44168, 44170-44172, 44174-44175, 44178-44182, 44184, 44186, 44190-44193, 44196, 44198-44205, 44208, 44211, 44213-44215, 44217-44224, 44226-44229, 44232-44235, 44238, 44241-44242, 44244-44245, 44248-44256, 44258-44259, 44261, 44267, 44269, 44271, 44273-44274, 44276-44283, 44286-44288, 44292-44293, 44299-44302, 44304, 44306-44308, 44312-44313, 44316, 44323, 44325-44328, 44330, 44332-44340, 44342, 44344-44347, 44350, 44352-44354, 44357-44358, 44360-44363, 44368, 44371-44375, 44377, 44379-44384, 44392, 44394, 44396, 44399, 44401, 44403-44405, 44408-44413, 44419-44420, 44423, 44426-44427, 44429, 44431-44437, 44439-44441, 44443, 44445-44448, 44450, 44453, 44455-44456, 44458-44459, 44461, 44463, 44465, 44469-44470, 44473-44475, 44477, 44479, 44482, 44486-44487, 44489, 44491-44499, 44501, 44504, 44506, 44508, 44510-44511, 44514-44515, 44517, 44519-44522, 44524, 44526, 44528-44529, 44532-44533, 44536, 44538, 44542, 44544-44545, 44548, 44550-44551, 44559, 44562-44566, 44568-44569, 44571, 44576-44581, 44584-44587, 44591-44592, 44594-44595, 44599-44604, 44606, 44608, 44611-44613, 44615-44616, 44619-44621, 44623-44638, 44640-44646, 44651, 44653-44654, 44658-44659, 44661-44663, 44667-44668, 44671, 44673, 44675, 44677-44679, 44681, 44683-44686, 44688-44689, 44691-44693, 44695, 44698-44699, 44714-44715, 44718, 44720-44724, 44728, 44732, 44736, 44739, 44741-44742, 44744-44748, 44750-44752, 44754, 44756, 44761, 44763-44765, 44767-44769, 44771-44775, 44777-44778, 44782, 44784-44785, 44787-44789, 44792, 44794, 44796-44797, 44799, 44801-44805, 44807-44812, 44815-44818, 44823-44824, 44826, 44829, 44831, 44834-44836, 44838, 44841-44846, 44853, 44855-44858, 44861-44862, 44865-44870, 44872-44873, 44877, 44880-44881, 44886-44887, 44889, 44891, 44893, 44897-44898, 44900-44903, 44906-44910, 44913-44919, 44921-44925, 44927-44928, 44931, 44936-44939, 44941, 44943-44944, 44946, 44948-44951, 44955, 44958, 44961-44965, 44967-44971, 44974-44975, 44977-44985, 44987, 44989, 44991-44992, 44994-45000, 45002-45003, 45014, 45016-45017, 45019, 45021, 45023-45024, 45028-45029, 45031-45033, 45035-45036, 45038-45045, 45049-45055, 45059-45064, 45066, 45068-45069, 45071-45074, 45076, 45079, 45081-45084, 45087-45088, 45091-45093, 45097-45098, 45101-45110, 45113-45116, 45118, 45122-45125, 45127-45131, 45133, 45137-45138, 45140, 45142-45150, 45152-45167, 45175-45176, 45178-45180, 45182-45186, 45189, 45193-45197, 45199, 45202-45207, 45209, 45211-45215, 45219-45221, 45224-45225, 45227-45230, 45235, 45238-45246, 45249-45251, 45255-45260, 45266-45269, 45272-45281, 45284, 45287-45288, 45290-45291, 45293, 45295, 45297-45301, 45303, 45311, 45316-45318, 45320, 45322-45325, 45328-45332, 45334-45338, 45340, 45343-45344, 45347-45349, 45351-45353, 45355, 45359, 45362-45364, 45366-45375, 45377-45383, 45385, 45387-45388, 45390, 45393-45398, 45400-45401, 45403, 45411-45417, 45419-45421, 45423, 45425-45426, 45430-45431, 45435, 45437-45443, 45445, 45447, 45449, 45452, 45454, 45458-45460, 45462-45465, 45468, 45470-45472, 45474-45477, 45479-45480, 45486-45489, 45493-45499, 45501, 45503-45504, 45506-45508, 45510-45511, 45513, 45515-45520, 45524, 45526-45528, 45534, 45536, 45538-45541, 45546-45547, 45549-45552, 45557-45558, 45560-45561, 45564-45565, 45567, 45569, 45571, 45573, 45577, 45579-45580, 45585-45587, 45589-45594, 45596-45597, 45599-45600, 45604-45608, 45610, 45612-45615, 45617, 45621-45626, 45629-45633, 45635, 45637-45640, 45645-45648, 45650-45656, 45659-45660, 45662-45664, 45666-45668, 45671, 45673-45675, 45678, 45680-45681, 45689-45690, 45692-45694, 45699-45706, 45708-45710, 45713-45724, 45726-45727, 45729, 45731-45732, 45734, 45736-45740, 45742-45743, 45745-45746, 45749-45758, 45760-45761, 45765, 45767-45773, 45776-45780, 45782-45790, 45794, 45797-45804, 45806-45807, 45810, 45812-45813, 45815-45819, 45821-45824, 45826, 45828, 45832-45834, 45836, 45838, 45840, 45844-45845, 45856-45857, 45859-45864, 45866, 45870-45888, 45892-45900, 45902, 45905-45912, 45916, 45920-45924, 45926-45927, 45929, 45932, 45935-45936, 45938, 45941-45945, 45948-45949, 45951, 45953, 45958, 45960, 45962-45971, 45973-45980, 45982, 45986-45988, 45990, 45992, 45995, 45998-46000, 46006-46008, 46010-46011, 46013, 46015-46017, 46020-46021, 46023-46024, 46026, 46028, 46031, 46033-46037, 46039-46042, 46044, 46048-46053, 46056-46064, 46066, 46070-46075, 46077-46078, 46080-46088, 46090, 46092-46094, 46096-46098, 46101, 46103-46104, 46106-46109, 46111, 46113-46116, 46118, 46120, 46125-46126, 46128-46134, 46137, 46139-46140, 46142-46143, 46145-46146, 46149-46160, 46165-46166, 46169, 46173-46174, 46181, 46183-46185, 46187-46189, 46193-46199, 46201-46206, 46208-46211, 46213-46220, 46222-46229, 46231, 46233-46234, 46237-46239, 46241-46242, 46245-46251, 46253-46259, 46261-46266, 46270, 46273, 46275-46276, 46278-46286, 46288-46289, 46291-46295, 46300, 46302, 46304-46305, 46307, 46309-46312, 46314, 46319-46322, 46324-46326, 46329, 46331-46337, 46339-46341, 46351, 46355, 46357-46358, 46362-46363, 46365-46370, 46372, 46374, 46376-46377, 46379-46383, 46385, 46390-46394, 46398-46402, 46406, 46408-46410, 46413, 46415-46418, 46420-46421, 46423, 46425, 46427-46429, 46431-46432, 46435, 46439-46443, 46446, 46449-46451, 46453-46456, 46458-46459, 46461, 46463-46468, 46471-46472, 46474-46478, 46480, 46482, 46484, 46486-46489, 46491-46495, 46498, 46500-46502, 46504, 46506-46508, 46510-46516, 46518-46521, 46523, 46527-46538, 46541-46542, 46549, 46551, 46555-46557, 46559, 46562-46564, 46572, 46579-46581, 46583, 46586-46590, 46594-46595, 46598, 46601, 46604-46609, 46611, 46614-46615, 46617-46621, 46624-46625, 46627-46634, 46637-46638, 46640, 46642, 46644-46646, 46649, 46651-46652, 46654-46655, 46657-46660, 46664, 46666, 46670, 46672-46673, 46675-46677, 46680-46683, 46685-46687, 46690, 46693-46695, 46698-46700, 46702, 46704, 46706-46713, 46715, 46719-46722, 46724, 46727-46729, 46731-46740, 46742-46743, 46746, 46749-46756, 46758-46762, 46765-46768, 46770, 46773-46779, 46781-46784, 46786-46787, 46789, 46791-46792, 46794-46795, 46797-46798, 46800, 46802, 46807-46808, 46810-46814, 46816-46819, 46822, 46828, 46830, 46832-46834, 46836, 46838-46845, 46847, 46849-46850, 46853-46854, 46857-46863, 46867, 46871-46874, 46876, 46879-46884, 46887, 46891, 46893-46894, 46896-46901, 46903-46906, 46910, 46913, 46918-46920, 46922-46923, 46927, 46929-46931, 46934, 46939-46940, 46942, 46944-46947, 46949-46952, 46954-46956, 46958-46961, 46967-46969, 46972-46974, 46976-46978, 46980-46981, 46983-46985, 46987, 46989, 46991-46995, 46997, 47000-47007, 47009-47011, 47013, 47015-47016, 47018-47022, 47024, 47029, 47031-47034, 47037-47040, 47042-47054, 47057-47058, 47061-47062, 47064-47065, 47067, 47069, 47071-47079, 47081, 47083, 47085-47091, 47093-47095, 47098-47103, 47105-47109, 47112, 47119-47121, 47123, 47128-47132, 47134, 47136, 47139-47140, 47142, 47144, 47146, 47152-47153, 47156, 47158-47159, 47162, 47164-47165, 47167, 47172-47175, 47177-47179, 47182-47185, 47188-47190, 47193-47200, 47202-47203, 47205, 47211-47219, 47221-47224, 47226, 47230-47232, 47234-47238, 47240-47242, 47246, 47248-47252, 47255-47256, 47259-47264, 47269-47270, 47274-47277, 47280, 47283, 47287, 47290-47291, 47294, 47296-47297, 47299, 47301, 47303, 47306, 47312-47331, 47333-47335, 47338, 47341-47345, 47348-47350, 47352-47353, 47355-47358, 47362, 47364, 47369, 47371, 47373-47374, 47380-47381, 47383-47390, 47393, 47397-47399, 47401, 47403, 47405-47407, 47409-47414, 47418-47425, 47427-47428, 47430-47434, 47436, 47438-47439, 47443, 47446, 47448-47449, 47451, 47453-47457, 47459-47464, 47467, 47469, 47471, 47473-47474, 47478-47483, 47485-47487, 47490-47493, 47495, 47499-47505, 47507, 47510-47512, 47515-47518, 47520-47522, 47524-47529, 47531-47533, 47535, 47537-47538, 47540, 47542-47543, 47545-47552, 47558-47559, 47561, 47563-47564, 47566, 47568, 47570-47578, 47581-47584, 47586-47588, 47590, 47592, 47595-47597, 47604-47609, 47614-47616, 47623-47627, 47630-47632, 47635-47637, 47639, 47646-47649, 47651, 47653-47654, 47656, 47658-47659, 47661, 47663-47664, 47666, 47668, 47670, 47672-47685, 47688, 47691-47698, 47700-47702, 47705-47708, 47710-47711, 47713-47714, 47718-47720, 47723-47725, 47733, 47735, 47738-47741, 47744-47747, 47749-47752, 47755-47756, 47758-47760, 47762-47764, 47766-47768, 47770-47776, 47779, 47783-47786, 47788-47791, 47793-47804, 47806-47807, 47809-47812, 47814-47823, 47827, 47830-47834, 47836-47837, 47839-47842, 47845, 47848, 47850-47851, 47856-47858, 47860, 47862-47867, 47869-47872, 47877-47887, 47889-47892, 47894, 47899-47903, 47905-47906, 47908-47920, 47922, 47924, 47927-47928, 47930, 47932-47935, 47939, 47941-47943, 47946, 47948-47950, 47952, 47954-47958, 47965, 47967, 47969-47970, 47972-47973, 47975-47982, 47984-47986, 47988-47993, 47998, 48002-48017, 48020-48025, 48027-48035, 48037-48039, 48041, 48048, 48054-48055, 48058, 48061, 48063-48069, 48071, 48073, 48075-48078, 48080, 48082-48085, 48088-48089, 48091-48092, 48094-48097, 48100, 48103, 48106-48107, 48110-48115, 48118, 48122-48125, 48129-48134, 48138-48139, 48144-48145, 48147-48152, 48156, 48158, 48160-48164, 48166-48167, 48169-48170, 48173-48174, 48177-48178, 48182, 48186, 48190, 48193-48194, 48196-48198, 48200, 48203-48204, 48207, 48212, 48219, 48221-48222, 48225, 48227, 48230-48231, 48233-48234, 48237, 48239-48240, 48242-48243, 48245, 48249, 48254-48255, 48258-48266, 48272, 48274, 48276-48278, 48280-48282, 48284-48286, 48290-48292, 48295-48298, 48300-48301, 48304, 48306-48307, 48311-48313, 48315, 48317, 48323, 48325, 48328-48331, 48336-48338, 48340, 48342-48345, 48347-48348, 48350, 48352-48353, 48355, 48357, 48360-48362, 48366, 48369, 48372-48378, 48380, 48383, 48387-48388, 48391, 48395-48396, 48398-48399, 48401-48403, 48405-48407, 48411-48412, 48414, 48416-48418, 48420, 48422, 48426-48427, 48429, 48432-48434, 48437-48439, 48442, 48446-48449, 48451, 48454, 48459, 48462, 48464, 48466-48468, 48470-48471, 48473, 48476, 48478, 48480-48482, 48487, 48489, 48491-48492, 48494, 48497, 48499-48506, 48508-48510, 48512, 48516, 48518, 48521, 48525, 48527-48530, 48533-48534, 48536, 48538, 48543-48552, 48554, 48556-48559, 48562-48564, 48566, 48569-48570, 48572, 48575, 48577-48585, 48587, 48591-48594, 48596-48597, 48600-48605, 48607-48611, 48617-48618, 48621, 48624, 48627-48628, 48630-48634, 48636, 48641, 48645, 48647, 48650, 48652-48654, 48656-48657, 48659-48661, 48664, 48668, 48670-48673, 48677, 48681-48684, 48688-48691, 48693-48705, 48707-48708, 48712-48714, 48716-48717, 48720, 48724, 48726, 48731-48734, 48736-48739, 48742-48747, 48750-48755, 48757, 48760-48761, 48763-48766, 48769, 48772, 48774-48775, 48777, 48779, 48781-48785, 48793, 48797-48802, 48804-48806, 48808, 48813, 48826, 48828, 48836-48837, 48840, 48842-48847, 48849-48851, 48853-48855, 48856, 48859, 48863, 48865-48867, 48870-48871, 48874, 48877, 48880, 48884-48885, 48887, 48890-48896, 48904-48905, 48907, 48910-48911, 48915-48916, 48918-48920, 48925, 48939, 48941, 48943-48948, 48950-48952, 48954-48955, 48959-48969, 48971-48974, 48976-48978, 48982-48983, 48989, 48991-48993, 48995-48998, 49000-49001, 49003, 49006, 49009-49019, 49021, 49023-49024, 49026, 49028, 49030, 49035, 49037-49040, 49043-49044, 49047-49050, 49052-49056, 49058-49065, 49067-49069, 49073-49076, 49080, 49083-49090, 49092-49093, 49095-49097, 49102-49104, 49108, 49110-49111, 49113, 49115-49120, 49122-49123, 49127, 49130, 49133, 49136-49138, 49141, 49143-49145, 49148-49156, 49158-49162, 49164-49165, 49168-49173, 49175-49180, 49182, 49186, 49188-49189, 49191-49193, 49197, 49202, 49204, 49207, 49213, 49215-49217, 49219-49220, 49231-49232, 49236-49241, 49243-49244, 49246, 49250-49252, 49255, 49259-49261, 49263, 49266-49272, 49274, 49276, 49279-49281, 49283-49284, 49286-49288, 49291, 49293-49295, 49299, 49304, 49306-49308, 49310-49312, 49314, 49316-49327, 49329, 49332, 49336, 49341, 49343-49345, 49349-49353, 49355, 49359, 49361-49362, 49364-49374, 49376, 49378, 49383-49384, 49386-49388, 49390-49393, 49395-49398, 49400-49401, 49405-49410, 49412-49415, 49417-49422, 49424-49427, 49429-49430, 49432-49433, 49436-49441, 49443-49444, 49447-49448, 49450, 49453, 49458, 49462-49463, 49465-49471, 49473, 49475, 49478-49484, 49486-49487, 49490, 49494-49496, 49499-49500, 49503-49511, 49513-49514, 49518, 49520-49523, 49525-49530, 49532-49533, 49535-49539, 49544-49546, 49549, 49551, 49553-49557, 49559, 49561, 49564, 49567-49570, 49573-49575, 49577, 49587-49588, 49594-49595, 49597-49606, 49610, 49612-49619, 49624-49629, 49631, 49634-49640, 49642, 49644-49653, 49656, 49658-49666, 49668-49669, 49671-49672, 49674-49680, 49682-49683, 49686-49689, 49691-49692, 49694, 49696, 49699, 49701-49702, 49705-49708, 49710, 49712-49717, 49719-49727, 49729-49730, 49733, 49735, 49741, 49745-49747, 49749-49760, 49762-49765, 49767-49768, 49770-49773, 49775, 49791-49793, 49796-49799, 49801-49804, 49806, 49808-49810, 49813-49818, 49820, 49822, 49824-49833, 49835-49840, 49845, 49847-49848, 49850-49859, 49861, 49863-49864, 49869-49870, 49874-49875, 49877-49883, 49885-49886, 49888, 49890, 49892, 49894-49899, 49901-49902, 49904-49905, 49907-49908, 49910-49917, 49919-49922, 49925-49927, 49929-49931, 49934-49939, 49941-49942, 49947-49962, 49964, 49966, 49969-49970, 49972-49976, 49978, 49983-49986, 49990, 49992, 49994, 49997-50002, 50004, 50006, 50009-50010, 50012-50014, 50016, 50020, 50022-50024, 50026, 50028, 50030, 50034, 50037-50039, 50043, 50045-50046, 50048-50049, 50051-50056, 50059-50068, 50070, 50074, 50076, 50078, 50080-50083, 50086, 50088, 50090, 50093-50095, 50097, 50099-50101, 50105, 50107-50108, 50111-50117, 50119-50122, 50124, 50129-50133, 50135, 50137-50142, 50144, 50146-50147, 50150, 50154-50155, 50158, 50160, 50162-50165, 50168-50169, 50171, 50176, 50180-50181, 50185, 50188, 50190-50191, 50196, 50198, 50200, 50202-50203, 50205, 50212, 50214-50216, 50221-50222, 50224, 50228-50229, 50236-50238, 50240, 50242-50249, 50253, 50255-50256, 50258-50260, 50262, 50271-50272, 50274-50275, 50277-50279, 50282, 50284, 50286-50288, 50290, 50294, 50298-50308, 50310-50311, 50314-50317, 50319, 50322, 50324, 50326-50327, 50330-50331, 50335-50337, 50340, 50342, 50344, 50347-50350, 50352-50353, 50356-50359, 50361-50364, 50366, 50369, 50371-50378, 50380, 50382-50383, 50385-50394, 50396-50398, 50400-50403, 50405-50410, 50413, 50415, 50418-50422, 50424, 50426-50429, 50433, 50435-50439, 50441-50444, 50446-50453, 50455-50458, 50460, 50462-50463, 50466-50467, 50469-50470, 50473, 50476-50479, 50481, 50483-50485, 50487-50494, 50496-50498, 50500, 50504-50507, 50511-50514, 50516, 50518-50522, 50524-50525, 50529, 50531, 50534, 50536, 50538-50539, 50541-50543, 50545, 50547-50554, 50557-50559, 50562-50564, 50566, 50568, 50570-50575, 50578-50579, 50582, 50584-50587, 50590, 50593-50601, 50606-50615, 50619-50620, 50623, 50625-50630, 50633, 50635, 50637, 50641, 50643-50644, 50646, 50650, 50652-50654, 50656-50657, 50660-50662, 50664-50669, 50671, 50673, 50676-50681, 50684-50688, 50690-50691, 50693, 50696, 50698-50701, 50703-50704, 50706-50709, 50711-50713, 50715-50717, 50719, 50721-50722, 50725, 50727, 50729, 50731, 50734, 50736-50745, 50747-50748, 50752, 50758, 50760, 50764-50767, 50769-50775, 50777-50782, 50784-50785, 50788-50800, 50803, 50805-50808, 50810, 50813-50814, 50816-50819, 50821-50824, 50828-50833, 50838, 50840-50841, 50843-50844, 50846, 50849-50851, 50853, 50857-50859, 50861-50864, 50866-50869, 50871, 50875, 50877-50878, 50881-50884, 50886-50893, 50895-50896, 50898-50909, 50911-50913, 50918-50923, 50926-50930, 50932-50937, 50940-50949, 50951-50953, 50956, 50958-50964, 50966-50968, 50970-50974, 50979, 50982-50986, 50988-50989, 50992, 50995, 50997-50998, 51002, 51006, 51008, 51010-51013, 51015-51017, 51019-51020, 51022, 51024-51026, 51028-51029, 51032-51033, 51037-51038, 51043, 51045-51047, 51049, 51051-51054, 51056-51063, 51065-51066, 51068-51070, 51072, 51075-51084, 51086-51090, 51093, 51097-51100, 51102, 51104-51106, 51108-51109, 51114, 51118-51119, 51121, 51123-51125, 51127-51128, 51131-51133, 51135-51140, 51142-51144, 51146, 51149-51150, 51152, 51154, 51156-51158, 51160-51163, 51167-51170, 51172-51174, 51177, 51181-51182, 51184-51188, 51193, 51195-51196, 51199-51202, 51205-51209, 51213, 51216, 51218, 51223, 51225-51226, 51229, 51232-51235, 51237-51240, 51253, 51255-51258, 51260, 51262, 51264-51265, 51267, 51270-51271, 51276-51277, 51282, 51284-51285, 51289-51290, 51292-51293, 51298, 51301, 51305-51312, 51314-51317, 51319-51322, 51325-51336, 51339-51346, 51348-51351, 51353, 51356-51357, 51359-51364, 51366-51367, 51369, 51371-51378, 51381, 51383-51387, 51391-51393, 51396-51397, 51400-51402, 51404-51405, 51407, 51411, 51414-51415, 51417-51419, 51423-51427, 51429-51430, 51432, 51435, 51437-51449, 51452, 51461-51463, 51466-51468, 51470-51472, 51474-51475, 51478-51484, 51486, 51490-51491, 51493-51496, 51498-51501, 51503-51506, 51508, 51510-51513, 51515, 51521-51525, 51529, 51534-51541, 51546-51556, 51558-51559, 51561, 51565, 51567, 51570, 51572-51573, 51575-51585, 51587, 51590-51592, 51594-51595, 51597-51598, 51600, 51603-51621, 51624-51629, 51632-51635, 51637, 51639-51648, 51650, 51654-51660, 51662-51665, 51667, 51670-51671, 51675-51678, 51680-51681, 51684-51685, 51687-51693, 51696, 51698-51699, 51701-51704, 51706-51711, 51713, 51715-51716, 51718, 51722, 51724, 51728, 51730-51731, 51736-51737, 51739-51743, 51745, 51749-51750, 51753-51755, 51757-51758, 51760-51761, 51763-51764, 51767, 51775-51780, 51782-51783, 51785, 51787-51788, 51790-51793, 51796, 51798, 51802-51804, 51806-51811, 51813-51815, 51820, 51822-51837, 51839-51841, 51843, 51845, 51852-51855, 51862-51867, 51869, 51873, 51877-51878, 51883-51887, 51893-51896, 51898-51900, 51907, 51912, 51915, 51917-51918, 51926-51927, 51929, 51931-51935, 51937-51939, 51942, 51946-51951, 51953-51954, 51956, 51958-51959, 51963-51964, 51967-51970, 51974, 51978, 51981, 51983, 51985-51986, 51989, 51992, 51998, 52001, 52003, 52005-52008, 52011-52012, 52014, 52017, 52019-52026, 52028-52032, 52034, 52036-52037, 52039-52044, 52046-52053, 52055-52059, 52062, 52064, 52067-

52070, 52072, 52075-52076, 52078-52080, 52083-52087,
52089, 52091, 52094-52097, 52102-52103, 52105-52106,
52108, 52110-52113, 52117, 52122-52126, 52130-52131,
52133-52141, 52143, 52145-52148, 52150-52159, 52162-
52166, 52171-52176, 52178-52179, 52182, 52184-52186,
52188, 52191-52192, 52194, 52197-52200, 52202-52213,
52215-52216, 52218, 52220, 52222, 52224, 52226-52229,
52231, 52233-52234, 52237-52241, 52243-52245, 52247,
52249-52250, 52252-52253, 52255-52261, 52264-52267,
52270-52271, 52275-52276, 52280, 52282-52283, 52285-
52289, 52291-52293, 52298-52314, 52316-52318, 52320-
52322, 52324, 52328, 52331-52332, 52335-52342, 52344-
52348, 52351, 52353, 52355, 52357, 52360, 52362-52365,
52367-52374, 52377, 52379-52382, 52384, 52386-52387,
52389-52392, 52394-52401, 52405, 52407, 52411, 52413-
52414, 52416-52421, 52423-52428, 52430, 52432-52436,
52438, 52440, 52443-52444, 52446-52447, 52449-52450,
52452-52453, 52455-52456, 52458-52466, 52468-52471,
52473-52481, 52483, 52485-52486, 52488-52490, 52492,
52494, 52496-52497, 52499-52504, 52506-52515, 52517,
52521-52522, 52524-52525, 52528, 52530-52531, 52533,
52537-52540, 52542, 52544-52550, 52552-52554, 52558-
52563, 52566, 52570, 52572-52574, 52576-52580, 52583-
52586, 52588-52590, 52593, 52595-52596, 52598-52605,
52607-52610, 52612-52614, 52616-52621, 52627-52635,
52637, 52645-52647, 52649-52652, 52654-52655, 52658,
52660, 52662, 52664-52667, 52676-52678, 52680-52682,
52685-52692, 52694, 52697-52699, 52702, 52705, 52708,
52712, 52716, 52720-52722, 52727-52732, 52734, 52736-
52742, 52745, 52749-52756, 52758, 52761-52764, 52766-
52772, 52774-52783, 52785, 52787-52788, 52790-52791,
52801-52802, 52805, 52807, 52809-52816, 52818-52822,
52825, 52827-52828, 52830-52834, 52838-52839, 52841,
52843-52845, 52847, 52850-52859, 52861-52862, 52864-
52867, 52872, 52874-52875, 52877-52878, 52880-52883,
52885, 52887-52888, 52890-52892, 52895-52897, 52899,
52901-52905, 52908-52911, 52913-52915, 52919-52924,
52926, 52931-52940, 52943-52944, 52946-52950, 52952-
52955, 52957, 52959-52962, 52964-52967, 52971-52975,
52977-52978, 52980, 52982-52983, 52985-52987, 52989,
52991-52995, 52997, 53002-53003, 53005-53006, 53008-
53009, 53016-53018, 53021-53023, 53025-53027, 53029-
53030, 53032, 53036-53041, 53043, 53049, 53052-53054,
53059-53060, 53063-53065, 53067, 53069, 53071-53074,
53076-53079, 53083-53085, 53087-53090, 53092-53099,
53103, 53105-53107, 53113-53121, 53123, 53128-53130,
53136-53137, 53139, 53143, 53150-53157, 53160-53161,
53163-53164, 53167, 53169, 53172, 53174-53176, 53181-
53183, 53185-53186, 53194-53199, 53201-53202, 53205-
53206, 53209, 53219-53220, 53223, 53225-53226, 53228-
53231, 53235, 53237-53239, 53242, 53247-53249, 53255,
53258-53259, 53261-53262, 53264-53265, 53268-53270,
53272, 53274-53277, 53279, 53281, 53283, 53287-53288,
53290, 53292, 53294-53296, 53298, 53300, 53302-53304,
53306, 53308-53316, 53318-53319, 53321, 53323, 53326-
53330, 53338-53339, 53341-53342, 53349, 53351, 53353,
53355-53356, 53359, 53362-53364, 53366-53369, 53371,
53373-53376, 53378-53390, 53393, 53396-53398, 53400,
53402-53404, 53406-53409, 53411-53412, 53414-53415,
53417, 53419-53420, 53422, 53426-53430, 53432-53433,
53435-53441, 53443-53447, 53450, 53452-53458, 53461-
53462, 53464-53467, 53469-53474, 53476, 53479, 53481-
53494, 53496, 53498, 53504, 53507-53508, 53510, 53512,
53514-53516, 53520, 53522-53523, 53525-53532, 53535-
53536, 53538, 53540, 53542-53545, 53550, 53552, 53555-
53560, 53562, 53565, 53571-53573, 53575, 53577-53578,
53580-53581, 53583-53589, 53595-53597, 53599-53601,
53603-53604, 53606-53607, 53609-53615, 53617, 53619-
53621, 53627-53629, 53632, 53635, 53637-53638, 53640-
53642, 53644-53648, 53650-53656, 53659, 53665-53666,
53669-53677, 53679, 53681, 53685, 53687-53689, 53691,
53693, 53699, 53701-53705, 53707, 53709-53716, 53719-
53721, 53724, 53728, 53730-53735, 53738, 53741, 53744,
53746, 53748-53751, 53755-53758, 53760, 53762-53763,
53765, 53768-53774, 53779, 53783, 53786-53793, 53795,
53798, 53800-53805, 53807, 53809, 53813-53816, 53818-
53821, 53823, 53825, 53827-53841, 53845, 53848-53850,
53852-53853, 53855-53860, 53863-53864, 53866, 53868,
53872, 53874, 53876-53878, 53880, 53883-53895, 53897-
53898, 53901-53906, 53909, 53912-53915, 53919-53924,
53926-53929, 53931-53932, 53938-53939, 53941, 53947-
53949, 53951, 53953-53957, 53959, 53963, 53966, 53969-
53970, 53973-53975, 53977, 53979, 53982, 53984-53985,
53988, 53991-53993, 53995-53996, 53999-54004, 54008-
54009, 54014-54015, 54018-54019, 54021-54022, 54027-
54028, 54030, 54032-54033, 54035, 54037-54038, 54041,
54047, 54049, 54051-54055, 54057, 54060-54061, 54064-
54065, 54067-54068, 54071, 54073-54079, 54084-54086,
54088-54090, 54094-54098, 54100-54101, 54103-54107,
54110-54112, 54114, 54117, 54119-54121, 54125, 54127-
54129, 54134-54136, 54138-54142, 54144, 54146, 54148-
54151, 54154-54158, 54161-54181, 54183-54185, 54190,
54192-54195, 54197, 54199-54204, 54208-54212, 54214,
54219, 54221-54230, 54234-54239, 54241-54242, 54245-
54246, 54248-54256, 54258-54261, 54263, 54265, 54267-
54268, 54270-54275, 54277, 54279, 54282, 54286-54291,
54293, 54296-54303, 54305-54306, 54308, 54310-54312,
54315, 54317, 54324-54325, 54328-54334, 54338-54339,
54341, 54343, 54347-54348, 54350, 54354-54355, 54357-
54358, 54361-54364, 54366-54370, 54372-54378, 54383,
54385-54386, 54388, 54390-54391, 54393, 54395, 54398,
54400-54411, 54413-54419, 54421-54422, 54424-54425,
54427-54428, 54430-54432, 54436, 54439-54442, 54445-
54454, 54456-54458, 54461-54466, 54468, 54472-54478,
54482-54490, 54492, 54497, 54500, 54504, 54506-54508,
54511-54513, 54515, 54517, 54519-54521, 54523-54524,
54529-54534, 54536, 54539, 54541-54542, 54546-54547,
54550-54553, 54555-54556, 54558-54562, 54565-54567,
54569-54570, 54574, 54578-54583, 54586, 54588, 54593,
54601, 54603-54604, 54606-54607, 54609-54610, 54612,
54614-54618, 54620, 54622-54623, 54625-54628, 54631,
54637-54643, 54645, 54647-54648, 54650-54651, 54654-
54658, 54661, 54669, 54673-54675, 54680-54684, 54686,
54691-54694, 54699, 54702, 54705-54706, 54708-54712,
54714-54717, 54719-54723, 54725, 54727-54730, 54732-
54734, 54736-54740, 54743-54744, 54747, 54749-54751,
54753, 54755-54760, 54762-54766, 54768-54776, 54779,
54781-54783, 54785-54789, 54791-54796, 54798, 54801-
54804, 54806-54814, 54816, 54819, 54822-54823, 54826-
54828, 54830-54831, 54834, 54837-54843, 54847-54849,
54852-54853, 54855-54857, 54859-54861, 54863-54869,
54871-54872, 54874-54884, 54886-54887, 54889-54890,
54894-54895, 54899, 54902, 54904-54906, 54909, 54911-
54912, 54914, 54916, 54918-54924, 54926-54927, 54931-
54938, 54941-54945, 54948-54953, 54955, 54958, 54960-
54965, 54968, 54970-54973, 54975-54976, 54979-54980,
54985-54986, 54988-54989, 54992, 54997-54999, 55001,
55003-55005, 55007-55008, 55010, 55012-55017, 55019-
55020, 55022, 55025-55026, 55032-55033, 55035-55036,
55040-55043, 55045, 55048-55050, 55052-55056, 55059-
55074, 55076, 55079-55080, 55083-55086, 55088-55090,
55093, 55095-55098, 55102, 55104-55108, 55110-55112,
55114-55121, 55123-55124, 55126-55127, 55129-55130,
55133, 55137-55139, 55142, 55145-55149, 55151-55156, 55161, 55163-55166, 55168-55169, 55173, 55178, 55180, 55182-55186, 55188, 55190, 55193-55194, 55196, 55199, 55203-55207, 55210, 55212, 55214, 55216-55217, 55219-55220, 55222-55224, 55227, 55233-55234, 55237-55240, 55242-55243, 55245-55246, 55248, 55250, 55252, 55254-55255, 55257, 55260, 55262-55264, 55266, 55270-55273, 55281-55282, 55284-55289, 55294, 55296, 55298, 55300-55303, 55305-55308, 55313, 55315-55317, 55320-55323, 55325, 55329, 55334, 55336-55337, 55339-55342, 55344-55346, 55350-55355, 55357, 55360, 55362-55363, 55367-55369, 55372-55374, 55376, 55378-55381, 55383-55385, 55387-55393, 55395, 55397, 55399, 55401-55408, 55414, 55417, 55419, 55421, 55425-55426, 55428, 55430, 55435-55437, 55439-55440, 55442-55445, 55447, 55449-55450, 55453-55454, 55457-55459, 55461, 55463, 55465, 55468-55469, 55471, 55476-55477, 55479, 55481, 55483, 55485-55487, 55489-55491, 55493, 55495, 55497-55503, 55505-55513, 55518-55519, 55521-55522, 55527-55528, 55530, 55535-55537, 55539, 55542-55549, 55556-55560, 55562-55563, 55565-55567, 55570-55571, 55574-55578, 55581, 55583-55590, 55592-55596, 55599-55601, 55603, 55606, 55610, 55613-55616, 55618-55625, 55631-55634, 55636, 55638-55639, 55642, 55645-55646, 55649-55650, 55652-55654, 55656-55657, 55661-55663, 55665, 55667-55675, 55682, 55685, 55688-55691, 55694-55696, 55703-55705, 55707-55712, 55715, 55730-55732, 55734-55735, 55744-55745, 55747-55748, 55750-55755, 55759, 55761, 55766-55768, 55771-55773, 55775-55776, 55780-55781, 55783-55784, 55786, 55793-55798, 55800, 55802, 55804-55805, 55807-55815, 55818-55821, 55823, 55831-55838, 55840-55844, 55847-55849, 55851, 55853-55855, 55857-55861, 55865-55868, 55871, 55873, 55876, 55879-55880, 55882-55883, 55885, 55891, 55893-55894, 55897, 55899, 55901-55902, 55904-55906, 55908-55909, 55912, 55914, 55917, 55919-55922, 55924, 55927-55928, 55932, 55934, 55943, 55945, 55948, 55950, 55953, 55956-55957, 55959, 55961-55964, 55966, 55971, 55973, 55975, 55980, 55982-55986, 55990, 55992, 55994, 55996, 55998, 56004, 56007, 56009-56011, 56014, 56019, 56022, 56025-56026, 56029-56030, 56032, 56034-56035, 56040, 56042-56043, 56045, 56047-56050, 56052, 56055, 56059-56065, 56069, 56071-56075, 56080-56084, 56089, 56091-56092, 56095-56097, 56101, 56103-56104, 56108-56109, 56113, 56115-56117, 56119-56120, 56124-56126, 56128-56129, 56131, 56134-56140, 56142-56147, 56149, 56151, 56158, 56161-56162, 56164, 56167-56170, 56172-56177, 56179, 56181-56185, 56189-56190, 56195, 56197, 56199, 56203-56204, 56206, 56210, 56212, 56217-56222, 56224, 56226-56227, 56229-56230, 56233-56238, 56240-56245, 56247-56250, 56252-56253, 56255, 56257-56259, 56261-56262, 56265-56268, 56272, 56274-56275, 56277-56280, 56283-56288, 56290-56295, 56297, 56300, 56303-56304, 56306-56310, 56314, 56318-56320, 56323, 56325-56336, 56339-56341, 56343-56344, 56346, 56348-56349, 56353, 56357-56359, 56361, 56363, 56366, 56368-56370, 56372-56376, 56378-56380, 56383, 56385-56386, 56388-56396, 56400, 56403, 56405-56406, 56410-56411, 56414, 56416-56417, 56419-56423, 56425, 56427-56436, 56438, 56440-56442, 56445-56446, 56449-56450, 56452, 56458, 56462-56466, 56469-56472, 56475, 56477, 56479-56480, 56482, 56484-56487, 56492, 56495-56496, 56499-56500, 56502-56503, 56509, 56511-56512, 56515, 56517, 56519-56527, 56532, 56534-56536, 56544-56545, 56549, 56552-56553, 56555-56559, 56563-56577, 56579, 56581, 56583-56586, 56588-56590, 56596, 56599-56601, 56604, 56607, 56610-56613, 56615, 56619, 56621-56623, 56625, 56627-56633, 56638-56640, 56642-56643, 56645-56647, 56650-56661, 56663-56673, 56675-56678, 56681-56686, 56688-56689, 56692-56694, 56696, 56698-56700, 56702-56705, 56707-56715, 56717, 56720-56722, 56725, 56727, 56729-56730, 56734, 56736-56738, 56741-56743, 56745, 56747, 56750, 56753, 56755-56765, 56769, 56776, 56778-56779, 56781, 56785, 56787-56788, 56791-56802, 56804-56807, 56813-56815, 56817, 56821, 56823, 56828-56829, 56832, 56834-56836, 56838-56840, 56842-56843, 56845, 56847, 56851-56852, 56855-56863, 56865-56871, 56873-56874, 56876, 56878, 56880, 56882-56888, 56890-56891, 56893, 56897, 56903, 56906, 56911-56915, 56920-56928, 56934-56935, 56937-56941, 56943-56945, 56947-56949, 56952, 56954, 56958, 56961-56962, 56965, 56967-56969, 56971-56974, 56976-56977, 56979-56981, 56988, 56990, 56996-57002, 57008, 57010-57011, 57013-57014, 57016, 57018-57021, 57023, 57025-57028, 57030-57032, 57035, 57038-57040, 57042-57043, 57046, 57048-57049, 57051-57052, 57054-57057, 57059-57061, 57066, 57070, 57072-57074, 57077-57078, 57080, 57082-57085, 57087, 57089-57090, 57093, 57097-57102, 57104, 57106-57117, 57119, 57121-57125, 57127-57128, 57136-57137, 57139, 57141, 57143-57144, 57146-57147, 57150-57160, 57162-57163, 57166, 57168-57170, 57173-57175, 57178-57180, 57184-57185, 57187-57188, 57192, 57194-57200, 57208-57212, 57214, 57216, 57221-57230, 57233-57236, 57239-57241, 57243-57244, 57246-57250, 57252-57255, 57257-57258, 57260, 57265-57267, 57269-57272, 57274-57276, 57279, 57281, 57283-57285, 57293, 57295, 57297-57300, 57302, 57305, 57307, 57313, 57315, 57317-57321, 57327, 57329, 57331, 57333, 57336-57337, 57340-57341, 57345, 57347, 57350-57354, 57358-57360, 57362-57363, 57366-57367, 57374-57377, 57379-57380, 57386, 57390-57393, 57395, 57397-57400, 57402, 57406-57407, 57409-57411, 57414, 57418-57420, 57423-57425, 57427, 57430, 57432-57435, 57438-57439, 57441-57454, 57456, 57459, 57462, 57465-57468, 57471, 57474, 57482-57483, 57489, 57491, 57494-57495, 57497, 57499-57500, 57502, 57504, 57506-57507, 57515, 57520-57522, 57524, 57526-57532, 57537, 57539, 57542-57548, 57550, 57552-57553, 57557, 57559-57560, 57563-57568, 57571-57577, 57579, 57583, 57585-57586, 57588-57591, 57593, 57595, 57597-57598, 57600, 57602, 57604, 57607-57621, 57626, 57629-57631, 57633-57635, 57637-57640, 57642, 57648-57650, 57652, 57654-57656, 57660-57662, 57665, 57667-57670, 57672, 57676, 57678-57679, 57682-57683, 57689-57693, 57697-57698, 57701-57705, 57707-57708, 57710, 57713-57714, 57717-57723, 57725, 57727-57729, 57734-57737, 57739, 57741, 57743-57745, 57748-57752, 57755-57756, 57760, 57762-57766, 57769-57770, 57774-57777, 57779-57782, 57784, 57787, 57789-57799, 57801-57803, 57805-57807, 57809-57810, 57813-57814, 57819, 57821, 57823-57826, 57828-57830, 57832, 57834, 57839, 57841-57853, 57855-57857, 57860-57866, 57868-57873, 57876-57877, 57879-57881, 57883, 57885, 57887-57889, 57894, 57897, 57899, 57902, 57905-57909, 57911-57914, 57921-57924, 57931-57934, 57936-57938, 57942, 57944-57950, 57952-57955, 57957-57960, 57964-57965, 57971, 57975, 57978-57992, 57994, 57997-58005, 58008, 58010-58015, 58018-58021, 58023-58024, 58029-58030, 58033-58034, 58037-58038, 58040-58043, 58045-58046, 58048-58056, 58058-58059, 58061, 58063-58070, 58072-58076, 58078, 58080, 58085, 58087-58092, 58095-58099, 58103, 58107, 58110-58113, 58115, 58117-58124, 58129, 58132-58134, 58136-58139, 58143-58151, 58153, 58157-58158, 58160-58164, 58166, 58169, 58171-58176, 58178, 58181, 58184-58191, 58194-58195, 58197, 58199-58201, 58203-58211, 58213, 58218-58221, 58223, 58226, 58228, 58230, 58233-58236, 58238-58241, 58243-58247, 58250-58251, 58254, 58256-58258, 58262-58267, 58269-58278, 58280-58283, 58285, 58288-58292, 58294, 58299, 58301-58303, 58305-58306, 58308-58309, 58311, 58313, 58317-58318, 58320-58322, 58324-58325, 58329-58331, 58333, 58336-58337, 58339-58341, 58343-58345, 58347-58349, 58351-58353, 58355-58356, 58359-58365, 58368-58370, 58373-58375, 58378, 58380, 58382, 58384, 58388-58394, 58396-58397, 58399-58410, 58414, 58416-58419, 58421, 58423, 58425, 58427-58430, 58433-58438, 58440-58446, 58448, 58450, 58452-58462, 58465-58466, 58472-58477, 58479-58480, 58482-58483, 58487-58488, 58490-58491, 58493, 58495, 58497-58498, 58503-58504, 58506-58515, 58519-58525, 58527, 58530, 58532, 58534-58541, 58543-58544, 58546-58559, 58561-58574, 58576-58578, 58580-58582, 58584-58586, 58588-58590, 58592-58593, 58596-58598, 58600, 58602, 58604-58606, 58608, 58611, 58616, 58618-58619, 58621-58622, 58624-58636, 58638, 58640, 58642-58644, 58646-58652, 58654-58655, 58657-58658, 58663-58664, 58666, 58668-58672, 58676, 58678, 58680-58681, 58683-58684, 58686, 58688-58693, 58695-58701, 58708, 58710-58713, 58715-58728, 58730-58731, 58735, 58739-58744, 58747, 58749-58757, 58759-58762, 58764, 58766, 58768-58769, 58773, 58778, 58781-58783, 58786, 58791, 58794-58798, 58800, 58803-58807, 58809-58813, 58815-58816, 58818, 58820-58828, 58830, 58835-58838, 58840-58845, 58847-58849, 58851-58853, 58855, 58857-58863, 58865-58873, 58877, 58880-58881, 58883, 58885-58888, 58890, 58894, 58896-58900, 58902, 58904, 58908-58909, 58913-58914, 58916, 58918, 58920-58921, 58923, 58925-58928, 58930-58935, 58937-58939, 58942-58944, 58946-58947, 58949, 58952-58958, 58961-58964, 58968, 58970, 58973-58975, 58977-58980, 58982-58994, 58998-59001, 59003-59029, 59032-59033, 59035, 59037-59046, 59048-59050, 59053-59054, 59058-59060, 59063, 59066-59071, 59073, 59075-59077, 59079, 59081, 59083-59089, 59091-59094, 59096-59100, 59103, 59105-59107, 59110, 59113-59127, 59130-59136, 59138-59143, 59145-59146, 59152, 59154, 59156, 59159-59169, 59172, 59175-59176, 59180, 59183-59186, 59189, 59191-59193, 59195-59198, 59203-59205, 59207-59208, 59210-59220, 59222, 59224-59225, 59228-59229, 59231-59233, 59235-59236, 59238-59239, 59241-59242, 59245-59247, 59251, 59253-59255, 59261-59263, 59266-59267, 59269-59270, 59272-59273, 59279, 59281-59282, 59290, 59294, 59296-59299, 59304-59305, 59308, 59310, 59312, 59314, 59320, 59324, 59328-59329, 59332-59334, 59336-59337, 59339-59346, 59351-59353, 59355-59356, 59359-59362, 59364-59368, 59373, 59378-59382, 59384-59385, 59387-59395, 59397, 59400, 59404, 59406-59409, 59411, 59413-59414, 59417, 59421-59423, 59425-59427, 59429, 59433-59435, 59442-59443, 59445, 59450-59453, 59455-59456, 59458-59460, 59463-59464, 59466, 59469-59473, 59477, 59483, 59486-59489, 59491-59493, 59496, 59498, 59500-59501, 59503, 59505-59512, 59514-59518, 59520-59524, 59527, 59532-59533, 59535, 59537, 59539, 59541, 59543-59545, 59548-59551, 59554-59555, 59562, 59565-59579, 59581, 59583-59584, 59586, 59590, 59592-59595, 59600, 59602-59604, 59608-59609, 59611-59613, 59617-59618, 59620-59621, 59623-59624, 59626, 59630, 59633-59641, 59644-59645, 59647-59650, 59652-59653, 59657-59658, 59662-59663, 59665-59666, 59669-59671, 59673, 59675-59680, 59682-59685, 59687-59688, 59691-59692, 59694-59697, 59699-59700, 59702, 59707, 59710, 59712, 59714-59721, 59724-59739

The foregoing written specification is considered to be sufficient to enable one skilled in the art to practice the invention. The present invention is not to be limited in scope by examples provided, since the examples are intended as a single illustration of one aspect of the invention and other functionally equivalent embodiments are within the scope of the invention. Various modifications of the invention in addition to those shown and described herein will become apparent to those skilled in the art from the foregoing description and fall within the scope of the appended claims. The advantages and objects of the invention are not necessarily encompassed by each embodiment of the invention.

SEQUENCE LISTING (59739 sequences)

SEQ ID NO: 1 - DNA, 93866 bp, Homo sapiens
gatttcaccatgttgaccaggctggtctcaaactgcactttacctcaggtgatccgcccgcctcagtctcccaaagtgctgggattacaggtataatccaccgcaccctgcctccttccttcctttttatctgcaccagcctattttttttctagaacccttttatgtaccaatgaaatcaagccttgctggaatggtcggttgtctacccctagttttatactgggaggctactaagaagaacggttgggggaggacaggaaggtgaaggcgctttctggaaaagacccatcctaatgatacatgtgctatgactgcagccccctctctcccctcaggtcagagaatcctcttagaggctgttctgtggtctcagaatgctccctgcccccaagttgccatgtcagatgtttgagggaaatctgatttctgaggacagagctctaggtgtgggttgttttattttggggatggggtgggggtaggagttggccatgggtttgctgcattccaggaagagggaggactgctctcctccgatgagtcatggaagagaaacgtctaatgtttgcaaacgtctccagccaagcctctgctttcttagactcctcccatcccccatccatgcagattggacccccgtgagaagatttaaatgttaaggttgaaggccaaagaggccatggctctactggttgagatgggaagcagctaacagaacgggaacgattgtccagtacctctagactccagcttgcaagacacgggacaggaccttataataggtgtatctgtctcccaaatcaggacatactctgggtggtgcaggaggatcaggtgaaagaactggattttcacaggggccctgccatctgcagagggcctccaatcaacacggcatctgcagagggctgggagatcagagaagccacagttggagaagaagcagaggcgattgcagaaaaggccagggcatagggagtcaggggaggtcttgcaaatgacagaagctgtgatctgtttctttcaggggaagatgaaggataagcgggcttgagagggatggagctagtgggggtgtgctgggagcccacggctgcctcagcctcagccttagccagactgctggagccagatggggttcatgatgcatcttcccagatggaacggatcaggcatgtcagacaagcttctcttaggatacatggtgtcctcctccctccccctatttgaaatcaggagagaatcacaaggtaacttgggagggctgccaacctcctgggatcttttgtgaactatcaggtaactacagcaggatcacaatgggagacctaaacatgcctccaccaacacccccccccctttttttttctattgtgggacatcaagggagcaagctggtcagcttgggaacaaagatcctattctaggaatttgtccacagcaaccctatctgctgtgtgcactgtccttggatttctgccagactgaaacccaacctgcttggggctgctaccactactgtgagagcaacaccctggcacccggcagggaagggagaatcagagaactcatcctataaaattaaaattgcatttaatcactcttctttcttctaccaggctcaggaggccaggccatctctgcattttaagtatttcaccatttaaagtctaagcaccttggggggtgaggaaggagggcaatggaggagaacttttgaaatctttccacaaaaatcaaagaacaaaccaactagagggaaaaatagctgctatatttaaactacattatcccatcagggagctatggttttgagaaccattccacagtactttgtttggcactgctatatgggtttcttttctttcttttttttaagatggcaagatttttttttttcttcagagcagtaattgcaaaggaagcaaaggtcttcactaattaatttggtagatattcactgagcatctgctatgtgcctggcactacactggtcgctgggggcacaaaatagataaggaaggactcaaggtcctcattgcaaataattatcatgcatttattcaagaagttttgattgcatgccttctaagtgcatatgattctattacaggaaagggtcccaatccagaccccaaaagagtaatagaattcaggtcgagtccacagagtaaagtgaaagcaactttattaggaaagtaaaggaataaaagaatggctgctccatagacagagcagccctgagggctgctgattgcccatttttatggttatttcttgatgatatgctaaacaaggggtggattattcatgcctctcctttttagaccatatggggtaacttcctgacgtcatggcatttgtaaactgtcgtggcgctggtgggagtatagcagcgaggacgaccagaggtcactctcatcgccatcctagatttggtgggttttggccacttctttactgcaacctgttttatcagcaaggtctttatgacctgtagcttgtgccaatctcctatctcatcctgtgacctagaatgtcttagccatctgggaatgcagcccagtaggtctcagcctcattttacccagctcctattcaagatggagttgctctggttcacatgcctctgacaatttccattctcctggagtttatagtctggtggaagaggacagacaataaacaagtgacttagggtgattaagtgccatgaaggaaggagtattactcatatgtgcatttgcccatttgctattccttctgcccaagatgctgctcttcttggctctaaattttcaaaggactctgtattattcctggccctccttctgtcactctcaaatgcgagtccatgacccagtcaagtggagatgtcagatcagcagctgagtatatgcatctggacatacaaatgtgtagtcaacaatatgtaggtgggccggcacggtggctcacgcttgtaatcacagcactttgggaggccgaggcaggtggatcatttgaggtcatgcgttcaagaccagcctggccaacacagtgaaatcccgtctctaccaaaaaatacaaaatttagtcaggcgtggtggagcatgcctgtaatcccagctacttgtgaggctgaggcaggagaatagcttgaacacaggaggtgaggttgcagtgagccgagatcgcgccactgcactccagcctgggtgacagagtgagaccctgtctcaaacaaaaaaacaaacaaacaaacccattatgtaggtggagtttaaagcagtgggactaaggaaagattacagataggaagactgccgggtcctaagccctgggacactccaggtttaaagttaagtagaagagtctggacacagtggctcacatctataatcccagcactttgggaggccgaggtgggaagatcgcttaagcccaggaggagttcaagaccagtctgggcaacatggcaagaccccccatctctacaaaaaataaaacaatttagcagggtatggtggcacatgcctgtagtcccagctactcgggaggctgaggtgggaggatcgcttgatcctgagaggttgagattgcagtgagccatgatggtgccactgtactctagggcaaaagagcgagaccccgtctcaaaaagaaaaagaataaagttaagtagaagagggggaggcacagaaaaggaggttgaaaacgaccaaccagagaaggggaaggaaaacccaggttactatactcgagtgatataaagtgctgtttgaggccaggcacaggtggctcagacctgtaatcccagcactttgggaggctgaggtgggcgaatcacttgaggtcagaagttcaagaccagcctggccaacatggtgaaaccccgtctctactaaaaatacaaaaactagccaggcatgttagtgcacacctgtaatcccagctactcaggaggctgaggcgggagaatcacttgaacttgggaggtggaggttgcagtgagccgagatcgtgccactacactccagcctgggtgacagagtgagaccttgtctaaaacaaacaaagtgcaatttgagacttctggggcgctgatgatggaagtgttggagaaggctgctatcatgcaagacttccaagatgagatggaatttgagccttcatcttgaagggtgatagaggttcaccaggcagatccaagcagaaggaacagcctgaggagaggtcccaaggaagggataatgagtcattgtgtcaggagcttggaattggaggagacgtcttggtggatgtgtagcagacgacactgcaaactacagtggaagaatgtagggcatctccaaacagggttttcagtattgtgtgctagttgcatctttttttttttttttttgaggcagtgtctcgctctgtcacccaggctggagtgcagtggtgtaatctcggctcactgcaacctctgcctcccgggttcaagcaattctcctcactcagccatccgagcagctgtgattataggcgcacgccaccacgctcaactaatttttgtatttttagtagagatggggttttgctatgttgaccaagctggttttcaactcctggcctcaaatgatctgcccacctcagcctcccaaagtgctgggattataggagtgagccaccacacccagccctgtggtagttacctctgcttcctccagaccagtgagatctttgactttcctcagtgaagtgaacatttgttgtttggcagatctaacatttgcagctcttctgataacagcagcaggattttcctttgaggctttgttttccagcatgtgtgtcctgaactagcagcatcaacatcaccggggaactcagaaatgcaaattcttgggtccaccccagacctactgaattgagcattctggaggtaggccccagcaaaaggtgttttcagaagccctccaggtgatgctgaggcatgcgtgtgaaaaccaccactgtagggaactacttctttccctctcagttcgtgcagttcagatggcactgaccatagtctttgcttccaggggtgtgcacaaatcccagagaaaatcttaggcctttctctccagcttagtgctccaaaagcactaaactggagaattagaaactggagatgctggaaccatgtctgccaccacctggagagagactgcctgagagtaaaaagcaaaggaaaagctgggcgcggtggctcacacctgtaatcccagcactttgggaggctgaggtgggcgagtcacctgaggtcaggagttcatcaccagcctggccaacatggtgaaaccccgtctctactaaaaatacaaaaattagctgggcatggtgatgcatacctataatcccagctgctcaggaggctgaggcaggagaatcgcttgaacccaggaggtggaggttgcataagccgagatcgcgccactgcactccaacctgggcgacagagcaagactctgtctcaaaacaaaacaaaacaaaaaaaacaacaaaacaaaacaaaacaaaaaccaaaaggaggccaggcgcagtggctcatgcctgtaatcccagcacttttggaggccgaggtgggtggatcacttgaagtcaggagttcaagaccagcgtggctaacatggtgaaaccccatttctactaaaaataaaaaaaattagctgggtgtagtggtgcacacctgtaatcccagctacttggaatgctgaggcaggagagtcacttgaaccccggaggcggaggttgcagtgagctgagatcgtgccattgcactccagcttgggcaacaagagggaaactcaaaataaataaataaataaaaaaggaaagaggcagagctaagaggtggagagagattctcagtgactttgagcacctggatcaagctgttctaaatttggagtctattccctataagtcccttttttataagcataaaatagtgagttggatttttaaccctcggccgtctaaagaatgcttataatcgtgcggtgtacagggaaggcagattctggaaaagacattgtgttaagtttgacaaattctcagatattgaagttatagttcatgggcatgtagaaaaagtggtggtcactaggtgctggtgtgtgttcagtaacacaagccatgccaaagtggatgcatttctgtgaaaagagcactagagtgtggatttggagcctgttacggacaatgtctctgaatcttcctctttttttttgagatggagtctcgccctgtcacctaggctggagtgcagtggtgcgatctcggctcactgcaacctctgcctcccggattcaagcgattctcctgccccagcctccccagtagctgggattataggcgcgcgccatcatgcctggctaatttttgtatttttagtagagacggggtttcaccatgttggtcaggctggtctcgaactcttgacctcatgctctgcctgccttggcctcccacagtgctgggattacaggcgtgaaccactgcgcccagccattttttttttttttgagacgtagtctcactctgtcgcccaggttggggtgcagtgtcacaatcttggctcactgcaacctccacctcctgggttcaagccattctccctgcctctgcctcttgagtagctgggattacaggcacctgccaccatgcctgcctaatttttgtatttttagtagagatggggtttcaccatgttggccaggctggttttgaactcctgacctcaggtgatccacccgccgtggcctcccaatgtgctgggattacaggcataagccaccacgcctggccagtcctctcattaacttcttatggacaaagtagagaaaggcgggtggtagactaatgtctgcctaatcatcttaagtgactttatatgacaacttaaataatgcaggcaattctcatcattctactcaacaagtatgtgccccagaataagagatgacagatgtgacttggttgaacggccttagttctcattggtgtctcagtgaaagcatctgactgtgccagttctgattttggtacataaatggatgttttcatataacatgacccttagatcaagctgactacatcaggcactcaaccaaaagaaaaatgatctgtttcaacactgtgtaataaagtattatagaagataaggaggcagggagtgccttataagattttcactttactgattttggacactgtagtcaagttgatttttataatagttgaacaattaaatacatttgattggttattttcaatctggaatgagtgtctagaagttctactggatagagacatagaagtcatgcttatcaaatttgtatgtaacctgaagctgggacatatagctaaagtatttgaaaatgaagatctcaaaagactagaacagaccctaaacatgggtctagagcatgagaacattcaagtatacacagaagttcagtgcctgggttaaaaactatcaacagtgcaagtgcacaatgagatataccgactgtagtttatatagaaaggactctcttttgagttgactgttagcacaaatctacagtgtgcagcggaaaagatccagcacaaaggtgggcatgacaactcctctgcaagaccatgcccagacttttttttttttttttttttgagatggagtcttgctctgtcgcccaggctggagtgcagttgctattacaggagcatgccaccacacccaactaatttttgtatttttagcagagacggggcttcaccatgttggccaggctggtctcaaactcctgacctcatgtggtccacccgcttggccccccaaagtgttgggattataggtgtgagccacctcacctggccccatgcccagacttttgtattcagtactgggtacctctaggactggatgacaaagttgctgagggattacaaactcatgatctaggaagaagccgggaagagacttttttttttccctagatggagtcttgctttgtcacccaggccagagtgcaatggcacaatctcggctcactgcaacccctgcctcccgggttcaagcaattcttccgcctcagcctccagagtagctgggattacaggtgcatgccaccatgcctggctaatttttgtattttttttttttagtagagatggggtttcaccatgttggccaggctggtctcgaactcctgaccttgtgatctgcccgccttgtcctcccaaagtgctgggattacaggcgtgagccgccgtgcccggctgagaagagactttttaacacagtagatagcttgaaatactcaaagggatctcacaccaaagagggatgaaattcatttggaatggttccagagagctaaacaagatccaatgtatagatgaagttagccaatgggaggtggatccagcctagaatgagactgctttaatgattagagctgtccaaatacagaatggactgccttttacaatctccactgctttacaaggagctgtagagcattgggaagttggctggggcctcttttacaagtcacttatttccactgtccatttctgtctaacttgctttttaaaccagcttgccttttagcagctaatgtcctcctttattaatgcctttgaagttctttaatcaaatcatccatctttctgaatcacagtttctgttttctctccctgtcctcaattgattgaatgtacctgcaatccttgctgaaaaatagagtatttctaaaacctattcttacttttaaaaacccttcttaacaagaagcaagtacaacacgatgcataaaataaattaagcacaagtttatttctacatgagagaaactagatatttctgcctttgggagactgcgtttctgataaattttggcaacccatcaacaacagctttcagagacaccagcaggttgaggaaccaagagcataattgttatgatgatgtctaagggggccaattctgggcttaaaatcacactgtttcagcttaagagagtattccagcctccagtaaatagaaagcttgcagagaacagtctaggagggcaatggcaacgtggtaacagtaccaatgtgaacttgaaccttccttctttctgagaaacctgtaatgctgtctagctttgtttttgtctgtttgttttaaactgactacacttcacagtcattctcatgaggcaggtagttcagagaggccctctagtttatttcacaaattggaaatcaatgaacttgagttcactgaaaatttgctgaggccttcctatgggggaggccctttgcaagtcacttatgggctagggatggtgggactaattcattcattcaaacagcaggcatttaataaatgaggagcatagactagggactgttctttgtactgaggatggacaagatggacaggccctgttcttatggagcttctgtcctagagctccatgagacactaggagacaagcagttaacagctaaaccaaaatacaacatcacaagtaagcactgtgaagaaaactgaccgggcacggtggctcatgcctgtaatcccagcactttgggaggccgaggcaggcagattacctgaggtcagttcgaagccagcctggccaacatggtgaaaccccatctctactaaaaatacaaaaatgaggcaggcatggtggcgtgcacctgtagtcccagctacttgggaggcggaggcacaagaactgcttgaacccaggaggccgaggttgtggtgagctgggattgtgctgctgtcctccagcctgggtgacagagagagactctgtctcaaaggaaaaaaaagaagaaaagaaaactgaaaaatgtgatggaaggtgaattgccgagagtagccactttttaatttatttattatttaattttttttttgagacaaggtctcactctgttgttgctcaggctggagtgcagtggcgtgatcacagatcactgcagtcttgacctcctgggttcaagcgatcctctctctttagcctcctgagtagctgggactaaaggttcaggccaccacgcccagctaatttttttcttttttttttttagtagagatggagtctcgctatattgcccaggctggtctcaaactcctgggctcaagggatcctcctgcctcagcctcccaaaatgctgggattacagacgtgagccactgtggctgggtagccactttagacagcaaagacatctctgaggaggggacatgtaagctgcgatctgaatggaaagagaacgacacaagtgaagaagatctgtgggaagagcattccatacaaaggctgaggtcaggaactcctccagaagctcataattgcaccagaggtgcttacaaccccaagcagtgacagtggcacagaatattcaacatcaaatgcctaagctaatttccaggctgagaaaggtaaaccatccttctcctgcctgcagtgcttctatcggtcctgaaagagacagaggaggtaagggagaagaattggtacgaaatggtgcagagctggtctcagagggcaacaacagccagccctccatgaccacactcccaccgtgcactcacgtgcccctcttgaagcggctctgatcctgtgacctaaccagtttccacctggcttctctcagtgcgttgccatatagtataattttttgtttgtttgtttcgtgtagggttttgttggttcttttccaagtatcaatcaaaactacatgccaacgtccactccttggaaataattaaatgacatgacgtgcctgattttttcagctggtgatgcactgtaatttgcatctgctgaaggaatttatcttaagtcctgaagcccagccacttgagacaactgaggtgatttttctgctctgcttttgctcatgcggatggtgcgttattgttaaacacaaaagtggactaattgcttcattctgcaacctactccgtgaagaaagctgctcttctttgtgaagagaatatgttcatgttttgttcatgaattccatgcaatttcccatccccttgttaagtaatgtagcttctttatattggcaaaattccctttatcttgctgtgacctgcgctttgtcctcccgagcagagcaaatcatctgtggtttaagagcagctttggattcaagtccccttttctcctgtcgagggaagtgagtctatgaaatggccttcatctgaaagccacagcgaagcacctcctagcccaagtctagctgctgtgtggcagctccagcggcgtgaactgtgactgccctgcagacacctatcaagcgctgcgtcagctattaataataaaatcaactcttctccctcccccccgcgaggggggttccctcgtcagggcccagaacccgctggggaagaatcggggctggcgtgcgaaggagctggcggcagggggtgtaggatgcggtgttcccgaggcgacagatgaaggatttgggttgtgtgggaagtgaactgcggaattcctccccttggtttctgaggggggctctgaaggagccagattaggatgcagagcgcagcccgggcgaccgagggcgaggaggcgagccaaggacatcagcccgagggcgcctcgagacgccccgcgtggaccgcgctcccagctcctcggcctcgccttccaaccatccgcccaccggccccagagcagcgtgcccactgtgagcgccccaccctgcgtctgcaggtgggtgggtcagagaaccgcaggcacagaagagggtacccagcttcccctccgccagccccgcgaccgcggcgcgcgcggcctcgatccgggttcctaggggcggcgcgcgggagggggcggggcctgcgcggcagcgtgggcgccaggcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttccattgttatcgtgttgtaagatcatactaagatgatgttggactctttgtagtctgtaaatagaacttacaaaaggaatattccagttgctttcccttcctggtaatggcaaggtgacagttgttcctgacggtgacaagaatgatgacggctgtgatggcacccttgttgaccaaatttggtcactgacctttagggtggtatatttatctaaattggacccctgtcttaagtgattcttaggttgaaagaacaaggtttagtacagttggttctagatcttaaaggaaaaaaaccagcatggtgttttttcttgttctgtgtgtgcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttactattggggttgcactgggtctgttttttgagtggccagtttgagtgactttatattagcattttaaattaatgatgtgtgtgggttttgtttgttcattttttactttgaagtaattagaggcttatagtttgtaagcatttcaagcaggtttttaaataaatgctttaattttttttataagataggaccttggctttgtggagcattatagagctatattttggagttgaaatttgagctcctttttggtaactgtggagttactgctcaggaaatgaactgtgttacatttttattttatgagttggtaaatagcaaaagaataagtgtttagggagtacttctatagaattaatttgctttggtttgtttgatcaaggaattgcagatataagacctgttgtgttgattttcttcatgtggggttgggtactgctgctgcattgtctttagtgtttcattcctcctgtctgtatcttttaaaagaaagagcactgactctctttttgtgtcagtttattcctattgatgtaacagaaaaaacatggtagaatattcaggtttttttggagaagtgactaggcgattcttatatacatcatgcgtcatcaagtcatgcttaaattaaaaagaatattagtgacttacttcaaatatcaaactaagtagtaaactgttaactatagttaatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccccctctatcattcactttatcttttcattctcttcttgattaccaactttgttctaaatgtaacacatcgtatggttgcttaactgatgcctgccctttcttctcttttcctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcataaagtcataattaatatggtaataatttgcataggtttctctaccttccaccgtcgtttcccatgtcagctacttagattgaccctaaaatgctaataaaactttctagactgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcggctcactgcaacctccacctcctgggttcaagtgattctcctgcctcagcctcctgagtagctgggattacagatgtccaccaccacgcccggctaatttttgtatttttagtagagatggggtttacctttgttggccaggctggtctcgaactcctgacctcaggttatcacctgcctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttatttaaaaaaaaaaaaaaacttgatgtaaatttcttcatttattgagcaattgtttgagggcccaaaggcacagtgcaagtttctgagaatactaggagcaaaatgtgcttatgatctttttaagcacttttttctttcgttttctttttatgatactaagagctcttcctattatcacagtgtatagatatctgagtcacaatatcatgactgtctcccagtttacagcagaacgtgctttttaccttggattaaaatttgctttatttggccgggtgcagtgagtggctcatgcctgtaatcccagcactttgagaggccgaggtgggtggatcatttgaggtcaggagttcgagaccagcctggccaacatggtgaaaccccacctgtactaaaaatacaaaaattagccaggcgtggtggtgggtccctgtaatcccagctactcaggaggctgaggcaggagaatcgcttgaacccgggaggcggatgttgcagtgagccgagattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcacatttgaagcattgaacttgtttgataatgtatgtcccagaagacaggtattattgtatttagcacaaagcaaagggaagaagaaacactgtttatgtccaaaactatggggcagtggtcttctcttttacttttctttgctgctgttcatgaagcttgttaccttttcgctgtcttttttttgagacggagtcctgctctgtcgcccagattggagtgcagtggtgcgatcttggctcactgcaacctccacctcccagcttcaagtgattctcctgcctcagcctcccgagtagctgggattacaggcatgcaccaccacgcccgggtaattttttgtatttttagtagagacggggtttctccatgttgaccaggctggtctccagctcctggccttaggtgatccgcctgcctcagcttcccaaagtgctgggattacagacatgagccacctcacccagcccagataatccttttacacactgtttaaaattttcaattttcctggagatagggtctcctgtcgcccagcgggtaaatgcagtggtgcgattatagctcactgcagcctcagacacctgggctgaagcctgattcttgagcctcccaagtagctgggactataggtgtgagccatcatgctttgcccttttttttttttttttttttttttgaggcagagtctcactctgtcacctaggctggaatgtagtagtggcacgatcatagctcattataacctcaaactcctggtttcaagcaatcttcccgagtagtcaggactacaggcatgccctgccatgcccaactaattaaaaaaaaatttttttttatacacatagggtctcactatgttactcaagctagtctccaattcctggccttaagagattttcccaaagcattaggattataggcatgagccacctcacccagctgaaacagataattctttttttttttttccttgagatggagttttgctcttgtcagccaggctggagtgcaatggcgcgatctcggctcgctgtaacctctgcctcccggggtcaagcgattctcctgtctcagcttccccagtagctgggattacaggcgtccaccaccacactcggctaattttttgtattttagtagagatgggttttcgccatgttggtcaggctggtcttgaactcctgacctcaggtgatctgcccacctcagcctcccaaagtgctgtgattacaggtgtgagccactgctcctggcttgaaacagataattctttatattcaacctgttgtcaaaatttttagaaacattttcccagttccttgtataagtatactttgtataacttctggcaaaccataattatgaactcacattactatagtactataatactgcagtaagggatcttgcgtttcagtaatgtcactcatccagttttcctcccctttctcttaccccatctccctcccagtctcatggtttctgttgtcaatcctctttctccttacacaaggcaagaggttttcttaccaatagatcagaactgtgaaggactgcccgacatgatctgatatggttgttcttcattttgggctgtagtattttaaagtagaggtttgctctgatggtcccatcactgcttgccattgtctttccctttgctctagctatcaggggatgttgctttaagtttgttccccaggctttactgccaagagggaaattcatacccactttaacaaggtgtgaagcttatcttacagttgctaatgcctcactgaccttttggaaaggtcatagttactcttcaagttgagcgatttttctcccccaagagctaattaaagtttcttgtttctgatatgctctccttggcaaatgtttgaaagtctagtatcagagcagctgtgatcctgcatctatcaaaatttataacttcctagagaagttttcattctggcattattcctggccttaacactagaatgccctgttgaaagcatacagtaacatttattatactcattctggttgtctgtttgccctagctcactggacgttggtggtgattggcatctgtcaggacttggtggtcctggtgcctcctgtttttatttttctttttgtcctgctcaaacagatatttcttattcatgccgtcttctaatgagtcatttggattcattattgccataaatcatttggaggagtgttttcatgatttactaagtagatcttttaaagaagattttattatgaaatatgcaaacattttaagcaattttttaattaaaaaaaattcgacctccaagattaaatcattagatgtggttaacactgtttctggattggtaagtttccacaaaaagaggtttttaaatttttaaccacatagaccactctttaccatattcattattcttagtattcattgtggtgagttctctctttttaccacgtttatagttgttggattgggaagtgcagtgtgactcttactttgtagtttttaaatcttaacaagtttatagttgtatgagctaaaagtttaaacctctgccccattttcttggggcagtgttctgtgaccagttacatttttggacttaggttatctctgaagtgctgtgttgctgtataaatgtcatatggaggataacctacaaaatacacttcggatctcccaacagctttgcggttctgaaacagccttcagtagtaccactgaaaagaaacggggaattaactggttttttgtttcttttatagagatgagggtctcgctatgttgcccaggctggtctcaagctcctggcatgaaatgatcctcctgccttggcctcccaaagtgccgggattataggcatgagccactgttcccggcctagaattaaacagtttatatatgctctaaaatttaagtcagtgatcaagttgtttatactgtggatttatgtcacatggatattacttgatatgaataataactaaatgaacatgactgttagatgatcaccttttactttaatcaagaattgaagttttattttttctaaatagatacatataaaatgaatggaatttattccctctccccagattttatttggattctaaaatggaattattacatcaaaagataaggtatttttaagaagtatagttgtttttttgagactgagtcttgctctaacgcccaggctggtgtgcagtggtgcgatctcagctcactgcaacctttgcctcccaggttcaagcgattctcctgcctcagcttcccaactagctaggactgcaggtgtgcgccaccacacctggctaattttttgtgtttctagtagaggtggtttcaccttgttggccagggtggtctcgaattcctgacctcaggcgatctacctgtctcggcctcccaaagtgctgggattacagacttgaaccaccacacccagccatgaagtatagttttttgtttgttttttgagttttgcttttgttgcccaggctggagtgcaatggtgcgatcttggctcaccgcaacctctgcctcccgggttcaagcgattctcctgcctcagcctcctgagtagctgggattacaggcatgcaccaccacacactgctaattttgtaattttagtagagatagggtttcttcgtgttggtcaggctggtctcgagctccagacctcaggtgatccccccgccttggcctcccaaagtgctggaattacaggcgtgagccatcgcacccggcttttttttttgttttgagaccgagtcttgctctgttgcccaggctggagtgcagtggcacgatctcggctcactgccacctccgcctcctaggtacaagtgattctcttgcctcagcctccccagtaggtgggattactgacacacatcaccatgcccaggtaatttttttgtatttttagtagagacggggtttcgccatgtcggccaggctggtctggaactcctgacctcaggtgatctgcccgcctcagcctcccaaagtgttgggattacaggtgtgagccactgtgcccagctgaagtatagttttgactttcaagaattcttatgaacaagacatagccagttgtttatataattgcattttctaccgtttatttctagagaaagaaaatagattttgtctatcataatccctttagtgctagccacttttttttttttttttttttgagttttcgctcttgctgcccaggctggagtgcaatggcatgcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctcggccagtgctagccactttttaaaaaagtgacattaagcctaaaaagacacattctaacgtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactctgttgcccaggctggagtgcaatggtgttgtctcggctcactgcaacctcttcctcccaggttcaagtggttctcgtgcctcagcctcccaagtagctgggactacaggcacgcaccaccacgcccagctcatttttgtattttttggtaagagacagggtttcaccatgttggccaggctggtcttgagctcctgacctcaagtgatccgccctcctcagcctcccaaagtgctgggattacagacgtgagccaccatgcccggcctattaatttaattaattgcaaatttttgaccttaatgcatataaactttgcagttaagattgctcattcttcgccaagtgtggtggcaccagcctgtagtctcagctactcaggaggctgaggtgggagggttgcttgaacccaggaggtcaagactgtagtgagccatgatcgtaacactgcactccagtctgggcaaaggagcaacactgtctcagaaaaacattgttcattctttacggtagcaaggaattaaaatgggtgagagaagctgcttaaggaaatgagaatgtgagaaccattatctttatgtctcctagttgcttcctgtgacaaactttaaaagctacatgtcatttttattctccttgggtttttttggtaggtttagctataaaaattgtttccccttcagtgcttactacagactctgagacttaaaattcatgttaagtgttgatcttttaggtatttgacggatataatcacccctttgaggactgaagtagaccttttttttgtttttgttttgagaccgactctctgtcgcccaggcaggagtgcagtggcacgatctcggctcactgcaacctccgcctcccaggttcaagcagttctgcctcagcctccttgagtagctgggattacaggcacctgacaccacacccagctaatttttgtatttttagtagagacggggtttcaccatcaggctggtctcaaacccctgacctcgtgatccacccacctcggcctcccaaagtgctgggattacaggtgtgagccaccactcccggcctttttttttttttttttttttgtttgtttgtttgtttgtttgttttgaccgactttcactcttgttgcccaggctggagtgcaatggtgcagtcttggctcactgcaacctccacttcccgggatcaagcaattctcctgtctcaccctcccgggtagctgggattacaggcacgtgccaccatgcccagctaacttacttacttttaatagagatggggtttcattttgttggtcaggctggtctcaaactcctgacctcagatgattccccctgccttggcctcccaaagtgctaggattacatgcgtgagccaccacgcccgacacatcttataaacatacttagtcctgttgaaattgtaaacttctaatctttaccaataaatgttaacgatctttatgtggtaggttcatagaaagatggcctacttagagatttgtaattgtgccatatatatgtgtgtgtgtgtgtgtgtgtgtgtgtgtgtgtgtgtgtatatatttttttttttttttttttttttttagatggagtcttgctctgttgcccaggctggagtgcagtggtgtgattttggctcactgcaacctccgtcttgtgggtttgaacaattctcctgcctcagcttcccgagtagctgggattataggtgactgtcaccatgcctggctgttgttttttttgtttttttgagacagagtctcactctgtcacccaggctggagtgcagtggcatgatcttggctcactgcaagctccgcctcccgggctcacgccattctcctgtctcagcctcccgaatagctgggattacaggtgcccaccaccacgcccagctaattttttgtacttttaatagagacggggtttcaccgtgttagccaggatggtctcgatctcctgaccttgtgatccgcctgcctcggcctcccaaagtgccgggattacaagtgtgagccactgtgcctggccttcttcttatgtttttctcaaaaaaattatatttggtcagggcatggtagctcatgcctgtagtatcagcagtttgggaagctgaggcgggtggatcagttaaggtcaggaggtcgagaccagcctggccaacatggcaagtccccgtcgctactaaaaatacagaaagttagctgggtatggtagcatgcgcccccagctacttgggaggctgaggcagggcttgaacctagggggcggagtttgcagtgagccgagatgatgccactgcactcgagcctgggcgacagagctagacttcgtctcagaaaaaaaagattcgagtttttaaaaaaagaacattcttaagtctttagtatactgaatggtatgagcagcaatagagggttgtggccttctgaaagtaaggaaaattataatgacagtataaggtagtatgaggggcatagtcttttatttctgaccagtgtcatcaaggagggctttattttttttaagacggagtctcgctctgtcaaccaggctggagtgcagtggcacgatcttggcccactgcagcctccacctcccggactcaagagattctcccacctcagtctcccaagtagctgggattacaggcgtgcaccaccacgcctggttaattttttgtatttttagtagagacagtttcaccatgttggccaggctggtctcgcactcccaacctcaggcgatccgcccacctcagcctcccaaagtgccgggattacaggtgtgagccaccatgcccagccttttcattgattgtaattgtcatctttgttctcagggtcagagataatttatcttttttttcccccaagacagcttcactcttgcccaggctggagtgcagtgtcataatcacagctcactccaatctctgcctcgcaggcttagtgatcctcccacctcagcctcctgagcagctgagactgcaggtgtatggcaccatgtcaggataatttttgcatttttcgtagagacactgtctcgttatgttcagcccaggttggtctggaactcttgggctcaagcagtcctcttacctcagcctcccaaaagtgctgggattacaggcatgagctactgtgctcagctgataatttaagcacatgcaaaatacagtgctcatgggatatttgtttaaccttgagcagtccagttaaattccacccaacatgatcttgaagggtaagaatgtctgatatgagattgaaattaactttatcatgaatttcccaattaaggtttttttatactttttctggggtatatacatcaaaactgaggtacacgtgttaccagctttcatctttgtgtcatttgattctctttaggctggtttgattctacaacttccattctgaaatcgggaagaaaattactgtgacttctaacggttgatagttcatatatgatgtcatgagaaatatatagcttgggactggcagtgctatgatgagagtccagccattcattggtctttacaactggagggatagttcttagaatttgtgagagatactcatcactcatagcatttactgtgtgcccaaacacaatctaagcatgttacatatgacttcttatcctcacaaaccttgaggtaggaactgttagtgttgtcattttatagacagtaaacttgtgtgttgtgtaacctctctacagtgacatagctgttaagagcctgtattgaacctgggcagcttagcccagagttgggttgggttggggttttttttgttttgttttgttttgtttttttgacatagtctctttctgttgcccaggctggagtgcagtggcaggatctcgtctcactgcagcctccgcctctcgggttcaagcgattcttctgcctcagcctcctgagcccagactattaagctgtactgcctctcatgagacagaattgattttaaatggcagggggatttggctaaaggtgaaagctgtgttttacagtcttagggacagcagagtctgtaattgcttttcctcattgttttatccccttagcttaattgagggtacttaacgtttcgtttttaatacaaattaataaatgtccttgtgtctgttgccttagatgtgaattgtttagtacaaatgttactggtgggcttcctttctttttaaagattagacctctaacattttattccttgggttagaaataattgcagtgtcaggcaggtctttactactcttctgttttcttttatacaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgagttgagtttgtcatttttcttttattctagatagtatttctgaatgtagtccttttctcaaggctcataattatatttaaaataattgttttcatgtatcaattaacacattttattgccattcatacaaatcctacattctctaaaattattttgaaatgttttagcacctcccttcctgtcattgataaggcttttggtttttgtttttaaacaaggtattttgaattctacttgtttaaatacattgtagaacacaagtgctagagaggtaaaacctaatgttgatttgacagttagttatagtgaacaatttgttagaatactggctaatgacgacacagtttttcctgttttgtttcttggcaccaaagttcatggtcaagggtaatttcttgactctgaaagctatgcttggccaggcttggtagctcacgcctgtaatcccagcactttgggatgccgaggcaggcagatcacgaggtcaagagattgagaccaccctggccaacatgaaacctcatctctactaaaaatgcaaaaattagccgggcatgatggtgtgtgcctgtagtcccagccacttgtgaggctgcagcaggaagaatcgcttgaacctgggaggcggaggttgcagtgagctgagatcgcaccactgcactccatcttgatgacagagtgagacttcatctcaaaaaaaaaaaaaaaaaacagtatgcttaaaaatacttatgtgttacactgagccaggagtctctgcctgaattccagagatagcttcaaagagtccatgaatccactgtgagtccagaatgctccacagacctccaagggtcagtatcctcactgctgtagattagtgctgtttttttgttttgttttgttttgttttttgagatgggagtctcactctgttacccgggctggagtgcagtggcatgatctcagctcactgcaacctccacctcccaagctcaagcgatcctcccactttgccccccaaatagctggtaccacagatgcatgccactacactcgcctaatttttatattttttgtagagagggagttttgccatgttgctcaggctagtctcaaactcctgagctcaagtgatcctgccttagcgtcccaaagtgctgggattacaggtgtgcccagcagccatatttctgacagtccaaaatcacaacacccctgggaccaaccaggatagtctaggtgggttgtttgttttggctatttcacttagagagtcattgcatactgttattcagattatctggcttttcatacccttctgagttaagtatactatttactttgttgctatttgtgaattatctcatagtaatatgcttttatattgacttgggaagggtgtgctttgtctttattgtcttactcattttaatgaattgaaagagctgcattccttaacccatgctctacaactttggcctctgaaaggaaattgccttgtcctattctctcatccagaaatttttgttgttcctccagaaaaaaaggatagtgttacatatatgccagtaagccaattatttgggactgtgtagtgtttgtgtgtaaatggtgtgtgtaaatgatttaacagcttccttaagtatagtgttaagaagagtacaactcagaatgaaatgtcttggctattggattttttaaaacttcctgttttggccaggcgtggtggctcatgcctgtaatcccagcactttgggaggctgaggtgggcagatcatgaggtcaagagatcgaaactatcctggccaaaatggtgaaaccctgtctctactgaaaatacagaaatcagctgggcatggtggctcccacctgtagtccgagctcctcgggaggctgaggcaggagaatctcttaaacccaggaggcagaggttgcagtgagccgaggtcgtgccatttcactgcagcctgggcgacagagccccagactccatctcaaaaaaacaaattttctgttttgacacaaatgttatactatcacagatgtattattttttcactctgtatacacacatttttgtatgaactgttgaagggtatattgcaggcatgatgcccctttaactcctaaataacatttgttttatagtatcaaggatgttctcttatataacctcagtatgattatcagaattaggaaattgatgcaatagtatgtaagatcttattcagaatttaccagttatcactttttttgatgaggggaagacagggtctcaatctgtcacccaggctggagtgcagtggcaccatcacggctcactgcagcgttgacctcctgggctcaagtgattctcccacctcagcctcctgaataactgggatcacaggcatgagcaaccaagctcctagctaagttttgtatttttttgtagagatgggtcttgccctgttgcccaggctggtctctcaaactcctgggctcaggcagtcctgcctcagcctcccaaaatgctgggattacagacgtgagcccactgcgcctggcccacattttttttaatagcaaaaaatatttgaattagggaattctgatggtgatgaagaaaataggtcagaatggggaaggctgaagatatagggaggctattttagtagtctaggcaagagataatgaggacagtaacattaagaataatgaaggaaagatttttgagttcatgaatagtggctcttaagcaggagtgcacatcacaatcatctgggggcactctttttaaaaaagtttttggcaggtctcaacctagaatattaactctgaatctccattgggtacagagttctgatcgtgagtagttcaaagagtgagcctctgacttagttacaaaacagcagatttgttttgttttgttttgagatggagtttcgctcttgttgcccaggctggagtgcaatggcaccatcacggctcactgcagcattgacctcctgggctcaagtgattctcccacctcagtctcctgaaaaactgggatcacaggcatgagccaccatgtacctggctaagttttgtattttttttgtagagatgggtcttgccatgttgctcaggcttgtctctcaaactcctgggctcaggcagtcctgcctcagcctcccaagtagctgggattacaggcatgcgccatcatgcccagctaattttgtatttttagtagatgtggggtttctccatgttggtcaggctgatctcgaactcccgacctcaggtggtccgcccgcctcagcctcccaaagtgctgggattacaggagtgagccaccacgcacggcctaaagcagctccttccgtcagtctgtccgtccgtctgtccttccttccttcctccccctttccctcccctcccctcccctcccctcccctccttctgtcctccctcttttccttctttctcgctctctcttttttttttttttttttttaacttggagacaggggcttgctctcttgtccaggctacagtggagtagtgtgatcactgcgacctcgaactccttggcttcaagggggtcctcctgcctcagcctcctgagtagctggtaatacaggcacatgacaccatgcccagcttttttttttttttttttttaaagacggaatcttgaactgtcgcccaggctggagtgcagtggcacgattgcggcccactgcaagcttcgcctcccaggtttacgccattctcctgcctcagcctccccagtagctgtgactgcaggtgcccaccaacactcccagctaattttttgtatttttagtagagacagggtttcactgtgttagccaggatgacctcgtgatcctcccgcctcagcctcccaaagtgctgggattacttacaggtgtgagccaccatgcccggcctttttttttttttttttttaaagtaaagatggggtcttgctttgttgtccaggctggtcttgaacttctgggctcaagcgatcctcctcctcctgccttggccttccaaagtgttgtaattacaggtgtgagccactgtacctggctcaaagcaacagattttgataatagataggagagtgtgtaaatcaaagatactggcaagatttctagtttacgtgactgggtgtgatgatggtactctactacctacagaaggaaacattggaaaggagattgtttttccacaaatatatgtggtgggtgaggttgtagatgacatcacctaaatatgtgtatgagattctgtttgattttatgcttacagtttctccagcttcttcttgtttaatttttttaaaaaaatagagacagagtctagctatgttgcctaggctggtctcaaactcctggcctcaagtgatcctcttgccttggcctcccaaagttctgggatttacaggtgtgagccactgtgctctgccttgttgggctgttttagtgtgttgagtctacttgaagccttagagaaattacccccaaagcctttatccttagtttgcatcagtagatggcaatggtagacagcttcagaggaaactacaactgtgatacctcaaagcaccatcctttttgaagaaagagacaaaagccagcttctcttcagttggtgattctggtttctctgtatctttgaatcctgattcttgccagtccttcccgtcttttgtaagacactctaacctaattaactgtgagaaacttggaagtcatcttgattttttcccccctcttatcctctgatttgtccgtaaggccactgattctgtctccagaacacacccaagttcgtgaactccgtttccttggtcagcacactagtctagccatcatctcacaccgcagctgtcatcatctcctaactaggctctggcttcctttgttgtcttcctccagtccattctccacacaagtgccagagtggtttcttaaaggttgtgttatttattcatctgctaaaaaacccttaagggacttccccattgcacttaaaatacaaaattctctgacctgataaacttgcattgtgtgtatgtacctcctgctttcttctatgatttcatcttgtgctgctccttcatgttgcagacatccaggcctttttttcagttttcagtaccaccaaagtcacctttttttggaaggttaggcaaattttatagagtttattaatttgctcaatgcactgatcttatggtggtgaagctttgattattaccctgacctatctcgctttctcacactgaaatttcattttctatattgtaatatagttttgttgttgcatttgatagtttagaaaggacaaataatgtttgatctatagtgtatgtgacttaagattttcagtctaatgggattttccttatttatattgtggtaaagtatacatattataaacttacccattttaaccatttttaagcgtgcagttctgtggcattaagtacattcacattgttttgggactgtcaccatccagaacttttatcttccctaactgaaatgtacaccttaaacactgacttccagttcccctcttccctggcccctggcaaccattccctttatttgaatattcaaaagacaatgaatttaatattcaaaaaaaacctgagtttaaatcccttaggtgaatatactactactataaagtggagtacaaatttaaatccattttcctttcacctgtttctgaatccttcatagatagtgctgattctggtagttatttaccactttttttccccagctcttcccccacagtatggtaattgctaaaaagcgtatatattgctttgacgttgggctctgtttttctttaatttttatttttattactattattattattattattattattactattttgagacagggtctcactctgctgtgcaggctggaatgcagtagcgtgatctcggttcactgcaacctctgcctgcctgttcaagtgattcttgtgcctcagcctcccaattagctgggctcaccagcatgcaccaccacacccagctgatttttgtagttgtagtagagatggggttttgccatattggccaggctggtctcaaactcctggcctcgtgacccactcacctcggcctcccaaagtgctgggattacaggcgtgagccaccgtgcctggcctattattattttagttaagcccagctgtgtgagacattgggctcttaagtgctgcttgctttcgtcttaaattgtgacctttttaactgagtaatgcagaacagacatctaggtttagaatgtatgtgggcattttattaaatactgttgtcatactactaggcagtgagcaccttaaggacagaactgtcatattgactgttgtaacgttatcgtaagttctctatgaatgaaatttgaaatcagaagtatatgataggctcagctaatgtaaacatagttgctgtgcagaacaaacagttgaagtgtatgtgtgtgttcaatacaattattattataatattatacagacagagtcttgttctgtcacccaggctctagtgcagtggtgtgatctcggctcactgcaacctgtgtacctcccagtttcaagtgattctcctgcttcagtctcccgagtagctgggattacaggcttgggccattatgcctggcttgcttgcttttttgtttgtttgtttgtttgtttgttttgagacgagtctcgctctgttgccaggctggagtgcagtggcatgatcttggctcactgcaacctccgactccctggttcaagcgattctcctgcctcagcctcccgagtagctgagattataggcacgtaccaccacgcccagctaatttttgtattttttagtagagacggggtttcaccgtgttggccaggatggtctcaagcccctgacctcgtgatccatcctcctcggcctcccaaagtgctgggattgattacaggcatgagccaccgcgcccagccacgcctggctaatatttttgtatttttagtagaggcagagtttggccatgttggcccggcaagtcttgaatttctggcctcaagcgatccacctgcctcagcctcccaaagtgctgggattacaggcgtgagccactgcacctggccttcaatacaattattgaatgccagattattagtatattcaaggtctgtgtgatcctcattattatcttaattccagaacattttcatcaccctcagaaaaacccatacccattagcagttgttgccctgttttcctcccaccagttcctgacaaccacagtttattatctgttttgtggattactgtctgtttttctggatattgcatataaatggagtcaatcttggtgactggctttctcttagcatagtgttacatttcgttcatgaatatagcatgtatttcattccttactgctgaataatgtttattagttgatggacatttgggttgtttccagttttggtctattatgagtaatgaatagtgctataacttgtacatacatgcttgtactaatttttgtgtgaacataacattttctctctgttaggtatgtacctaagcatggaattatggggcctatagtgactctatacttaacattttgagcagctaccaaactgtctttcagaatggtggtgatattgttctacattcccaccaacaatgtatacaagttccagtttctctacatccttgtcaagacatgtcattgtctatcgttttaaagttttacccaggaagtgagtatcattgtggttttgacgtccgtttccctaatttcttaatgatgttgggcatcttttcatgtggctattgtccatcggtgtgttttctttggagaaatgcctgtttaaattaggttatttgtctttttaatgttgaggtataagaattctttacatatcctgccttatgaggtgtgattagcaaaattttttccccattctatagggattcctttttttcactttcttgatggcatactttgtaacatacaagtttttaatatgataaagtccacttatacattgttgttgcttgtgcttttggtgtgatgtctaagaaactgttgccaattgaaggtcacaaagactttatatattagccagtatatatgatccaggcgtcgtggctcatacctatatgatcccagcactttgggaggctgaggcaggaaaaaccacttttttttttctttttgagacggagtcttgctctgttgtccaggctggagtgcagcgagtggcatgatctcggctcagtgcaacctccgcctcctgggttcaagcgattctcccgcctcagtctcccgagtagctgggattacaggtgcacaccaccacactcagctaatttttgtatttttagtagaaacggggtttcaccgttttggccaggctggtcttgaactcctgacttcaaatgatccgcctgcctcagcctctcaaagtgctgcgattataggcaagagccaccatgcccagcctaggaaaaaaacacttttaaattagccaggcaaggtggtacaggcctgtagtctcactactcaggaggcagaggtacgaagatgacttgagcccaagagtggaggctgcagtgagctactatgatcctgccactgtcctccaccctaggcaacaaagcaagaccttgcctctttaaaaacagcaacaacagcaaaaactatggtgtgaggtaggagatccagctgctttcttttgcatgtggatatttagttgtctcagcaccatttgttgaaaagatttcttcactaatttgtcctgcaacctttgtgaaaaattaatttacaaatgcaagaatgtatttctagactctattcttactccattgatctctgtctttaggtcagtaccatactgtcttgatagctagctgtcgttttgtattttttgaaattgggaacttgggagtgtaactttgttcaagataattttgggcattctgggttccttacatttacatataaatttttaagagttgcttgtcaatttctgcagaaagcaagctggtattttcagtaagaattgtgttgtatctatagatgagtttgggaaatatggtcgtaatatcaagtctttggatccatgagcatagggatgtctgttttttttttgttttttttttttaaggtctgtcatttctttcaacactggttgtcagtgttcaagtcttgtgcttcttttgttattgcatttttggcggggggaatatttgtaattggaataattttttgtaacttgaaattggcctattggtgatatttatttatttatttatttttgagacggagtctcgctctttcaccgctatgacaggctggagtgcagtggcacgatctctgctcactgcaagctccgcctctcgggttcacgccattctcctgcctcagcctccccagtagctgggaccagaggcgcctgccaccatgcccagctaatgtttttgtatttttagtagagacagggtttcaccatgttagccaggatggtctcgatctcctgacctcgtgatccacccgccttggcctcccaaagtactgggattacaggcgtgagccaccgcgcccggcctagtgatatttatttttaattaaaatttttagattcaaggtacatgtgcaggtttgttatgtggatttaatgtgtgatgctgaggtttgggcttctgctgatcctgtcatccagatgatgagtatagatgatgagtatagtacttcacagatagtttttcagccctcgcccctctttccctcccactttttggagtgcccagtgtttattgttcccatcttaatggctatgtgtactcagtgtttagctcctacttacaagtgagaacagacagtatttggttttctgggttaactcacttaggataatagtctctggctgcatccattttgctggaaaagacatgatttcattcttttgcatggctgcgtagtatcacatggtgtatatataccacatttatttttgagatagggtctcactctgtcgcccaggctggagtgcagtggtgcgattttggctcagtgcaacctccacctcccaagctcaagccatcctcccacttcagcctccttgtgagttcaggccatcctcccacctcagcctccttgtagctggaactacagatgcccaccacgcccaactaatttttgtatttttcgtacagataaggtctcaccatgttgcccaggctggtctcgaattcctgggctcaagtgattcacccaccttggcctccgaaagtgctgagattacaggtgtgagccaccacgcccggccacaatttctttttcttgggatatatacccagtaatgggatcgctgggttgaatggtcattctgtttttagtttcttgagaaatctccaaacagctttccacgggggctgaactagtttacattcttgccagcagtgtataagtgttccccccagccccaccacctttttttttttttttttctttttttttgaggcaggatctcagtctgttgcccaggctggaacacagtggcatgattatagctcattgagccatggctttccaggctctagtgaccctcccacctgagccttccaggttagctgggactgtaggcacacaccactatgacaggctcatttttaaattttttcgtagagatgaggtcttactatgttgccctggctagtagttgaattcctgggctccagtgatcctcccacctcagcttcccaaagtgctgggattacaagcgtgagccaccgtgcccagcaataatagtcactctgactggtgtgagatgacatctcattgtggttttgatttgcatctctctactagtgatgttgagcattttttcctatgttgactacttgattgttgtcttttgagaagtgtcttttcataccctttgcccacttttcaacagtgattttgtgtgtgtgtttgtgtgtggatttaagttccttatagattctggatattagtcctttgttgagtgcatagtttgcaattattttctccaattctgtaggttgtcagtttactctgttgatagatttcttctgctgtgcagaaactctttcgtttaactaggtcccaattgtcaagttatttgttgcatttgcttttgaggcttagtcataaattctttgcttagggcagtgttgagaagagtatttcctaggttttcttctaggatatttacagtttgaggccttacatttaagtctttaatttgccttgagttaggaattcttttttcaatttcattttcagattgttctttgctagcgtgtagaaatagttttttacgtattgatcttgtagtttgccatcttgctgaactcattagttagttttaatagtttttatgggttccttaagattttctatatacaagatcatgcatttgcaaatgaaaatgtttttacttctttctagtctggatgccctttatttcttgcctaattgccctggttagaatctccaatacaacgttgaagtaccaagagcagacatccttgtcttactgatcgtaggggaaagcatccagtccttcacagtgaagtgtgacataggtgtgggtctcataggcgggtgccctttatcatgttgaggaagcctagttacagctgtaatatttaggttgtcagtatactctggtgacctttcatggtgtttgtaaacttatatgcaaatcagaaatgatagtttgctgggttactaggaccagcaggtcattgaattgggtaagatataattctaaggcatttgcaactattatatggaacattttggaaaagcataccgtgactgtataacctgggccagataaataggtatttattttattaagactatacacgttgagccttttaaacttccacctcttttagaattagtaatcaaattgactgtgcaatctagcatttagcctgataattcagttttgtgaaaactatagagtgaactttaattctgaattttttcttgtcagtcgaaggtactatttgcgtagcctgaaagattaaatggcataaattgtgcttttagacatggtgacttttatattttcatttacattatgaaattggatgtgaaggggtttttcagatgtgttggaaaactggagagtgttgtaaactaattcgaagctgaaaataaaaaagtactgacttaacgattttgatatttgcagaaaggaacagacctttttgtagtcactgtttggaatgtaagggtcatctcctgactttaaaattctttgtcagcttttggaagatatctggtaggatggttctggctgaacttttcaaagactaagctggaataggtggttttttgagggagatatggagagagagtttaaggaaactaatttttttttttttttttttttttttttttttttttgagatggaatctcactctgtcgcccaggcaggagtgcaagggcgtgatctcagctcactgcaacctccgcctcctgggttcaagcgattctcctgcctcagcctccctagtagcagggattacaagtgcccgccaccacacccggctaatttttgtatttttagtagagacagggtttcaccatgttggccaggctggtctcgaactcctggcctcaagtgatccgcccgcctcagcctcccaaagtgctggaattacaggtgtgagccaccatgcccagccaggaaactaaattttatatgttgctataccagctaatcattccaaagagaaactgggtaagcatacatagcaaatgctaatgtgagtcttaagtatctagaacacaagagccaaatgaaattgatatggcaaataaaaacatggagaaaataacccgcacataggctgtgctcagtggctcatgcctgtaatctcagcacttttgggggaggccaaggcatgcagatcacttgagtccaggagtttgagaccagcctgggcaacatagtaaaaccccatccctacaaaaaatacaaaaattagctaggcgtggtggtgcgtacctgtagtcccaacgacttgaaaagctgaggtgggaggatcacctgagcccaggaggtcgaggctgtggcagtgagctgaaattaagccactgcactccagcgtgggcaacagagtgagaccctgactcaaaaaaaaaaaaaagagaaagtgacccacatgttcacctcttaagaagccacagtaattctacattatcttaaggccaagaaaatatttctccggatggatggaaaccaaaagtagtgaagttgtacataatcttataagaaatgaacgtcattgtttttaagctttctgtattatctgctgacatgaaagtgaatcaagctataatagcctaagtcatttctgttttctttttttctttttccttttttttttttaaagtagagacgggattttaccatgttggccaggctggtctcgaactcctgacctcaagtgatctgcctcccttggcctcccaaagtgctgggattacaggcatgaaccaccgtgcccggccatggttttgtgggatgtttttttgagacaaggtctccctgtattacccagcctagtctcaaactcctgggctcaagggatcctcttcccttggcctcccaaagtgctgggattacaggcatgagccaccattcccagctagaagtcttagttttagaattttggggcttctagtatatgccgcaggggttatttattgacttcttaagaacactgttttcagggttgtttaaaacaaactttatgtatcttggtaacccagggttgatgaatagcaccaggaaataaatattctcagatgacttctgtcttgtagtatatactctggagcgaatcatcttttaagatttaagtagtggaagcaacacaatcttaaaattgcatttgctttagcacttgtacagaaattgataattttatttcctaaaatgaagacttaatagccaacagggtgccagcaatttcaagatttactcgggaataaaaagaataattcttaaacttgacagcaatttaaaggaagaaaactttcaatttaaaggaaggaaacttttacttcagacagttaacatgcagtactgagatttagtagcaggtataaactgcttttgaagcagttgagtaaaaggcagagttgtgaaatagatgagtggattcatataagaacctggattatgatcctagttctgcatgacattggactatgtacattaacctctgcagaattaggtaattggagtactgtttcaaggagctttcttgctctaaaaagtgtgatttagatagtatggccatgagtccatgtggacttttttttgcttttagaaagctgttggggttggaattgactggctttaaacatttagcaaacattaaatgctctttaacacaaaacagagtagtcagtctgctgtagagcagaggagttggcatactatctttgtgggttggttggttggttcgtttgtttatagacatgaggtctcactgtgtcactcaggctggtcttgaactcctggcctcaagtgatcctcctgccttagcctgtaatcccaggtctttgggaggcggaggcgggtggatcacaagatcaggagttcaagaccagcctggccaagatggtgaaacccccgtctctactaaaaatacaaaaattagccgggtgcagtggcaggcacccgtaacccgtaatcccagctactcggtaggccgaggcaggagaattacttgaacccagggggcagaggttgcagtgagccaagatcgcgccactgcactccagcctgggggacagagcgagactccatctcaaaaaaaaaaaaaaaaaaaaaaaaaaacgctgggattataagtgtgagctatagcgtccagctaatattttgggttttgtgggccacaacaatctctgtaccaaagtcttttgtaaaatatgaaaagagaattgtttaaaaaaaaaaaaaaaaaggtgttggctgggtgcagtggcttatccctgcaatcctagcattttgggaggccatggcaggaggatcacttgagcccaggagtttgagaccagcctgggcaacatattgagaccttgtctttacaaaaaaagttttaaaaacttgcatagtgaggctgggagccatggctcatgccagcactttgggaggctgagacgaggttcacttgagctcaggagtttgagaccagcctgggcaacatggaaagaccccgtctctaaaaaaataaaaaatgaaaatttgctgggcatgttgacgtgctcctgtagtccctgcttctcgggaggctgaggtgggaggatcagttgagcctgggaggtcagggctgcagtgagctcagatcgtgccagtatgctccagcctgggtgacagagtgagacagagtaaaactctgtctcccaaaaaaagttcggggggtggggagccttaagattttgcacactgcttagatcaatgtttctctaacttcatgtgtgcaggaattacctggggatgttgttaaaatgtatgttttgattggttcagtctgaaatggggcctgattattctgcatttctaataagctcccaggtcaataatttgagtagcaaggctctagagcagatcttaatcatttctagatcacagtccctttgagaattaatgaaatttatggactttcttccccaaaaacatatattgaaaatcttgtgtgcaacttcaggaggttcatttgtcctcctcctcagaaagtccacctcaggattctagctatttagttttgaaaactgaagtacaggccgggcatggtggctcatgcctgtaatcccagcaatttaggaggccaaggcaggcggatcatttgagcccaggagttcgagaccagcctggccaacactgtgaaatcccatcttcactaaaaatacaaaaattacccgggtgtggtggtggatgcctgtaatcctagctacttgggtggctgaggcacgagaatcgcctaaacccaggagatggaagctgcaatgagcctagattgcacaactgcattccaccctgagggacagagcgagactctgttgcaaaaaaaaaaaaaaaagaaaacaaaacaaaaaagaaaaattgctttagttgttctgtaaatcctggaagctatacctctgtttccaaagccaaggtataaattattactctagaaaacggataagcagaagagcaaaatagtctaaaacaaaaatcagcatagagagtttttgagtttgagagcccctgagcactgtcagaatagctaagacattaagaactgtgagaaatgagagttctcctcaaccatcagaccatgataggccagttgatcttgaagcctgacctgatttcatggggctggcatttccttcctgatttcctgtaatcacctcctctctactccccatgattcagtggtagtcacagtaccaggaagtgccaaccttttcattcttgctactgagatgaagattttggaaaaaggagaagaaaccatgtggtttgggaaccacctttccttttttttttttttttttttttgatacggagtcgctctgtcgcccaggctggagtgcagtggaatgatctcggctcactgcaagctccgcctcctgggttcacgccattctcctgcctcagcctccccgttagctgtgactacaggcacccaccacaatgtccggctaattttttgtatattttagtagagatggggtttcaccatgttagccaggctggtctcaaactcctgacctcaagtgcttcatctgccttggcctcccaaagtgctgggattacaggtgtgagccaccgctgctggccatgggaaccacctttcctaagcattaacaccaaaccacctagatgggcagatttaactgtgaccaacttttatattaaaagataatggaacttttttttttttttttttttttgagacaaagtctcggctctgtcacccaggctggagagcagtggtgcaatcttggaccactggaacctctgcctcctgggttcaagcgattcttctgcctcagctttcccattagctggaattacaggtgtgcaccaccccacctggctattttgtattttttttttagtagagacggggtttcaccatgttggccaggctggtcttgaactcctgacctcaagagatccacccaccgtcagcctcccaaagtgttgggattacaggcatgagccactgtgcccggccgataatggaacttttgaaaaccaagggcttggtggccgggtacactggctcatgcctgtaatcccagcactttggaggccgaggcgggcagatcacctgaggtcaggagttcgagactagcctgaccaacatggagaaacgctgtctctactaaaaattcaaaattagctgggcatggtagcgcttgcctgtaatcccaactacttgggaggctgaggcaagagaatcacttgaacccaggaggcagagtttgtgctgagctgatatcgtgccattgcactccagcctgggcagcaagagtgaaactctgtctcaaaaaaagaaaaaaaaaaaaaaagtaaaacaaagggcttggcattatcagtgccagaaaaatacaagattgagagaatggggaaacaggagggacataaacttggtgggagtatacatttgtatgcaaaagtaaaagataacagacgaagatgttaaccctgtaacaccgtaaaaggaaatgttagaaataactagatagccataaaaatagaggatgattcatttagttcatggtatggttgtgaaatactgtggccttgaacaagtaccttttagtgtctcattttcctcatctataaacagggagggagtaaagataatagatccctccttagagttgtgaagattgaattagtaacctgtgaagctgttccagcagtacctggtctagaaataatagtctcaaaatttcattgcttattattactatacagccactttttaaaatgagacaggtatgtataaatataaaaggtctaatattgttttagtgaatgttgtacataaagagatgtccagaaaatccagaagatacactttttttttttttttttggaaatggagtctcgctctgtcgcccaggctggagtgcagtggcatgatctcagctcactgcaagctccgcctcctgggttcatgccattctcctgcctcagcctcccaagtagctgggaccacaggcacccgccaccatgcccggctaattttttgtatttttagtagagacggggtttcaccatgttagccaggatgatctcgttctcctgaccttgtgatccgcctgcctcagccttccagagtgctgggattacaggcgtgagccatcgcgcccggcaatatactgttaactgtatatatatctgttgaaagaggggaagaagaatggtgtttgaccttttaaacgtgcatttttcttttgtgataaaaatctctgttggtaggtaggctggagtactctaacattgcttagtgcatggttgcctttgcaacatctaatgaattggttacctttctacccccataactctagtaactggaaacttgcttaatgatcagtgtcatttttttagtcagttcattataaaatattccttatgagctaaaatatattttgtctgttgtgtatgttagcttttttaatttggagccacatagaaatctgatttatcaccagtttagatctgaaggggagcttatgaaaccttattttaggggatgagaagactaaaactcagagtttgtaacttatccaggagcatgtggcagtttgtggcagtactaggactgtcaaatgttagcagtatagcgtatcctaaaatttttatttttggccgggtgcggtggctcacgcctgtaatcccagcactttgggaggcctaggtgggtggatcacttgaggttgggagttcgagaccagcctggccaacgtggtgaaaccccatctctactaaaaatacaaaacttagccggccgcatcggcacacgcctgtagtcccaggtatttgggagggaggcaggagaattgcttgaacccaggaggcgggggttgcagtgagctgagatcacgccactgtgctccagcctgggtgacagagcaaacaaacaaaattagcttggtgtggtggtgggcacctgtaatcccagctactcgggaggctgaggcaggaaaatcgcctgaacctgggaggtggaggttacagtgagccgagatcatgccactgcactccagcctgggcaacaaagctagtctccatctcaaaaagtaaaataaaataaaatgtttatttccaagttagtcttagcatttgtttcaaacgctttaccatcttggtagttctctttggtacccagattgaatgcagttatgtaaatggagtctggttgtcattctagacattttttgtcttctgacagtctatggaaatttctttggcagtcttaattactctaccagctaaaactacagtctttcttaggtgttcttcccatccccccattcctaaatttctagacttttactggcatagattattttggttttagtctaaacgtagaatttaagcaactaccattattgaacctcatttagcttaaccaaagctgttatctctttggaccctgattttttattgtttctagcttcgtgatgttcttcaacttggtaattagaagtcttttgctacatgtatactaaaggaaatatgtgtgccaaatgctttattcattgacagatattttatttgacacccactgtgtgccaggtatagtggtagggctaggaaatcagtgatgtctgagtgactctgcctttatggagcttttggttttagtggggaagattcatgaagaccatgcgagtgtaaggaaaggacaggatgctctgtgggcacacagtgagggatgccagcctaatctgggagttagaggaaagccttactatttatgggagaagaaagggtatgtgaaggcccagaaacaagttagaggaactgaagagcatagtgtgtgatgctcagagggaggtgagagggtgacaggcaaacagcacttgggtcatggaggctgttataagcccgggttgggatgccaaagaagctgttgaaagattttaaaacaggaggagatcacgtttgccattttaaagacagtactgtctaagaaacagattgggagcaaaccacagtagtataatggggtattgtgtaatgttccttccctgttcaccgtgaggcctggaagtagtttaaagtagtcaagtagagcttctcaaatgaagaatttcattcagtctctgctaaactacaaaatttatgactcaaattggaaacacggtgaaaattttgagtcacagttaaatgtttaagtagtttaagataaatctgttatgccttgtgtttcctaggagccatttagattcaaaaacaacagtggcatttagaaggtaatttctggtcttaaatagtgtttttcttataaaagattttaataactggtgtttgccacaataaattaggtttttaaaatgcataatacaattgattaataaaaaggattttttaaaaaaataatgctgatttttggtttgtttgggttttttttgagatggagtctcactgtgtcacccaggctggagtgcagtggcgcaatctcagctcactgcaacctcagcctccaagtagctacaattataggcgcccgccaccatgccgggctaatttttatatttttagtagagacggagtttcaccatgttggccaggctggtctcaaactcctgacctcaaatgcttcgtccgccttggcctcccaaagtgctgggattacaggtgtgagccaccatgcccggcttgaataatggtagttttaaccatcagtatttatatttgacataagtggtacaaataatgtttcagtatcatggcttataaacgtttgcatggagttctaaaacgtggcaaactgataatttaatgaactcttacttgaactcttgtgcaagtatactgtgaggattttgttctgattggaaatctttattgtaatagcaaattaaagagctgtggattttcaagagctgaatttgaaaggtgtcagatgttaaatggaaggtaattcagagtttattcttttattgtacctgcctccacccaaagagtcagagaaaaacatttggaagaaaaaattgcagagcatccctttggcaagagtaagaattttccactaccacttgccctaagagcattgacatgcctcaccagggaaatgttacaggatgtgatcatcggaacagcctagcctgctcttcatgcacaaaatcctttgtctgaaattcacagaagcctctccagacaaagggaaattgttgtgtcttcacttgaaaagtattcggtggacctttactttcatgaaccttttaactctaagaacctgttttcctaatagagtcaaccctaaattgactctgatatcaacaaaaggaatgtaacagtcacacagcaagttaaacaaaggttttcattaattgagcttccttagagaaggctacttttacttcctagcctgagttcctgtgcataaaatgaagaggacattggttggtcaagatgatgtgatggtccctctagctaagaaaatactagaatatggcaggttcgttggtttgtttttgagatggagtctcgccctttcacccaggctggagtggcgcaacttcggctcactgcaacctccgcctccaaggctcaagcgatagtcttgctttagcctcccaagtagctgggattgcaggcacccaccaccacacccggctaatttttgtatttttagtagagatggggtttcatcatcttggccaggctggtcttgaactcctgacctcaggtgatctgcctgtctcagcttcccaaagttctgggattacaggcataagccaccgtgcccagtctatggcaggttttttggatttatgtttcttcaatatctttctacaaagatcagtttctaatagaagccaattaaacatagaaactctaaggtagcatatttcccaagtgttgggaggctttggagctttttagcttcgagttggtgtgcctgatagatgagaaacagcacaacagaaaagctgttcataggatccatgactctagctattgcattttttctcttgcattaatttttctagtgtatttgtaaaacctttttaaaaatatggattcttaattttaaaattaacctggtgcaatggcacatgcccgtagtcctagttacttgggaggctgaggtgggaagatgacttgagcccaggagttcaaggctgtagttcaccgtgatcacgccagtatactccagcctgggtgacagagtgagaccctgtctgtaagaataaaaaatgaaaaaaaaaaaaaaaaaaaaaaagtggattcctagaccccactccaaatgcatttaatcatactcttaaagaatctgtaaaagatctccagataactcttcttgtcgtttctaaatatttaattgccacttgattagaatggaagttgtaagatggaaacatttagaacagctgtggtcagtatttaagggtttcccaggcatttgacatttgttcctctagcatttgacatttaaggtattcctcagtatttggccaaaagttaaatgtgtatcaatacagtttctgcacagcaaagaaacacctttcatatattttagtagacctttataaagggaaagagtacatgttggtttccttataatgccagtataaatataatctttcatatacataatatatactatattatatattaatactatatataataaatctatactacacatattgtatatttatactataggaccaataggtaagacctatagtcctgtactacctgttggtcctgtaggtgtatctattagtgttaggtaggaccattactaaatacagtgtgtatatatactaaatatgtatatttagtattggtcctacctaatactgttagataacgattggatatccctaatctgaaaagctcaaagatcagaaactttttgagcaccaacatgatgctcaagggaaatacttactggagcatttcagattttgagttttttgtgtagagatgttcaacagtaagaatataaatcaaacactccaaattttaattttaaaatactgtttccaagcattttgggtaagggatactcaacctgtaatatgttggcagtgttacccaggaaatttaaccttggtatttcttacctgaaaaatacattttctatttatttcaaatcctctgagcttccactgaaacacagcaaaacacatgccaaaacattgcttttgtatcctcttgtaggttgtactcaatttaaatattagatttgttgaccttttaaaatttgtcaagtatatgagagtatgagctagggtttatatattgaattgtttaagtctgttcagcagttacaatgcagaagtaaaatagtgcttatagattgacgaccgctatctcacattggacagaagtcttctactccataggatcatgacattgacgtaaatcaaatcctcagacaccaaaggaacatttggaaataaattttccatttagggtcataatattcatcattgaacttgtcctctttttgaaatgttcgagggcatgtaggatcaggttaatcatgacaggcagaaatagtgcagtatagggcatgttagctgttaaagaccactaaagtttagaatatagttactttgttgtcttaaatcatctgttagatgtactctcttcaatgtagttagagcagaattatattaaaatgaaaggttctcgttgattcagtctgaatattgctgttcattgcacaagcatttccagcaggaatttcaccttagcttgtgtgtccctgcagtcaaatgcaagggtgatctttgcctgttgagattatatattgacaaactgtgccgccttgtgaccacattgcttacttaggctatagcattgtttttatgcactcaaattaaaaaagtaaaccatattctccctgaacttaagctccgaagtagagaaaaatcagaactaatttgaaggtttaagaagttcagtgttggctgggtgcagtggctcacgcctgtaatctcagcattttgggaggcaaggcaggtggatgcctgaggtcaggagtttgagatcagtctggctaacatagtgaaacgctatctctactaaaaatacaaaaatgaggctggttgtggtggcgcacgcctgtagtcccggttgatcaggaggctgaggcaggggaatcgcttgaacccgggaggtggaggttgcagtgagctgagatcatgccactgcactccagtctgggtgatagagcaagactctgtctctgaaaagaaaataaaaaataagaaattcaatgtttacttcttggacaggagtgctattttgccattttgtatatgactggtaacatgcaattcagtatagagagtaagtctgaaaaatgatttgattttaaaatgccatctgcaagtatgggagaattttcttatgtaatttgtagctgccctttcgtaagacttacaaaccaccttaattatctttcagaaaatcacggacagctgttttgttgttattattgttgttttgagacaaagtctcgctctgtctccaaagctggaatgtagtggtgtgaactcggctcactgcaaccgtctgagtagctgagactacaggcacactaccattcctcccagctaattttttatatttttagtagagacaggttttcgccatgttggccagactggtctcgaactcctagcttcgagtgatcctcccgcctcagcctcccaaagtgttgggattaacggacagctgttttaatgtccagctgctttgtgtgattgtgccactcattcagcagtatttgaataccagcagagggctgggcactattctcaaggtgcatggctttgtctgttacttgggctatgttgtggaatttcactttgtacacacatcaaggaaaggggctgagatttgggccttttaagagctattaaagtaacttgttggcctaggaaagaagactcagttgacttaaagatcttcaggttatgcaagaggtttattattcatttaattgatatttctttttttttttatgagacggagtctcgctctgccgcccaggctggagtgcagtggcgcgatctcagctcactgcaagctccgcctcccgggttcacgccattctcctgcctcagcctcccattaattgatatttcaaaaagtatcaaaggatatatgccccagctgtgcagtgttactagtttgctacaccttcccagaggtgtttctttataccattggaagttgtcattttagtatgaattaattacatgttatacgagcatatcaaagggtttgaaacagtgaaagagctaagattaacttggaaataaacattttattttattttactttttgagatggagactagctttgtttcccaggtggtgtgcacctgtagtccttctgcttgggaagctgaagtgggaggtcaagggtgcagtgagctgtgattgcctcactgatctctacatcctgggtgacagagcaaggccctgtctcaaaaaaaaaaagtggtgttactgtgtagttttattttgcatttgccatgtgtttcgttaattgaatatctttttaaagggggccatttgcttcctgttcacaataatttagcttttttgatggaatgaatcatggcatatacaactttattctctttgctgtgccttgtgtatatgtagtaagacttttacttactgctaagtaggaaagtattctttaaagtgaaagcttgaaggcctgtctgaagatacagagcaaaatttcttagaataatgtagttaggtttccttaagcctcattctcttccttcctaattcaaatcttgaatccatctaaagttttttatgactccaagataggttgatcactttgcttgttttaactgaattttatgtatttgtgttatatgcagatcatttattttctttaaaaattgatttggagacaaattcatctttagataacatagttttaaaagttgctcatttcagccgccttttttttctcctaattagttggtgacaaagttcctgctgatataaggttaacttccatcaaatctaccacactaagagttgaccagtcaattctcacaggtaaatatgatatattaagtcattgaatttctgaagaccttcgcatattccatgccaatagagttggctcttgcctcactgtccctttatggtatcccatcttaatcctctctaagatacttatttcttagtgctttagtctcgctccattgcccaggctggagtgcagtggcgtgattgcggctcactgcagcctccgcctctcaggttcaggcagttctcctgtctcagcctcccaagtagctgggactacaggctcctgccaccatgcccagctaatttttgtatttttattagagatggggttttaccttgttggtcaggctggtcttgaactcctgacctcaggtaatccacctgcctcggcctcccaaagtgctgggattacaggcgtgaaccactgcacctggctgccgatacggttttaaaggcatgatttaaaaacaaaacaaaatggctgggcacggtggctcatgcatgtaattccaacactttgggagactgaggcgggcagatggcttgagcccaggagttaaagacgggcctgggcaacatggcaaaaccccgtatctacaaaaaatacaaaaattagccaggcctgtaatcccagctactcaggaggctgggtgaaaagatcacttgtgcctaggtcaaggctacagtgagccatgcttgtgcctctgcactccagcctgggggacagagcaagactctgtctccaaaaaaaagttgtaatttgttcgttaccataggtaaatcttaaggttgaattgttgtctgttttgtggaaagcaaattacttattcgatgtcctttttccaggcaagaaaaatagactccagtgctgtaatttttttcactggaggagtgctaatgttgtatcaatctttacagtatccaaatacacaatgaacaaaagttagcccccataagagatgaaaattgtactacctggaatttgcacaattgtttgaaacattttcccgtttttgtgtgataaaagcacaatctagggtggagggttcatactaactggaagtaagtttgtcagaagaattaactttaaatacaatgctaacttggattaaatagtaaacataaagtctaaaggctctcaagatttatctgattatcaattttgaaaagcagctaatgtcatggagacagttatatgagtaacctggctctattttttttggtattgtttctttataaatagcttacttattaaaattctcattagcaacaacaagctggaggccaattaagccataaaatgttggagaaatggttgggttatatgtgtgaaattctcatagtgtgccctaaagacgtagttgccatttaaaaaaaatttttttttttttgaggcggagtctcgctctgttgcccaggctatagtgtagtgctgtgatctcagctcactgcaacctctgcctcctggattcaagctgttctcctgcctcagccacctgagtgtctgggattataggcgtgcgccaccatgcccagcttatttttgtatttttagtagagacggggtttcactgtgttggtcaggctggtctcgaactcctgatctcatgatccgcctgccttggcctcccaaagtgctgggattacaggcatttaaaaactttttaggctggtcacggtggctcatgcctgtaatttcaggactttgggaggctgcggcagtaggatcacttgtggccaagagtttgagagagcagttatagtctctataatgaaaatctttttttttttttttttaaagacagagttgcactctgtggcccagtggcgcgatctcagctcagtgcagcctctgcttccggggttcaagtaattctcatgcctcagcctccctagtagctgaaattacaggcatgcaccaccacacctggctaattgtatttttagtagagatagggttttgccatgttgtccaggctggtcttgacctcctgacctgaagtgatcgcccgcctcaaacccccaaagtgctgggattacagacataagtcatcacacccagcctataataaaaaactttaaaagtttaaaaaaaaatttaaacttcatagaggttctcgaatattatctttctttcattaagaaatcataatgtagtttttggctaacttgtggaaccaatttttttggtcaaatattgagagtgaagtttgctacctgtaacttaaagtaacatttagagacatattttactcagattgaccctaattatatatctatgacatgatttttaaattgaaatcagctgggcatggtgtctcatgcctgtaatcccagcactttgggaggccgaggtggggggatcacctcaggtcaggagtttgagaccagccttggccaacatagcaaaacctgtctctactaaaaatacaaaaattagctgggcatggtggcacatgcctgtaatcccagctacttgggaggctgaggctggaaaattgcccgggaggcagaggtttcagtaagccaagattgtgccactggactccagcctgggcaacaaagcaagactccgtctcaaaaaaaaaaaaaaagtagttctttatttaccatgcgatctttccagtacacttgctaattgctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagtgaagccatgtccttctcttataacactaggaattaaagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaaccctgtctctaccgaaaagacaaaaattagctgagtggtggcgtgcacctgtagtcccagctactcgagaggctgagacaggagaattgcttgaacctgggcagcggaggttgcagtgagccaagatcacaccactgctctcaattctgggcgacaagcaagactccatctcaaagaaaagaaaagaaaaaagacaaggtctcattctgttgcccaggctagtgtgcagtgacacagctgtggctcacttacagcctcaacctcccaggctcaagtcctcccaccccagcctcacaagtagctgcaaccacaagtgcatgccaccatgccccactagtttttttatttttttttgtagaggcaggttctcactatgtcaccaggctggtcttgaattcctgggctcaagtgatcctcctgccttggcctcccaaagagctgggattataagcatgaaccaccacactcagcctcctttctaattttcctgatcctctgtctctaggtgtatgttaatagacaagttctagagaaagctgctagttaacctccctacctgaagtcctaattggtttttctatcacatgttgaatgaagcgtgctttttctcaaaaagtagatagtcatctctctgtattcattagagattggttccaggacctccctcagataccaaactctgcagatgctcaagtctctgaaatgaaatggttcagtacttgcatataaccttgttcatcctccagtatacttgaaaacatctccagattacttacagtacctaacgtaatattataaatgatatgtaaatagttaaactgtgttgtttagggatagttaacctgtgttgtttagggaataatgacaagaaaaaaatgtacatgttcagtacagatgcagttattttttccatctgctgtttagttgaccgtggatgtggaacccacaggtacagagggctgactaaaattgcttttaacttgctttattctgtgtattcatcatatatatttttgtttgtttgtttgttcttgttttgagatggagtttcactcttgttgcccaggctgtagtgcaatggcccgatctcagctcactacaacctccgccttctgggttcaagcaattctcctgcttcagcctcccaagtagctgggattacaggcatgcgcccccacgcccggctaattttttgtatttttagtagagatagggtttctccatgttggtcaggctggtctcgaactcgcgacctcaagtgatccacccgcttttgaaagcctcccaaagtgctgggattataggcgtgagcccccgcgcccggccatcctatattttttgaccatcatttgataaaataaataatttaaacctgctgttagaaaagtaacaactgaataaataatgcaataattatacagctggattattttgtataattcactttccttaggttttgcttaaacaacttggtacaagtctattccaaaaggtacacatgactcatacagagtagacatttgtcacatattttattcggctcattaattagcaagggaatctgtatttgaggaagtgttcaatattagaatattagaatagggattgctaggttagattacaaaactaatgtcttacagggaaacctcatataacatgagcatttatttagtaacacagtgttacattttcctagaatgggcttgttaaataatgcttctgtatgatattgaaagggtgtagttatcttggcctttttgtcaggttttagataattatttttaacatcggaaattgttttataatcagttaagccctgtgaatttttatcttgccaattttaagctcatgatgattttttagatacaggttctccctcccccgcaagctccttgtgaagtccaaacccacatttagaattgacagaactggggtgttccaactttcaaagtggaaagcttctaggtttgtcttaggtttctccaggatattaaggtgtttgagctacttaagttcttattttttggaaccaaaaggttggatgaattggctaaaagtcagttttgtcatactggttgtttcaggaagagaaagggaattttcttatttacgattttgtgtctcacttagcctgaaagctttaattcctcagaatagtctttatgtctgtgaaagtaagccatgtgtaaagccatgtgtaaaattgtaatttttaaaatttcagtttcccagttcactataatttttttttgttcttttctcccttgaatggcttggcttaaaatgttttcttataataaagaaaaagcctgcctgttctgagtgaagctctacctcacaacaggaagctggtgctaattggtattctgcaggaggcttcttgcagtggtattgcataactgcccttgacttaggaagattttcatcctgcatatcctaaatggttgacttgctcacagtcaaaaatgtctaagtacatttagatttagctaatgtagattcagattctgaatgtcttttagaatattttgggctttggtatagactcaaagaatttcacatttttggctgggcacagtggttcacgcctgttatttcagcactttgggaggccgaggcgggcggatcacctgaggtcaggagttcgagaccagcctgactaacatggtgaaacctcgtctctactaatattacaaaaattagctgggcatgttggcaggcgcctataatttctttgggaggctgaggcaggagaatcacttgaacccgggaggcggaggttgcagtgagccgagtcgtgccattgcagtccacccagcctaggcgacagagtgaaactccacctcaaaaaaaaaaaaaagttattttaaaataaagattaactaatttccttattgaatgtgagatgaattgctctgaaaagatgtgtttttaaaacacaacatagctttgttgttgctgttattacggagttttgctctgtcgcccaggctagagtgcagtggcgcaatctcagcccactgcaacctctgcctcccgggttcaagcacttctctccctcaacctcctgagtagctgggattacaggtgcccaccaccacgcccggctaatttgttatatttttagtagagacgggtttcaccatctttgccaggctgatcttgagctcctgtcctcatgatctactcaccttggcctctcagtgctgggattataggcgtgagccaccgtgcccagctcaacgtggcctgtttaacttgagttttacattttttaaattccccttagagaatgatttgatcagattattaattgctcatatttcagagaaagcacgagaaaatatagttttgacatcactttctgtaattttttctttttagaggaggttttacaagttttcatttgcaatgaaaacacaagcctaaatcttacttttccaaactgggcttctgaattataatttgtgaatgcaaatcaagcagtggaaaaattatctttaagaaaatagcttatgtcgctttaaaaaataaaattaatcctttcctaagcatgcttccatctgtattgtctagggaacatcaattcattcagctctgcgggctccttactgtatacatatagttatgcagcttcatagaacatgagctattgccacaataaaaataagtgggaaggagcagagaagcagtttgtcttattttactcgggaaatgtttatgcaactctgaaatgtgagtttattcttcccaagcttttgtgcttagctctaaggcaggactacctaataccactctcacagccagccatttgaaatttgggattctgagcaatctaaagagtaacttgtctctggaactgaccttttgctgaccgggagtcctcataacttggattttgtgtgggttgttgtgtctttggtgccactgctgctcattcattcagcacctcagtgatgctgtttttcatactgttcgattggtcgggggtgtgatgggcgaagcagtctaatataattaagctagttagggtaagggacagtactgctgatgctgagtgagcctcagtgagttttattaaagttgttttcgtaaatgaaagaggttgtttgcctttgtcctaagctaacaaaggtagtttatttgtgtagcattttttaaaaatcccttttaaatactctgatgcgctctccccctacagatgttcattctggacagagtggaaggtgatacttgttcccttaatgagtttaccataactggatcaacttatgcacctattggagaagtgtgagtaaccctcctcctcatttaaaggatctggtgtggcagtttagtatttgtattgatttgcagcatgtctacaaagttaagacagctttctgaatgtggctcaagtcaacacttattactaaagtagtaaatgtttttaaaacaaaaactttgaaagatgaaccaaaggttataatccagtcatctttttgcatcttctgggctccaaactttcaagagggatttgtgtttgttattcactgtagccagtggtggaagaattgaattaagaatttctggtctttttactgattgatttctgataccagagatgcattctctcttttgtttttgtctaatattggctctggcatcaaattgtttggaattttttccagtatgttgtcccagaaattctgttttcattattaaacaattgcgggggggcagggggcgggaggaatcaatagtggcgaccataccctgctctaagagtgttttctctttgggcaggcataaagatgataaaccagtgaattgtcaccagtatgatggtctggtagaattagcaacaatttgtgctctttgtaatgactctgctttggattacaatgaggtaagtctcttcataaattagaaggaatggctgttcctagttcaagggtggggtgggtggaatgaaagtctagcctgccttcctcccttttgaaagtcaagggtgcctgattttgtttcccccttccattcagaacctgatggtggggccagcatgacctcaccaaagaaagctgagagcctttcacatatcctctgtgactgagcattgcagttagttaacttaaagttgtagtatatgtgatgttctttctgttgatagcatacttactataaatgaataaaacccaggatagaaaatgctttcctgaaagcaaaggatatagtttctgtctcaaaggtaagctagtccctgtcagagacagaatgtgaactcttcagaatgataagcagtgacatggaattacattattatgtgaaggcactctttgaattaatagtgtgatcagtggcttcttatatttgggtgaaataataaatactgtgtttgatgtcatcttatatttaagggaaatgaaaaacctacttattagaataagatcacatgcacacctgtactttgagtatgtttttaattatctgggtcacctgtttcagaggaggataaaaatggccttacagtgttgtaatagaggacagattgtgcttttgtggaaaaaaaatattaaagataaatttatctgtgtacttctcccttttttctactttctgtgcctttaaccaatacaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtgagtatttgaacctggtttattgttcatgctgcttatcagtcgtactatatatacttagtgtctgcactgtcctactctcttagaaaactaattataccttatctcctcaaacttacagtatttccttccccatattcactctcaggtaagatgctcttcctgtgtatttgaccaggaaaataaaagcaatcaatagctaatttccttgagcgaccctctgggcccacaggggctgccttctcccatagtgctgtgaacagtgttcttgctcctagcagaagccacctcctcccaacatctttgctgcattattgatttccatctctactagatgttcttcagcatagggggaaataatagtgtctttctatcttgaaactttcctttgaccttatttcccctgtcagctaccacactttcttttcctgttcaattaaaccttttttttttttttttttttgagacagagtttctctctgtcaccagattggagtgccatggcgcgatcttggctcactgcaacctccacctcccaggttcaagcgattctcctgccttagcctccctagtagctgggattacaggcacacgccaccacgcctggctaattttttgtatttttcgtagaaaggggtttcaccatgctagccaggctggtctcgaactcctgacctcaggtgatccgcccacctcggcctcccaaagtgctgggattacaggcatgagccaccgcgcctgggcatcaaacatttcttaactcatttgatgagaccagcataaccaaataccaaaggtcaatgtggtgatggtggtggcagtggcagtggcagtggcagagggcacccacattgttcatgtatacactgaacaaataagtggcctctgagcctttttctgcctgtcagagtctttgagacagggctcattcgaccagcatcactatgacaagggccagtagcaaggatggggagtctccacagtgagttggacctgagtgaggttcctctcaaagagctgctgctccctcctgccaagaccaccatactggacctgtcctgcagtactgcccttagatttctgtggcctcacaagcccggggagcctagacctcagtagaaacactttgcaacggctgctggtgaagaatggccatccattgagtctctagcacctgggtctcctcaaaagactggtccccctgcctgtcacttggctcagcttaagaacttgaagtggaccaggcgcagtggctcacacctgtaatcccaacactttgggaagctgaggcgggagagtcacttgaggcctagagtttaggttgcagcatcactgcacttgagcctgggcaacagagtcagaccccatctcaaaaaaaaattaaggcctgaagtggctaaacttgaaggataactccctttatcttatcctggccaaagtggtagatgattgcttggatgagaagtgatatgcagataagatgttgcaatacacaaagtctgtgtgggtcagtcggtcacgtgggtgccaaggacaggtgggagagaagaagcaagctacagaagcagctcaagaatgggaactgcggaagctgattgtattggaggaaggagtgtgatgctctcagagcagccagggaggagcagaaggagcttagggacgtaagtcaggctctcaaagtctatgtctggttcctgcccccacaaaccaccacccaggaaacatcattcctgagctgtgtggcagcagcagcagctgctccttttatatggcagacagggtgattgcttgttgggcaagagccctcctacactatcttagagtgaataccctctatctgcagtccagggtctgcacagccacatggtcctctaataggtccaccagaccatttgcctgcaaacagcctcatcctcagtgcccactgtctcctagctgtggagcttggattcctatggaattgggttctgctgaacatacctctttttagcatcagacctacctgtctgtcatcaccatggggctgccagtcagtacttttgcagcctctttataggacattgttgtaacttagggttccctggtagaataaggagcgatgggaaggggagaggttctgcctgcctgaaggaacaggtctgggggaggagagaggtaaaactcagccttttctagttgtcatacacagctgtataaaggcaagcctcatttagcaaaatgattagttgtcaccacgtttaatgctttttgtatgtcataagccctttcatcccttcctggataataagggcaaatgaggaggcattgtgtcattggggggtagtacagcctgagttgggagggagcagtatacctgttttcttaataacctcaaatatcaggcattttagtgaccacacaaaatctcagggtgaaaagttctagaccatcatgtccagcctgcagttagggacacctagcccttccatgacctgtatggcgtggtcttccggttagtgtgaggcagcattttgtctcctttatactgtcctgagaaaacaaaactcacactggaattgagactgtctcagctgaaatatagattccttttcagtaaactgatgcacaattcacaaatagcagtctcaaagccatgaaggccttggaccactcctttggcttcttccctctacccatgtgtcttccatgaacccgaagcagtccaggcttattcactctgccagtaagcaaggagttggatcctggcagagccacgctgcctgtgatctattagttggtgtaactaaaaatctgaggcagcctgaaaacagcttcacagattgagggtttgagtcgtttgattctagacctctgactactccactgagtgatgggaaacaagtcatgtaatggggctgaaccagcactggctcactagccagtgaccacacaagtacgggcaatactgtcatccttgtgtctccctgctccagagctcccttgtcccatctttttcacatcccttggccaagggatcggaaacagctgtcatgctgctcattcactaaggagttccaaacacaagctctttgcctcccttcccacttgagacagcaggaacccatgtgtagtttagaagcagagagagcaggtccagcattttggccccatggcttgtttggtgaggtctgtggttcttggccagcctagtactgaaagggatttccctcccccactcccagcccaagacctcttacctgggtaggtccacgccttcctcagaatcattgcgtgttcctttagtcatcccagtgccattggcgcaaatgcttaattgaaactaaacacacgtgtgattgagatgatacagaatctagcgtagcactcatacccattcctttgctgcctgagacggttcagtggctggcaggccagcaggatcgctgcagggccctgagccccatctagtcagttcatcagccttcagtcctcccgtagcttcctaggttagatgctgatgttcttggggatttctatgatgatttttaaatgtgtgtcagtgggagcaaatataattaactcaccacattaaccaaattaaggtggaaaaaacaataaggtcacctcagtaggtgcatatgatgaaacgcatcttatcacaccaaactaagactataaaagtgtgtctttaacgctgacagtgtgtttacacagagaccatgctaacataacagaattctcaccatttctatgcagtattatactggcattcctggtctgtgtaataggcaagaaaagtacaaaaactggaagagaaggggtatctttagttgtaggtaacgatataaagccaaaggtttattctcagtcttcgtcttcctattttgttggtgctgtcactcgctccctctttgaagcacctcttcacttggcttccacgatcccatacttgctctccctccctggcctctcattcgaggtctttgtagctgggtctttcacaaggcaccaggaggtgaaggctccatagtcctcagccatttctgtctatagttactcccatgatctcttctggtctcattactataatcagtagccactagctatctaaaactacttagaatacctaaaaacacttccttagatgccctagccatattcacttaaagtgcttatccatcacgtgtgacagccacatgaacagtggccacagagcattgccatctttcacagagttctggtggacagctctgcttggggccatctcttcacctccaacgttccctagtttaagtcagtgtcattatactgaatggtattccttgtctcccttcagccaatgcttttgttttttgagatggagtttgctctttcgtccagggtggagtgaagtggcgcaatctcatctcactggaatctctgcccccctggctttaagcagttctcctgcctcggcctcctgagtagctgggattacaggtgcctgccaccacacctagctaatttttgtagacagggtttcaccatgttggccaggctggtcatgaactgctgacctcaggtgatccactgcacccgaccaccttcagccaattcttgacaactggagcttgagaccctccgttgtcttctgttttacttgtcttaaaagccaaatgccccataatgacttttgaggtcttaatgacctgcttctaccatcctctgccattacctgcctcaccttttgctcatgtaaactctattccagccacgttggcactcctttaccattccaggacttgccaggttgcacttccgttctctgcctggtgggtcttcaccaccacccactgggttcacacacatcttttcaggccccatggggccatctttattcaaatgtcaccgccttctggccactttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaattctcagtgtggtggtgactgttctgtgggagggggactgatgggcaccaagggcctccactccgcacccgggcctgcccctctacagggaagcaggggaggctcagtctgggcagggtggccatgtgactagaggggacaggaacctcttggactcgacttcacagtagacaggctgactggcagcaggtccgcccatgtgaagcccaccctggctccctaccctttaaggatgggggaagctgagtgtgtgttaccagtggggtcttaaacacacaaggcctcactcgtcagtgtggtgaagaaagccaagactccgcgctctccattgttagcagcctggaaagatctggagactagcaatggagagatgtttcttaggctgttcagatccaaaacttccacattccccgttgttgataggtatgggatggagaggtgaacagaactgaagcagctgttggaattcatttgctggttactttagtgcttatttggcagtgatgggtttgggattgggtttttggttttgcacattccctaagatgattctttatcactttaaaaaataccaggatacaaggatagctggatgattctataaatctaatttttaaaactatcagttctgggtaggcacggtggctcacgcctgcaatcccagcactttgggaggccgaggcaggcagatcacaaggtaggagatcgagaccatcctggctaacacgatgaaaccccgtctctactaaaaaaaattgccgggtgcggtggctcacgcctgtaatcccagcactttgggaggccgaggcgggcgaatcatgaggtcaggagattgagaccatcctggctaacatggtgaaaccccgtctccactaaaaattcaaaaaattagccgggcgtggtggtgggtgcctatagtcccagctactcaggaggctgaggcaggagaacggcatgaacccgggaggcggagcttgcagtgagccgagatcgcaccattgcactccagcctgggtgacagagcaagactccgtctcaaaaaaaaaaaaaaaaaacaacaacgaaaatacaaaaaattagctgggcatggtggcagttgcctgtagtcccagctactcaggaggctgaggcaagagaatgaatggcgtgaacgtgccactgcattccagcctgggcgacacagcgagactctactgatcagttctgctgatggagaaaaaaaatttgataaaatttaacatccattttctaaaaattattcctatgtaccatttattattagaaaccaaaagtgttaacgctttagagttgcattccaagtccactcttgcccactaccaaacactgttctagaggtgctagtcagtacaatcgggcacgagaaggaaaaaatgccttggaatgaacaaaaagcgatcaggggtcatactgggtcaatgttcctagacaggaactattttgttcctagttagaaatgtttaatgattcagggaaaattgacagctgaatgggagtgacatataattcatactgatatatgagaataccaatggtggccttaggccaatcctaacaaacatcaggcagacaaaaaccaaggaagcacaccaaacctcttaaagctatggtaattcagtgcatcacttgagaagggtggtgtttcagcttagtaggtaatagttggattattatgtggggggtcatcttgagaaaaataaagctgtatcccttacacccaataaattgcaaacggatcaaaatacttggaaaatgcaactatacccccaaaagaaacatggttaaatggtgtaaacgagagaaaacaaatagctcatgtgaaaagatgctcaactccactggcaaattaaaatcacgaggtaacgtctcgagaagtgggtcttctgatgccaaggatggagcagcttgcgaggatgaactctagggaatgaccgaaatcactcagcctagaggtgttctcaacacccttacccctgcccccgccccaagcaggtccactcctagagaatctcacacatggggaagagccacagcagagtttttggagaaaaatgaaaccaccagcaggaaaatgggtgagtacattcaggcatattcagatgatgctcagctatgaaataagctagaactacgttatcaacctaaataaatcctgaacagtgaagccaagtgcagcaacatatcaatatgcacaataccgcctcatatcctctaaacgtggcccacgggccaggctggctgagagaaagtgtgtacaccagagtgtacatcaacgtggactagtaccaaacagattggtaatgagtttgtggacatcagccagaggctgtgaaagcccgaatcgatagtggttaattcagtgagggagaggggcggagacgaggaaaggcagatactgctttacctatcagtaaggaaagtatagacagaggtgttcattatgcctgtttgcgtgtcagattttcatttttggggagggtgggaagtgacagtgtcccaggctggggtgcaacggtgccatcatggcttgctgcagcctcaacctcctgggttcaagcgatcctcctgcctcagcctcttgagtagctaagactataagtgcacactaccacacctggcaaattttataatttttggtagaaatgggatcttgctacttgcccaggctggtcttgaactcctggcctctagtgaccctctcatgtcagctcccctagtcgctgggattacaagcataagctaccacacacagctctcagatttttaaatatctatatcctttgatcaagaacttcactttcctgaaatcctcccatatgttcaaaaagtataatccctactgcactcttgtagcagaagagtggaaataagctgatgttcatcaagaggcaagaactgaataaggtagagagcattcaaaccatggaataccgtgcagcctttgaaaaagacaaggtacacgtgtgtacgagcaaggaatgatgtctgatatacgttgtctgcccagggaaatattcaattacagagcagtttgtattataatctaccattttttagaaacagaaggaagttaacagtttctagtaatgacagttgctgagaataacaaaatgctgcatatagatggcagatggtggaagccaggtctctctgttggagtgggaggaagcagaggaagcaaggggagaagctaagataagcaaggggaggaagctagaataatccatgtggtaatgaattagagccggagatatcaggatgaagtcatgtttagcttcatatgtacggatggtttcatatagaaacactgatagtggcgaggcacagtgactcacgcctataatctcagcactttaggaggctgaggcaggaggatgaggagcccagcagtttgagaccagcctgggcaacacagtgagaccccacatctacaaaaaattttaaaaattagccaggcatggtggtgcctgcctgtagtcccagctactctggaggctgaggcaggaggatcacctgaacccagcaggacaagatcacaccagtgcactccaccctgcacgacgcagcgagagcctgtttcaagaaaaggaaaaaagaaaaactgctgactgtgatgtgtatatacactggtcactacacacatgcatttccttgtactgtcagctcagaaggcaatgaacacacttggcttccagtgttaggtttctaatgccattctccagtaaaaaagggctccttggagaaatggctgattctagagatgggacagaaaacgtacagtacgtgcctgaagaataccaaagcaccagaaaggaagggctcaaaaacagcaatcaaagatgtggttatgtgaaaggaacacaggagccaactgaaaaagccacaacagccgaagaatgtgagcaacaaaataaagcagtattggactagaatccaaagtataaatatccataagtccacgctgacataaacaaataaataaatgggggtgactacaaatcttccatgcagaattccaagtaatttacatggacactgcctcaggaggtggagactcacctcctctgtgggctgtgcaatgttccaaagagtacatacagtagggatgggaaagtgcccgtcactgtggagacctgacatgctacctcagccagggggcgtcatcttgaaagcatgggcccttgatctgaagtgatgaaaatggcattttacctttgtggtcttcctctcaaaatacacaacctcagtctaatcatcatcagaaaacacctgaccaatccccaaacgaaaaatccctgactggtattcctcaaaactgttgaggtcatcaaaccaggaaagtgagaaaagtataatcatcagaatgtaaaaacgaatggggccaggtgcagtggctcacgcctgtaatcccagcactttgggaggccaaggtagttggatcacttgaggtcaggagttcaagaccagcctgatcaacatggtgaaaccccatctctactaaaaatacaaaaaaattacctgggcatgatggtgcatgcctgtaatcccagctactcaggaggctgaggcaggagaatcgcttaaacctgggaggcggaggttgcagcagtgagccgagatcaagccactgcattctcggctgggcaacagagagagactctgtctccacaaaaaaaaaaaaaaaaaggccgggcgcggtggctcacgcctgtaatcccagcactgggaggccaaggcaggtggatcatgaggtcaggagattgagatcatcctggctaacatggtgaaaccccatctctactaaaaatacaaaaaaaaaaaaaagaaagaaagaaattagccaggcatggtggcgggcgcctgtagtcccagctactcaggaggctgaggcaggaggatggtgtgaacccaggaggcggagcttgcagtgagccgagattgcaccactgcaccccagcctgggcaacagagggagactccatctcaccaaaaaaaagaataaaaaaaaggttggccagcctgggcaatatagtgagacctcaaatcggcaaaaaatttaaaaattggccaggcaaggtggctcatgactgtaatcccagcactttgggaagctgaggagggtggatcgcgaggtcagcagttcaagaccagcctggccaagatggggagaccccgtgtttactaaaaatacaaaaaaaaaaaaaaatagccaggtgaagtggcaggcacctgtaaacccagctacttgggaggctgaggcaggagaatcgtttgaacccggggggcgtaggttgcagtgagcagagattgcgccattgcactccagcctggctgggcgattgagactccgtctcaaaaaaataaataaataaaaattaaaaattatcctggcatagtagcacatgcctgtagtcccagctactgaggggcccaaggcgtgaggatcacgtgggcacaggagtttgaggttacagtgagctgactgcaccactggactctagcctgaacacagcaagaccctgcctgtcgcaaaaaaaaaaaacaaaaacaaaaacaaaacaacttcatggttggatgtggcatcaaaattgacacagcaaaataatgaatgaggctgggcgcggtggctcacgcctgtaatcccagcactttcggaggccaaggcaggcagatcacctgaggtcgggagtttgagaccagcctgaccaacatggagaaatcccgtctctactgaaaatacaaaattagcccagcctggtggcagtagcctgtaatcccagctacttgggagactgaggcaggagaatcacttgaacccgggaagtagaggttgcagtgaaacgagatcgtgctattgcactccagcctgagcaacaagagcgaaactctgtctcaaaaaataataataataataatgaaatggtcgatgagaataaattaattagaatgcagcagaaggtgagggtggggagaaaaggctagaaaacatgcaggaaaggtaagatacctagaagacagactgagaaaagcgacaaagtcaaatatacatttcactaccttcaaaagagggccaggcacagtggctcacgcctgtaatctcagcactttgtgagactgaagctggaggatcacttgagcccaggagtatggaacagtctcggctacttgggaagctgaggcaggaagatcacttgaggccagaaggtggaagctgcagtggccatgagtataccactgcactccagcctggaccacaggcacatgctgtcacatctggctaattaaaaaaaaattttttttactgggtgtggtggcgcatgcctgtgcagctactcgggaggctgagatgggaggatcacttaagtccaggatacaggataactaaaaagaaatccaggctaggtatggtggttcacacacgtaatctcagcactttgggaggcccaaggtgggagggctgcttgagcccagtactttgaaaccaacctgggaaacagcaaaaaaccatctctaccgaaaaaaacaaaaacaaaaattaggtgggcatggtagtacattcctatattccgcattcccagctactttggaggctgaggcgggaggatgtcttgagtctgggaggcggaggttgcagtgagctgagattgcaccaccgcacttcccagcctgaaggacagagccagatcctatctcaaaaaaaaaaaaaaaaaaaaaaaaaaaaaaagagagagagaagtcaatcattccagccctagtaataaactgcagaaaaccaaagaaaatcttaagagcagtgggggacggggcagaggtaaatatcatcttcaaaggagactgacattacaacagtaacaatgaaagccagaaaccaacgggatggcagcttcatgtgctgaaggcgattaatggcaacctggagagagtatgtagtatttaagcatatagtattcagggtgaaataaagatatttttaggcaaaaacagggttcaggccgggcacagtggctcatgcctgtaatcccagcactttcagaggccaaggtgggaggaccatttgaggtcaagagtttgagaccagcctggcccaacatggtgaaaccccatctctactaaaaatacaaaaactagctgggcggtagtggtgcacatctgtaatcccagctactcaggagtctgaggcaggagaatcacttgagcctggaagatggaggttgtagtgagccgagatcataccactccagcctgagcaacacagtgagaccctgtctcaaaaaaaaaaaaaaaaaaagaaagaaaagaaagaaacagttcttcatcagcagacccacactaagggaaactccagatggggtgggtgtaaacagaatttaaatgatctgagagcttttgtcatccaagaggacagacagtaaagacatcagttaactttaggtgtggatatgttaaataaatacattgcaattcctaggataaccactaaaggaacagaaacacaggccagactagcatgctgcctgaaggaaaaaaaggaacctaaaattacagaatagcaaggataagatgatagattccaaccccaaatataatcaataacaacgttttaagaatatactaaatatgttattcctgttcctctattacaagagaatgattttagcatggctgagacattcctattttggaaagcaatctgtacatttttttttttttttttttgagacagagtctcgcactgttgcccaggctggagtgcagtggcatgatcttagctcactgcaagctccgccttccaggttcacgctattctcctgcctcagcctcccaagtagttgggactacaggcacctgccaccacgcccagctaattttttttttctgtatttttagtagagccaggtttcactgtgttagacaggatggtctcgatctcctgacctcgtgatccatccgcctcagcctcccaaagtgctgggattacaagcatgagccaccgtgcccagcctagcaatctgtacttctgacaggactccctgcagggggaggagagaaaaacatgtccagtagtcagccagtgagtgttggtaaagtttaaattggatgtttttccatcaaaataagtagaggctgggtgcagtagctcacacctgtaatcccggtaatttgggaggccaaggcagaaggatcacttgagcccaggagttcgagaccagcctgagtaacatagtgagaaccttgttgctacaaaaaattagccaaggccggacacagtagctcatgcctataatcccagcactttgggaggctgaggtgggcagatcatgaggtcaggagttcgagacaagcctgatcaacatggtgaaaccccatctctactaaaaatacaaaaattagccaggtgtggtgcacataagtagcaatcataaaaatgtattttgtaagtttggaaattactgggcgacagagtgagactccatctaaaaaaaaaaaaaattagccgagtgtggtgacgtgtgcctgtagtcccagctactagggaggctgaggcaggaggatcacttgagcctgggaggttgatgctgaagtgagccacgatcacgccactgcactccagcttgcacaagagtgagaccctgtctcaagaaaataaataagtagaaatcataaaaatgtgttttttaagtttggaaattactcaaaatgccttgatttgtgactaagaatgtacaaactttaacatttatttttttttatatttatcaatcataacctgtttaagaaacagattctattgaaaactgggacttaaccaggcacagtgtctcatggcacaatctcggctcactgcaaactccatctcccaggttcatgcaattctcctgcttcagcctcccgagtagctgggattacaggtttacatcaccatgcccagctaattttttgtattttcagtagagacggggcgcttcactatgttggccaggctagtatcaaactcctgacctcaggtgacccacccgcctcagcatttttttttttttttttgagacagagtcttgctctgtcgcccaggctggagtgcagtggcgcaatctcagctcactgtaacctccaccttcggggttcaagcaattctcctgcctcagcctcctgagtagctgggattacaggcacgcgccaccacgcccggctaatttttgtacttttagtagagacggggtttcatcatgttgatcaggctggttttgaactcctgacctcatgatctgcccacctcagcctcccaaagtgttgggattacaggcgtaagccacgatgcctggccacagttttttttttaattacagggtctcgctatgttgcccaggctgtagtgcagtggctattcacaggcatgatcccaccaccgatcagcacaggagttctgacctgctccgtttctgacctgggccagttcacccctccttaggcaacctggtggccccccactccctggaggtcaccatcttgatgccgaacttagcgcaaacacccgattggcatagtgcactgcagcccagaactctggggctcaagcgatccttgcacctcagcctcccaagtagctgggactacaggcacacgccactgtgcctggcaaaaaaaaaaattttttaattagccagatgtgcaggcacgtgcctgtggtcccagctaagtgggaggctgaggtgggagaatggtttgagcccaggaggttgaggctgcagtgagctgtgatcatgccactgtactccaacctgggtgacagagtaagacactgtctcaaaaacaaaaaaagaaaaaaaaaatgagagttttggctgggtacggtggctcaagcctgtaatcccagcactttgcgaggccaaggcgggtggattatctgaggtcaggagttcaagatcagcatggctagcatggtgaaaccccgtctctactaaaactacaaaaatttgtccggcgtggtgacaggcacctgtaatctcagctacttgggaggctgaggcaggaaaatcgcttgagcccaggaggcagaggttgcagtgagccgagagtgcaccactgcattccagcctgggcaacagagcaagacttaaaaaaaaaaaagactttactttttataaactctgctgatgaactgtgcaaatacaaaaggggggtggcatatgcatatccacttatgtgatttcaaattatttctggaaaaatacatgagaaactagtaactatggttccttctagagaggcaactagaaggcaggcagggtggggaaatttcataatttccctttttgaaaattgctgtctagtctatttagaaagaaaaaaagaaaactgctctgacttattatgtgtgaatcttaaaaggatatatatataggccagggttaatggctcatgcctataatcccagcactggcaggctgaggtgggcagatcacttgaaggcaggagcttgtgaccagcctggccaacatagcgaaatcccatcactactaaaaatacaaaaaaattagctgggtgtggtggagcatgcctgtaatcccagctactcgggaggctgaggtaggagaaacatttgaacctgagaggaggagattgcagtgagctgagatcatgccactgtactccagcctgggcaacacagcgagactctgtctcaaaaaataatactaaaaaccaataaaattggatccctacatcacaccatagagagtacattttgaccttgagtaaggaaggatttcttaagaattgtaaaacacgggccgggcacggtggctcacgcttgtaatcccagcactttgggaggccgaggtgagtggatcacgagatcaggagatcaagaccatcctggctaacacagtgaaaccccgtctctacttaaaaaaaaaaaaaaaaaaaaaaaaaaaaaattagccaggcttggtggcacacacctgtagtcccagctactcgggaggctgaggttgcagtgggcagagatcgcgccactgcactccagcctgagggacagagtaagactccatctcaaaaagaaaaagaattgtaaagcacaaccataaagaaaaagattcaactatattaaaattaagaccctctgttaaccaaaagataccacagagaatgacaagccataaactggaagaagatattgccaactcatgttcgaaattgtatctagaatatacaaagaatgactatgaattaatgagaacaagataatccaatagaaaagtaggcaaaacaacaggaatttcagagaagaggaaatcattcctctgcaaaatcgttactaaatatataaaatattgttcaatattattacaaaacaggaaaatctaaattacagtaactatgtcatctcacacacagtgtattggagaaaattaaagattgataatacccagttagtgaggaaatggaacaaagtgctgcaggtgagcatgttgatttgtacattatatatttctgtaaaaataaaatacatagcagaagcagtttgaaacaaaaagttagaaaaaaaagtccatcaacagaataaaatggataccttatatccacgcagattcttatattgcaatgaaaactgaataaggcaccctacaaaacccttgacgagtactcctcaaaactgacaaagttagtaaaaacaagtgtgagaaactgatagccatgaggagcctaaggagacatgatgactatgtaatgtggaatcttagatgagattctgaaacagaaaaaggacattaggaaaaaaactgagtaaatctgggccaggtgtggtggcttatgcctgtaatcccaacactttgggaggccgagacaggtagatcacctgaggtcaggagttcgagaccagcctggccaacacggcaaaaccctgactctactataaacacaaaacattaactgaaggtggtggggggaggctgaggcaggagaatcacttgaacccagga

SEQ ID NO: 2 - DNA, 93866 bp, Homo sapiens
tcctgggttcaagtgattctcctgcctcagcctccccccaccaccttcagttaatgttttgtgtttatagtagagtcagggttttgccgtgttggccaggctggtctcgaactcctgacctcaggtgatctacctgtctcggcctcccaaagtgttgggattacaggcataagccaccacacctggcccagatttactcagtttttttcctaatgtcctttttctgtttcagaatctcatctaagattccacattacatagtcatcatgtctccttaggctcctcatggctatcagtttctcacacttgtttttactaactttgtcagttttgaggagtactcgtcaagggttttgtagggtgccttattcagttttcattgcaatataagaatctgcgtggatataaggtatccattttattctgttgatggacttttttttctaactttttgtttcaaactgcttctgctatgtattttatttttacagaaatatataatgtacaaatcaacatgctcacctgcagcactttgttccatttcctcactaactgggtattatcaatctttaattttctccaatacactgtgtgtgagatgacatagttactgtaatttagattttcctgttttgtaataatattgaacaatattttatatatttagtaacgattttgcagaggaatgatttcctcttctctgaaattcctgttgttttgcctacttttctattggattatcttgttctcattaattcatagtcattctttgtatattctagatacaatttcgaacatgagttggcaatatcttcttccagtttatggcttgtcattctctgtggtatcttttggttaacagagggtcttaattttaatatagttgaatctttttctttatggttgtgctttacaattctttttctttttgagatggagtcttactctgtccctcaggctggagtgcagtggcgcgatctctgcccactgcaacctcagcctcccgagtagctgggactacaggtgtgtgccaccaagcctggctaattttttttttttttttttttttttttttttaagtagagacggggtttcactgtgttagccaggatggtcttgatctcctgatctcgtgatccactcacctcggcctcccaaagtgctgggattacaagcgtgagccaccgtgcccggcccgtgttttacaattcttaagaaatccttccttactcaaggtcaaaatgtactctctatggtgtgatgtagggatccaattttattggtttttagtattattttttgagacagagtctcgctgtgttgcccaggctggagtacagtggcatgatctcagctcactgcaatctcctcctctcaggttcaaatgtttctcctacctcagcctcccgagtagctgggattacaggcatgctccaccacacccagctaatttttttgtatttttagtagtgatgggatttcgctatgttggccaggctggtcacaagctcctgccttcaagtgatctgcccacctcagcctgccagtgctgggattataggcatgagccattaaccctggcctatatatatatccttttaagattcacacataataagtcagagcagttttctttttttctttctaaatagactagacagcaattttcaaaaagggaaattatgaaatttccccaccctgcctgccttctagttgcctctctagaaggaaccatagttactagtttctcatgtatttttccagaaataatttgaaatcacataagtggatatgcatatgccaccccccttttgtatttgcacagttcatcagcagagtttataaaaagtaaagtcttttttttttttaagtcttgctctgttgcccaggctggaatgcagtggtgcactctcggctcactgcaacctctgcctcctgggctcaagcgattttcctgcctcagcctcccaagtagctgagattacaggtgcctgtcaccacgccggacaaatttttgtagttttagtagagacggggtttcaccatgctagccatgctgatcttgaactcctgacctcagataatccacccgccttggcctcgcaaagtgctgggattacaggcttgagccaccgtacccagccaaaactctcattttttttttctttttttgtttttgagacagtgtcttactctgtcacccaggttggagtacagtggcatgatcacagctcactgcagcctcaacctcctgggctcaaaccattctcccacctcagcctcccacttagctgggaccacaggcacgtgcctgcacatctggctaattaaaaaatttttttttttgccaggcacagtggcgtgtgcctgtagtcccagctacttgggaggctgaggtgcaaggatcgcttgagccccagagttctgggctgcagtgcactatgccaatcgggtgtttgcgctaagttcggcatcaagatggtgacctccagggagtggggggccaccaggttgcctaaggaggggtgaactggcccaggtcagaaacggagcaggtcagaactcctgtgctgatcggtggtgggatcatgcctgtgaatagccactgcactacagcctgggcaacatagcgagaccctgtaattaaaaaaaaaactgtggccaggcatcgtggcttacgcctgtaatcccaacactttgggaggctgaggtgggcagatcatgaggtcaggagttcaaaaccagcctgatcaacatgatgaaaccccgtctctactaaaagtacaaaaattagccgggcgtggtggcgcgtgcctgtaatcccagctactcaggaggctgaggcaggagaattgcttgaaccccgaaggtggaggttacagtgagctgagattgcgccactgcactccagcctgggcgacagagcaagactctgtctcaaaaaaaaaaaaaaaaatgctgaggcgggtgggtcacctgaggtcaggagtttgatactagcctggccaacatagtgaagcgccccgtctctactgaaaatacaaaaaattagctgggcatggtgatgtaaacctgtaatcccagctactcgggaggctgaagcaggagaattgcatgaacctgggagatggagtttgcagtgagccgagattgtgccatgagacactgtgcctggttaagtcccagttttcaatagaatctgtttcttaaacaggttatgattgataaatataaaaaaaaataaatgttaaagtttgtacattcttagtcacaaatcaaggcattttgagtaatttccaaacttaaaaaacacatttttatgatttctacttatttattttcttgagacagggtctcactcttgtgcaagctggagtgcagtggcgtgatcgtggctcacttcagcatcaacctcccaggctcaagtgatcctcctgcctcagcctccctagtagctgggactacaggcacacgtcaccacactcggctaattttttttttttttagatggagtctcactctgtcgcccagtaatttccaaacttacaaaatacatttttatgattgctacttatgtgcaccacacctggctaatttttgtatttttagtagagatggggtttcaccatgttgatcaggcttgtctcgaactcctgacctcatgatctgcccacctcagcctcccaaagtgctgggattataggcatgagctactgtgtccggccttggctaattttttgtagcaacaaggttctcactatgttactcaggctggtctcgaactcctgggctcaagtgatccttctgccttggcctcccaaattaccgggattacaggtgtgagctactgcacccagcctctacttattttgatggaaaaacatccaatttaaactttaccaacactcactggctgactactggacatgtttttctctcctccccctgcagggagtcctgtcagaagtacagattgctaggctgggcacggtggctcatgcttgtaatcccagcactttgggaggctgaggcggatggatcacgaggtcaggagatcgagaccatcctgtctaacacagtgaaacctggctctactaaaaatacagaaaaaaaaaattagctgggcgtggtggcaggtgcctgtagtcccaactacttgggaggctgaggcaggagaatagcgtgaacctggaaggcggagcttgcagtgagctaagatcatgccactgcactccagcctgggcaacagtgcgagactctgtctcaaaaaaaaaaaaaaaaaaatgtacagattgctttccaaaataggaatgtctcagccatgctaaaatcattctcttgtaatagaggaacaggaataacatatttagtatattcttaaaacgttgttattgattatatttggggttggaatctatcatcttatccttgctattctgtaattttaggttcctttttttccttcaggcagcatgctagtctggcctgtgtttctgttcctttagtggttatcctaggaattgcaatgtatttatttaacatatccacacctaaagttaactgatgtctttactgtctgtcctcttggatgacaaaagctctcagatcatttaaattctgtttacacccaccccatctggagtttcccttagtgtgggtctgctgatgaagaactgtttctttcttttctttctttttttttttttttttttgagacagggtctcactgtgttgctcaggctggagtggtatgatctcggctcactacaacctccatcttccaggctcaagtgattctcctgcctcagactcctgagtagctgggattacagatgtgcaccactaccgcccagctagtttttgtatttttagtagagatggggtttcaccatgttgggccaggctggtctcaaactcttgacctcaaatggtcctcccaccttggcctctgaaagtgctgggattacaggcatgagccactgtgcccggcctgaaccctgtttttgcctaaaaatatctttatttcaccctgaatactatatgcttaaatactacatactctctccaggttgccattaatcgccttcagcacatgaagctgccatcccgttggtttctggctttcattgttactgttgtaatgtcagtctcctttgaagatgatatttacctctgccccgtcccccactgctcttaagattttctttggttttctgcagtttattactagggctggaatgattgacttctctctctctttttttttttttttttttttttttttttttgagataggatctggctctgtccttcaggctgggaagtgcggtggtgcaatctcagctcactgcaacctccgcctcccagactcaagacatcctcccgcctcagcctccaaagtagctgggaatgcggaatataggaatgtactaccatgcccacctaatttttgtttttgtttttttcggtagagatggttttttgctgtttcccaggttggtttcaaagtactgggctcaagcagccctcccaccttgggcctcccaaagtgctgagattacgtgtgtgaaccaccatacctagcctggatttctttttagttatcctgtatcctggacttaagtgatcctcccatctcagcctcccgagtagctgcacaggcatgcgccaccacacccagtaaaaaaaatttttttttaattagccagatgtgacagcatgtgcctgtggtccaggctggagtgcagtggtatactcatggccactgcagcttccaccttctggcctcaagtgatcttcctgcctcagcttcccaagtagccgagactgttccatactcctgggctcaagtgatcctccagcttcagtctcacaaagtgctgagattacaggcgtgagccactgtgcctggccctcttttgaaggtagtgaaatgtatatttgactttgtcgcttttctcagtctgtcttctaggtatcttacctttcctgcatgttttctagccttttctccccaccctcaccttctgctgcattctaattaatttattctcatcgaccatttcattattattattattattttttgagacagagtttcgctcttgttgctcaggctggagtgcaatagcacgatctcgtttcactgcaacctctacttcccgggttcaagtgattctcctgcctcagtctcccaagtagctgggattacaggctactgccaccaggctgggctaattttgtattttcagtagagacgggatttctccatgttggtcaggctggtctcaaactcccgacctcaggtgatctgcctgccttggcctccgaaagtgctgggattacaggcgtgagccaccgcgcccagcctcattcattattttgctgtgtcaattttgatgccacatccaaccatgaagttgttttgtttttgtttttgttttttttttttgcgacaggcagggtcttgctgtgttcaggctagagtccagtggtgcagtcagctcactgtaacctcaaactcctgtgcccacgtgatcctcacgccttgggcccctcagtagctgggactacaggcatgtgctactatgccaggataatttttaatttttatttatttatttttttgagacggagtctcaatcgcccagccaggctggagtgcaatggcgcaatctctgctcactgcaacctacgccccccgggttcaaacgattctcctgcctcagcctcccaagtagctgggtttacaggtgcctgccacttcacctggctatttttttttttttttgtatttttagtaaacacggggtctccccatcttggccaggctggtcttgaactgctgacctcgcgatccaccctcctcagcttcccaaagtgctgggattacagtcatgagccaccttgcctggccaatttttaaattttttgccgatttgaggtctcactatattgcccaggctggccaaccttttttttattcttttttttggtgagatggagtctccctctgttgcccaggctggggtgcagtggtgcaatctcggctcactgcaagctccgcctcctgggttcacaccatcctcctgcctcagcctcctgagtagctgggactacaggcgcccgccaccatgcctggctaatttctttctttcttttttttttttttgtatttttagtagagatggggtttcaccatgttagccaggatgatctcaatctcctgacctcatgatccacctgccttggcctcccagtgctgggattacaggcgtgagccaccgcgcccggcctttttttttttttttttgtggagacagagtctctctctgttgcccagccgagaatgcagtggcttgatctcggctcactgctgcaacctccgcctcccaggtttaagcgattctcctgcctcagcctcctgagtagctgggattacaggcatgcaccatcatgcccaggtaatttttttgtatttttagtagagatggggtttcaccatgttgatcaggctggtcttgaactcctgacctcaagtgatccaactaccttggcctcccaaagtgctgggattacaggcgtgagccactgcacctggccccattcgtttttacattctgatgattatacttttctcactttcctggtttgatgacctcaacagttttgaggaataccagtcagggatttttcgtttggggattggtcaggtgttttctgatgatgattagactgaggttgtgtattttgagaggaagaccacaaaggtaaaatgccattttcatcacttcagatcaagggcccatgctttcaagatgacgccccctggctgaggtagcatgtcaggtctccacagtgacgggcactttcccatccctactgtatgtactctttggaacattgcacagcccacagaggaggtgagtctccacctcctgaggcagtgtccatgtaaattacttggaattctgcatggaagatttgtagtcacccccatttatttatttgtttatgtcagcgtggacttatggatatttatactttggattctagtccaatactgctttattttgttgctcacattcttcggctgttgtggctttttcagttggctcctgtgttcctttcacataaccacatctttgattgctgtttttgagcccttcctttctggtgctttggtattcttcaggcacgtactgtacgttttctgtcccatctctagaatcagccatttctccaaggagcccttttttactggagaatggcattagaaacctaacactggaagccaagtgtgttcattgccttctgagctgacagtacaaggaaatgcatgtgtgtagtgaccagtgtatatacacatcacagtcagcagtttttcttttttccttttcttgaaacaggctctcgctgcgtcgtgcagggtggagtgcactggtgtgatcttgtcctgctgggttcaggtgatcctcctgcctcagcctccagagtagctgggactacaggcaggcaccaccatgcctggctaatttttaaaattttttgtagatgtggggtctcactgtgttgcccaggctggtctcaaactgctgggctcctcatcctcctgcctcagcctcctaaagtgctgagattataggcgtgagtcactgtgcctcgccactatcagtgtttctatatgaaaccatccgtacatatgaagctaaacatgacttcatcctgatatctccggctctaattcattaccacatggattattctagcttcctccccttgcttatcttagcttctccccttgcttcctctgcttcctcccactccaacagagagacctggcttccaccatctgccatctatatgcagcattttgttattctcagcaactgtcattactagaaactgttaacttccttctgtttctaaaaaatggtagattataatacaaactgctctgtaattgaatatttccctgggcagacaacgtatatcagacatcattccttgctcgtacacacgtgtaccttgtctttttcaaaggctgcacggtattccatggtttgaatgctctctaccttattcagttcttgcctcttgatgaacatcagcttatttccactcttctgctacaagagtgcagtagggattatactttttgaacatatgggaggatttcaggaaagtgaagttcttgatcaaaggatatagatatttaaaaatctgagagctgtgtgtggtagcttatgcttgtaatcccagcgactaggggagctgacatgagagggtcactagaggccaggagttcaagaccagcctgggcaagtagcaagatcccatttctaccaaaaattataaaatttgccaggtgtggtagtgtgcacttatagtcttagctactcaagaggctgaggcaggaggatcgcttgaacccaggaggttgaggctgcagcaagccatgatggcaccgttgcaccccagcctgggacactgtcacttcccaccctccccaaaaatgaaaatctgacacgcaaacaggcataatgaacacctctgtctatactttccttactgataggtaaagcagtatctgcctttcctcgtctccgcccctctccctcactgaattaaccactatcgattcgggctttcacagcctctggctgatgtccacaaactcattaccaatctgtttggtactagtccacgttgatgtacactctggtgtacacactttctctcagccagcctggcccgtgggccacgtttagaggatatgaggcggtattgtgcatattgatatgttgctgcacttggcttcactgttcaggatttatttaggttgataacgtagttctagcttatttcatagctgagcatcatctgaatatgcctgaatgtactcacccattttcctgctggtggtttcatttttctccaaaaactctgctgtggctcttccccatgtgtgagattctctaggagtggacctgcttggggcgggggcaggggtaagggtgttgagaacacctctaggctgagtgatttcggtcattccctagagttcatcctcgcaagctgctccatccttggcatcagaagacccacttctcgagacgttacctcgtgattttaatttgccagtggagttgagcatcttttcacatgagctatttgttttctctcgtttacaccatttaaccatgtttcttttgggggtatagttgcattttccaagtattttgatccgtttgcaatttattgggtgtaagggatacagctttatttttctcaagatgaccccccacataataatccaactattacctactaagctgaaacaccacccttctcaagtgatgcactgaattaccatagctttaagaggtttggtgtgcttccttggtttttgtctgcctgatgtttgttaggattggcctaaggccaccattggtattctcatatatcagtatgaattatatgtcactcccattcagctgtcaattttccctgaatcattaaacatttctaactaggaacaaaatagttcctgtctaggaacattgacccagtatgacccctgatcgctttttgttcattccaaggcattttttccttctcgtgcccgattgtactgactagcacctctagaacagtgtttggtagtgggcaagagtggacttggaatgcaactctaaagcgttaacacttttggtttctaataataaatggtacataggaataatttttagaaaatggatgttaaattttatcaaattttttttctccatcagcagaactgatcagtagagtctcgctgtgtcgcccaggctggaatgcagtggcacgttcacgccattcattctcttgcctcagcctcctgagtagctgggactacaggcaactgccaccatgcccagctaattttttgtattttcgttgttgttttttttttttttttttgagacggagtcttgctctgtcacccaggctggagtgcaatggtgcgatctcggctcactgcaagctccgcctcccgggttcatgccgttctcctgcctcagcctcctgagtagctgggactataggcacccaccaccacgcccggctaattttttgaatttttagtggagacggggtttcaccatgttagccaggatggtctcaatctcctgacctcatgattcgcccgcctcggcctcccaaagtgctgggattacaggcgtgagccaccgcacccggcaattttttttagtagagacggggtttcatcgtgttagccaggatggtctcgatctcctaccttgtgatctgcctgcctcggcctcccaaagtgctgggattgcaggcgtgagccaccgtgcctacccagaactgatagttttaaaaattagatttatagaatcatccagctatccttgtatcctggtattttttaaagtgataaagaatcatcttagggaatgtgcaaaaccaaaaacccaatcccaaacccatcactgccaaataagcactaaagtaaccagcaaatgaattccaacagctgcttcagttctgttcacctctccatcccatacctatcaacaacggggaatgtggaagttttggatctgaacagcctaagaaacatctctccattgctagtctccagatctttccaggctgctaacaatggagagcgcggagtcttggctttcttcaccacactgacgagtgaggccttgtgtgtttaagaccccactggtaacacacactcagcttcccccatccttaaagggtagggagccagggtgggcttcacatgggcggacctgctgccagtcagcctgtctactgtgaagtcgagtccaagaggttcctgtcccctctagtcacatggccaccctgcccagactgagcctcccctgcttccctgtagaggggcaggcccgggtgcggagtggaggcccttggtgcccatcagtccccctcccacagaacagtcaccaccacactgagaatttatcatagaatagatttatttacctgaaaccatgtctgtgcgacgctcattgttaccagcacagaaagaaacaaactgatctctatttacagtctaaagtcaaacatgcgcagtgataaattgacatttagcattttattaagataaatgcatcacaatatttgtattgcaccaacatctgtctactgcttctgatttcattaaataagttacatttaatacagtgcgaaatagctgtctgcacactcagaaaataactgaaaatgaactggaggcctacattttaaccattcaacacctgtagtgtttttaatgaatttataaataagcaaactgtacagggccaattaaaaagtagcatgttccaatgtcactggagagggatctggctacttacaaccgaaggcatgcattacaattgaatactgtacatttatataagctatgacattttgcagagaaatgtggcgacttggctgacggcttccaagttcttagataaggttacagagcctcattcctcttgcagcaaagaaaccaaacttctctggagaggctttctgattaagctaaattgtacatctgtaatcagtattttgatttaaaagctaacaaccccattggtaatacacatttcctccacataacacaaagtgagttgggaagttttttacttttctttttccccaacatcagtcatgcacagggttggtagatgtgttgctaaaaacgcacatgcacgcaaccgaacacccttacatttctgcaaaatggtttaggaagcggttactccagtattgctgaaaaggaaagagagaggaaatcagcttcatgaaatacagagaggaaacgttagaatacctatttaaatagatgaagatcaacagcgacagatgaaaaggaacattcagcttgatcttttcaaggtttcaagaccagcatttctgatttactgtccctgaggtgccgcccacacagggtagcatctagaagcactggctcagtgacacagactcctcgtgtcgtctggctacagaataaaggctctggaggaaaaccccatgaggcagacacaatcgttgcagctgtgaaagcagcgagacaggcaagaggacaaggtcttggttagtggtgcagagggtgaggttgatggagaagtgagcagccagtagcagcacagccttcctgtccctgccctgtgggcacccggcttctggctgctcgcctgccttgcctagccctggagaggaaactcctccgcatcattctcctcagtaaaggagggtgaagcctacccttcttgctaactgcagcgggtgtttggacaatttggtggttacagtcacagggcaactgctggctctgctcacaggcactgcagacgtggtatgctctggccctggacagtggctagatgcttggtagacactgagctaatcttgtggtctcaggtcttaggtctgcccacctcagtcagggctgaagctccagtccgaggggatgtgggagcagctgttgtgagggaagtcggccagatgccctgcttgcctgggagctcactgagctcaagggacagcttcctccagaatggatcatctgcattctgcagagtggtgtcccagttagggtatgtatgattgttggtcttctgggcaaagctcagagaggccaagggaggcacggggtggcaacaagcgacactgatggctgggccttcagccacctgcccatcaggaaagaatgtggaagtaagtttcaggcaagagctgcctgacagcaggcacattgcggggctgggcagctgctgcctcactgttaggtgagggcctgaggccagggatgtgccaagaccacggtgctggacctggtctttatgggttgacctgaggaggagatgctgaagtgttttcacccagcaaagccttcagtgaaatggagcaagtggccctgctcaaaacagcagtgggcctaacccactcccagctgtctggaccaagggaagtgggtccctccatgggctcctctgtgggctggaggggtctgaagctgagaaaccatgaagctaactaggggctgtgcgacagcaggccacacactactcaactttttttgtaaaggccactaagtcaaggaactgagtcaggaaaagctgagttttgtttgcacggaatagcaatagtgcagcactcaagtcagtttgcagcccagagatgcactccttgcatttggcccattcaacccatttcttgttacacctcatgatgctcaaactggcaaaatttaccccctgccccaaatgttccctgctgggcaaagcagcctcccttcccgagagccacagctgcctgcgagcagccttggaggcttcacagtaaggctgatttttttttgacagggcctcactctgttgcccaggctggtttgagtacctgggctcaagcaatccttctgctgtggcctccaaagggctgagacttacttacaggcatgagccaccacacccaaccacggactgtgcttttaagagtcggtctccaggttccacctccatcccttgaacgtgggccctctgaactcagcagcaccttgtcctgcttgatgcctcctaaccctccccaaactccaaccatctgcattacatctactggccatcccagtaaccagagcctaagtacattttgaagaatatagtcgaggcctcacaccctggctaaggagtaagctggtttttgggctgtgcagagccacgtcctactaactgtgctttaacatcccctgcagagctaagtcttagccaccaaggacaagaccaagcaagggggggtgggggagtggggaagtggcctatttaagacgaacctatcgatacccagagttcactggttcagttacttgctttcactagtttttagctttttaataaataagtagcaatgttctgggatgactcctggcagctgcgaaccctcattttagcaatagtctgcacagctccttcagcctgttggtctggctgaaatgcctctctccccactccggcttttgtctggcttgggccctcctggtcatcttgtcctaggcagcctgtggaggtctatgaaagccacacctccagccagctgatgctgcgcccgagtcacatggcaggcgccacaggcaaccccggtgctcacagggcatcagggagcacagcagcatctgccatggaggcggcttataagttagtgacatacagttatctcacttggtggcagtcacctttaggctaaagcatccaaatcccaggaagaaaatactcacgttagttgatggatgttggaaggcattggaggaaaacaccacagttaggactgttaatgacttacacactgttggtgagactcatctcgaacatgcgcaaacattgatcgtagtaacggtggtggtggttagtgccacattcaaataaaaatagttctatacaatatgttcatttggtcatgtgctatttacagattttacaaaacacacacatacacacacatacacacttgcccttatgttctctataccaggccagcagaaacttgcataaaatgtacatcacagatgacaattagtgcctgtacattaagaatacaattcctatgactacctacacagcagagcaggagccttcttcccctcaagcagagtacaactaaagttctgagctaagaactggagagaaagttggacatgtctgttagtcccaggtaagccacttacgagttaaagacaagacagttatttttctctgtccatttaaaatgttttatttttttaaaactagatgacgtgccactgaaataggcaatgttggcaaaacaatgtctgttacaataaaatacattagacatttaaataaataaccttaaaaactatgtgaagggacataaacccagtcgattgaatctggaacaatgttttctgcacaagcgagtacaggcatacctctcgttaaaactgatgtaaacagaacgaaccatcacaatcctaaagaagaagccaagcggggcgggggtaaggtggggagaggtggggtggggtggggtgaacggaggccaaagtgggtgagggaagtagcaaaccaaaacaatactgactgaggtagcaagactctgctcagtgcagaaaaattggcttatgaataaaaattagactgtgatatcaaattaaatccggatcatcatgcaaaagacacaatacatgctatttagttttagaaaaaaaaccacacacattcatttcctaaaatctgctgccaattaatttgctgacaatgtctgctggctcaactattttttttatacaaggatgagtattaaacagaacactgtacatgctttttcatctacaaaaaaatatttgcataaaatagtgttagttctctgtacatgtcaatggacactttaattatgtgtataaaaaaggaaaatcttgccccactggagtcagaaaaagcaaaacaaaatctagagtatgaaacctccatcaccagccagtatgttcatgtgaaaattcagcagaaatagacagttgctttaaacaataaaaaaattaattgattaagttaaacatcttctttatggaaaactgtcagtcaagaccagaacatatcgctaaagttagtgtctgtgctatagacccagatcaccaggggcattatgagcagcacaaacggccaggaaatcccatcggtgcatgccgagaacgagcaggatttggtggcaggctgcacacactctttaccaggttccaggtagttgcgggccacaaacttgagcgtctcatccatgagaatcacgggcaaggagattttcagcaccatcagccactgggtcacgttcagcggtgtgatctggaagatgagctgacacacagggaagacgtgtcacgcctccagcctcccctggaaggaggtggctggtcccaagccccacccaaccacttactggcaagggttcgacatagaggatcaggaagtggagtgacatggacaggcagatggagcccacgagccagatgttctcccaggggggcatcctcagcaaggactggttttcggacaagctgcagagcaaggagaggtggggaaacgcacccccaaggcaaggcacgtgtcacagtggcagtaagaccctgttggactacacttcagtaaggcggctgttaatgtggcaccatccgctgacctacctccactttctacagtggcaaagttgaagagaatgtcctaatgcaggacaaactgtgaattctgtatctatgttttggcatagcagaccccatcttagtgggttcaaagctgttcccaattgccctggagacttgggctatttagaaatttccatttttgtcacgggcttaactggatggtaccatttgtctgtgtgaaagggtgaggttccttccctgtgggtgctggcatacaggggtaccaaagttcctatttttggcccccacggtttcttttaaggaagagctcctaagaaacacagggctaagcactcccactacttcctggaggtgacgacagctcatgcttttaaaactggtattgcctgttctcctttcttttgggaagggaagaactgtcctgtgatcctcaatcaaccgtgactacacacaattccccggtgccctggcagtcaccatgctcgcctcagcctgccgtgaaggtgcactaacctgttgagggcgttacacatttctatagttactagaacagagagcgccattgtcatcgggtatggggattcaaagattgcacaatccacgccttcaaagtccgggttgtcctctttacactgtaggaaatgactctgcaagaaaatccaatcaaattcctatcagcccagtatatttcccaagtccaggctccaaccccataccaagcctagcacagaccagcctgaatgcagagccagccaagaggtttaccccaatttctcggagaagccctggtccttcagaatcatcttagatgtaactgtttattgtctgagtcttaagatgatttgatagataccgaaaccacagaaaggtcaaggcctcacaacacttctcatgtaaggtacagaaagaaaggtgactgagtaccagctggtagaaggacactcttggaccaccgtcagcagcaatgaaccaccatgcagcagcacccacggtagcagcgccgacgtaacctgggaacaaacacagtgatgctgatgcacttgcctctgcagggctcgctgccaccgaggccatgcaggccagtccccacaaggacgaagatcaaagacatgggacagtgatggtaaccggggcctgtggtgctaccaccacctgctcacgcctggtagccagagcaactagaccctggtttctgaaggacaggggtgtttctagaacagaagaactggataacttttcctccagaatgtgtgagaaaaagcacttgctccatcctgtgccaacctttccccttgccgtgccttctcccctcagtgggtagtacttcaaggctgcaagtgtgtgtgtactccatgtaaggctgcacagtttgagggactagattacaccaggacttttggacaaactattgctgcctagttgtacacagatttatttgctccattagaggcccagcagcagttttctagggaaatgctgtcaggagctagggtggaacactgagcagcatggccctgccctcagcagcttctgggattccccccagtattagctttgagttcaggaagtttattgcaaagaagcaacaaggtgcagcagagaatacacagagttcagacgaggcaaatatccccatgtggtagcatcaaaaacaacaagtgcatatacccactaacccacgaattacagtggagcatgaaggccgctggctgcaaggatgaggcactacgcatgtccggatatggaaggatctgacaagcaggaagaaggcaagacaagggtcaacatgcaggtgtgcacagcatgctggaatctctccggaagggcacagggtacatgagcacctcaacgccagagggaagtgactggcccaaaccctttccattctatgccattgtgtgctttttgaatttgaagtcatgtgaatatattatgaaaacacaatgccttcctatgggatcccagggaagtgatttcacctcactttcccaatctatgaaatggggaagaacccggggtgaggaagatgagggctaaagagatgatttatatataaaagggaccagccactgcgcaacccttctcttatggaaacagggactaaattttataacttggtgacaattatctatttaaatcccacctatgaactcttggaaggcagaacctagcgtgaatcattcttatccctttgcacagagggctcaatctgaaaaccctgatgtttaattgctcattcagaaaagcccaagtaagggcaggatgctaaaactggaactaactgtgaaaggactctggtaaattggatgtatagttcatcgaactgtaagagggcatctctgtcttttgctaccctatacggggatagaagaaaaaacacgcttttaagggatgaatttacaaaatttcagctcacaaacattttgtttaaaaatcagtaatataaaaaaattgtactcacagccaatagccaagtaacggaaaaagagccacccgctgatcaatggttcctttgggttccggggaggtttattcatgatgtccagatcaggagggttgaaccccagtgcagtggcaggcaggccatctgtcaccagattgacccagagcagctgaacaggaatcaaagcctcgggaaatccaagggctgctgtcaggaaaatactgtttccaatcaagaaaagaagacaaagagagcccaaatgacttctggccactatttaaagagcatcatcaacccgccctcctccagaaaaataaatgacaacaacttcaggtaatctgtaaaatacttatacccaattttgaattaaagctcaattttacttagtttattacttaaattcagatgactgaggccaggtgcggtggcttatgcctgtaatcccagcactttgggaagccaaggtgggcagactggctgagctcagcagttaagagaccagcctgggcaacatggtgaaacctcatttctactaaaacacaaaaaaatggcagggagtggtggcgcatgcctgtaatcccagctgttcgggaggcttgaacccaggaggtggaggggacagtgagctgagatcgtgccactgcccgaagcctgggcgacagcgagactgtctcaaaaaaataaataaaaataaaaaaattattaagctgactgagataaagccaacttttggagggcaagaatttcatgtgactacctggttaatgttagctcagtctcacgttaaagaggattctttgcacattggggcagctgcagacaaccctcccgagggccaaagcaccactgcttccataaggcatttctgtcttgcccactcccctcttccaactcaggcacaaagaccaaagctgctgcaatctggagagcaaactgcgagaactgggctccatgacccatttagataaaggcgtacagtaagtgatgctgtcacagagacctaccagacaacttccccgacgttggacgagatgaggtagcggatgaactgtttcatgttgttgtagattgcccgcccctcctcaacggcagccacaatggtggagaagttgtcatccgccaggaccatctcagaggcggttttagccaccgcagtgccagagcccatagcaatgccaatctcggctttcttcagagcaggagcatcgttcacgccatcgccagtctgaaagggaaagcaatggttgggtcagccaactggcatgccacattcatacccctaggcaaaagcccactgaatgggaagcaggaggaaaatgaatagagccgtaggtctcttggcaaagagttttagaatttttgtttcataagttggtgtcacaaaacacattttacctaggaaatgtaaaattaccaaataagtttaccgaagtgggacaaaggggacttcaaatttatctgtattatcttactaaaaacaaaaacacaacctatgtggcagtcaagaggaagcacttgtatccacatggataaatttcaagtagaaagatgcagattgcaaaaatatgcaaatttttatttttctgagatggagtcccgctctgtcgcccaggctgtagtgcagtggcgcagtctcggctcactgcacgcctcctgggttcaagcgattctcctgcctcaatctcccgagtagctgggattacaggcgcccaccaccacacccagcaattttttgtatttttagtacagacggggtttcaccatgttggccaggctggtcttgaactcctgaccccaagtgattcacctgcctcggcctcccaagtgttggggttacaggcatgagccactgcactcggccaaaaaatatgccttcaaaagcatgcaaaaataatactgtctacagacacaaaaacagcactcccatgtttttaatatttttgctaaattccaacttcagttacctctgggggagaggagagtacacttatagtatgtttcaaaactaagatttttttttaaaagagaagaaagtaaatttaacataatgtatctgggtgaaaatcaggtgaggggaagaatactggaaatgcttcatcaatagccagctcttaaagaacttaaaagcagggtgatccaaacaactgactgattacatcctcaattttcagaaaacttacaataaaaacacgtctcatttaaaaaagagactagatcaccagattgttcctctgggactgatctggaaggcccttctgggttttaaacgactctaggatcttccctgcaagtagcacacaacatgctaaccactgattcaccgaattctagagaaaagacccaaatcatgacaaattccaaattagggagctatgacaaaaaaattcagtggtcaaaattagaggctactatgtgcttgtgtagcctgagtcacctgtacatgttcaaacatgctcaccatagctgtaatctcatcaaaagactgaagaaattctacgattttagacttgtgggagggttcaactcgagcaaaacagcgggcgttcaggcaggcgtctcgctgggcggaggggttgagttcatcaaactcccggcctgtgaaagcttttgacgtcacgtcctcatcctgcccgaagatgccgatgcggcgacagatggccacagcagtgcccttgttgtccccagtgatcatgatgacccggatgcctgcttgccggcacagcttcacggaggaggccacctcgattctcggaggatccagcatgcccacgcagccaacgaaggtcagattggtctaaaataagagcatcactttaaataaaagtggcaagttctagtttttgtcccctagtttgaaaaatgcccagttaaacattgagacaggtttctgcattttttttctttttttttttttgaggcggagtttcgctcttgttgcccaggctggagtgccatggcgcaatctcagctcactgcgacctccgcctcccaggttcaagagactcttctgcctcagcctccagggtagctgggactacaggtatgcgccaccacacctggctaattttgtatttttagtagagatgtggtttctccatgttggtcaggctggtctcaaacccccaaccccaggtgatctgccagcctcggcctcccaaagtgctgagattacaggcatttgagccaccgtgcctggcggtttttgcattttcttatgagaaaaaaaaataccactacacccgttatcaaaccattctttaactcttgtgctattctgagcccacagtaccaaagcttcttcattttgttcatagctttaggatgtcacatccttgatataaaagaattctactctgagtagaaaagtggaagtaatctccaacttggatcttttgaccttcagtaactaatgaatattctagaaatgtcaccaatttaaaaaaaatcatgatttagatgagaggcaaaatggggtttacaagcttaagctcatcttgattattctactttgaaaatattctactttgaaaataacacttttatgaaattattaactatgtatgtttgaagcagcaaattttaagggtgacacagctggcaggcagaaaaacaaataaccacacctctttcttggcaaaagtgagaactgtttgaccttttgcttgaaggagtactgtttaaacacaatgaatcgtgcagggtgtggacaaagaaacttttcattagctaacctcatatttaataaagttggcagagtcctcaaggtgcatttcttctcttctcagtgggttgtcatgagtggccagggccaggcatcgcagtgtgtcgctgccactaccccactctcgaatgacagacatgatcttctgtttgactccagaggtcataggaaccttagtacttccaactcgaatgtgggtgcacctgtcaatgacaccttcaggagcaccctggaaatgttacagatttagataaacaattttgttttattggttcaccgggatcttaaccctggcaagaacatctcaattgcaatctgccatacttgccttcacaaacatcttgctcattgatgtcctgcttggtttatttggtgtacagtaaaccgacattgactttctgtcacgtgaaaactctagagtgaattcctttttcatcagctgtttaatgacctacaaagggaacaaatatggatactactgggtggcaatttctgaacttttttacctaacaagcagtaagcacacctattacatgacagatgctaggaatatagcaataaacaaaacagacaggtttttgccctcatgaaacttgtcccctattttgggagagacagactaagatgcaaaagtaacacaagtgctatagagaaaaagggaagggggatagaaaatttgcatacatacatatgaactgttacataaagtggccagaaggcggtgacatttgaataaagatggccccatggggcctgaaaagatgtgtgtgaacccagtgggtggtggtgaagacccaccaggcagagaacggaagtgcaacctggcaagtcctggaatggtaaaggagtgccaacgtggctggaatagagtttacatgagcaaaaggtgaggcaggtaatggcagaggatggtagaagcaggtcattaagacctcaaaagtcattatggggcatttggcttttaagacaagtaaaacagaagacaacggagggtctcaagctccagttgtcaagaattggctgaaggtggtcgggtgcagtggatcacctgaggtcagcagttcatgaccagcctggccaacatggtgaaaccctgtctacaaaaattagctaggtgtggtggcaggcacctgtaatcccagctactcaggaggccgaggcaggagaactgcttaaagccaggggggcagagattccagtgagatgagattgcgccacttcactccaccctggacgaaagagcaaactccatctcaaaaaacaaaagcattggctgaagggagacaaggaataccattcagtataatgacactgacttaaactagggaacgttggaggtgaagagatggccccaagcagagctgtccaccagaactctgtgaaagatggcaatgctctgtggccactgttcatgtggctgtcacacgtgatggataagcactttaagtgaatatggctagggcatctaaggaagtgtttttaggtattctaagtagttttagatagctagtggctactgattatagtaatgagaccagaagagatcatgggagtaactatagacagaaatggctgaggactatggagccttcacctcctggtgccttgtgaaagacccagctacaaagacctcgaatgagaggccagggagggagagcaagtatgggatcgtggaagccaagtgaagaggtgcttcaaagagggagcgagtgacagcaccaacaaaataggaagacgaagactgagaataaacctttggctttatatcgttacctacaactaaagataccccttctcttccagtttttgtacttttcttgcctattacacagaccaggaatgccagtataatactgcatagaaatggtgagaattctgttatgttagcatggtctctgtgtaaacacactgtcagcgttaaagacacacttttatagtcttagtttggtgtgataagatgcgtttcatcatatgcacctactgaggtgaccttattgttttttccaccttaatttggttaatgtggtgagttaattatatttgctcccactgacacacatttaaaaatcatcatagaaatccccaagaacatcagcatctaacctaggaagctacgggaggactgaaggctgatgaactgactagatggggctcagggccctgcagcgatcctgctggcctgccagccactgaaccgtctcaggcagcaaaggaatgggtatgagtgctacgctagattctgtatcatctcaatcacacgtgtgtttagtttcaattaagcatttgcgccaatggcactgggatgactaaaggaacacgcaatgattctgaggaaggcgtggacctacccaggtaagaggtcttgggctgggagtgggggagggaaatccctttcagtactaggctggccaagaaccacagacctcaccaaacaagccatggggccaaaatgctggacctgctctctctgcttctaaactacacatgggttcctgctgtctcaagtgggaagggaggcaaagagcttgtgtttggaactccttagtgaatgagcagcatgacagctgtttccgatcccttggccaagggatgtgaaaaagatgggacaagggagctctggagcagggagacacaaggatgacagtattgcccgtacttgtgtggtcactggctagtgagccagtgctggttcagccccattacatgacttgtttcccatcactcagtggagtagtcagaggtctagaatcaaacgactcaaaccctcaatctgtgaagctgttttcaggctgcctcagatttttagttacaccaactaatagatcacaggcagcgtggctctgccaggatccaactccttgcttactggcagagtgaataagcctggactgcttcgggttcatggaagacacatgggtagagggaagaagccaaaggagtggtccaaggccttcatggctttgagactgctatttgtgaattgtgcatcagtttactgaaaaggaatctatatttcagctgagacagtctcaattccagtgtgagttttgttttctcaggacagtataaaggagacaaaatgctgcctcacactaaccggaagaccacgccatacaggtcatggaagggctaggtgtccctaactgcaggctggacatgatggtctagaacttttcaccctgagattttgtgtggtcactaaaatgcctgatatttgaggttattaagaaaacaggtatactgctccctcccaactcaggctgtactaccccccaatgacacaatgcctcctcatttgcccttattatccaggaagggatgaaagggcttatgacatacaaaaagcattaaacgtggtgacaactaatcattttgctaaatgaggcttgcctttatacagctgtgtatgacaactagaaaaggctgagttttacctctctcctcccccagacctgttccttcaggcaggcagaacctctccccttcccatcgctccttattctaccagggaaccctaagttacaacaatgtcctataaagaggctgcaaaagtactgactggcagccccatggtgatgacagacaggtaggtctgatgctaaaaagaggtatgttcagcagaacccaattccataggaatccaagctccacagctaggagacagtgggcactgaggatgaggctgtttgcaggcaaatggtctggtggacctattagaggaccatgtggctgtgcagaccctggactgcagatagagggtattcactctaagatagtgtaggagggctcttgcccaacaagcaatcaccctgtctgccatataaaaggagcagctgctgctgctgccacacagctcaggaatgatgtttcctgggtggtggtttgtgggggcaggaaccagacatagactttgagagcctgacttacgtccctaagctccttctgctcctccctggctgctctgagagcatcacactccttcctccaatacaatcagcttccgcagttcccattcttgagctgcttctgtagcttgcttcttctctcccacctgtccttggcacccacgtgaccgactgacccacacagactttgtgtattgcaacatcttatctgcatatcacttctcatccaagcaatcatctaccactttggccaggataagataaagggagttatccttcaagtttagccacttcaggccttaatttttttttgagatggggtctgactctgttgcccaggctcaagtgcagtgatgctgcaacctaaactctaggcctcaagtgactctcccgcctcagcttcccaaagtgttgggattacaggtgtgagccactgcgcctggtccacttcaagttcttaagctgagccaagtgacaggcagggggaccagtcttttgaggagacccaggtgctagagactcaatggatggccattcttcaccagcagccgttgcaaagtgtttctactgaggtctaggctccccgggcttgtgaggccacagaaatctaagggcagtactgcaggacaggtccagtatggtggtcttggcaggagggagcagcagctctttgagaggaacctcactcaggtccaactcactgtggagactccccatccttgctactggcccttgtcatagtgatgctggtcgaatgagccctgtctcaaagactctgacaggcagaaaaaggctcagaggccacttatttgttcagtgtatacatgaacaatgtgggtgccctctgccactgccactgccactgccaccaccatcaccacattgacctttggtatttggttatgctggtctcatcaaatgagttaagaaatgtttgatgcccaggcgcggtggctcatgcctgtaatcccagcactttgggaggccgaggtgggcggatcacctgaggtcaggagttcgagaccagcctggctagcatggtgaaacccctttctacgaaaaatacaaaaaattagccaggcgtggtggcgtgtgcctgtaatcccagctactagggaggctaaggcaggagaatcgcttgaacctgggaggtggaggttgcagtgagccaagatcgcgccatggcactccaatctggtgacagagagaaactctgtctcaaaaaaaaaaaaaaaaaaaaggtttaattgaacaggaaaagaaagtgtggtagctgacaggggaaataaggtcaaaggaaagtttcaagatagaaagacactattatttccccctatgctgaagaacatctagtagagatggaaatcaataatgcagcaaagatgttgggaggaggtggcttctgctaggagcaagaacactgttcacagcactatgggagaaggcagcccctgtgggcccagagggtcgctcaaggaaattagctattgattgcttttattttcctggtcaaatacacaggaagagcatcttacctgagagtgaatatggggaaggaaatactgtaagtttgaggagataaggtataattagttttctaagagagtaggacagtgcagacactaagtatatatagtacgactgataagcagcatgaacaataaaccaggttcaaatactcactgagttgcaggcatttgcacgttctattttagaaagacccttcaattcggtatcaaatacattcatcttctctactaggcaagtgagagcagtctctgtagcttctccaactttttcatacacaccctttgcctgtattggttaaaggcacagaaagtagaaaaaagggagaagtacacagataaatttatctttaatattttttttccacaaaagcacaatctgtcctctattacaacactgtaaggccatttttatcctcctctgaaacaggtgacccagataattaaaaacatactcaaagtacaggtgtgcatgtgatcttattctaataagtaggtttttcatttcccttaaatataagatgacatcaaacacagtatttattatttcacccaaatataagaagccactgatcacactattaattcaaagagtgccttcacataataatgtaattccatgtcactgcttatcattctgaagagttcacattctgtctctgacagggactagcttacctttgagacagaaactatatcctttgctttcaggaaagcattttctatcctgggttttattcatttatagtaagtatgctatcaacagaaagaacatcacatatactacaactttaagttaactaactgcaatgctcagtcacagaggatatgtgaaaggctctcagctttctttggtgaggtcatgctggccccaccatcaggttctgaatggaagggggaaacaaaatcaggcacccttgactttcaaaagggaggaaggcaggctagactttcattccacccaccccacccttgaactaggaacagccattccttctaatttatgaagagacttacctcattgtaatccaaagcagagtcattacaaagagcacaaattgttgctaattctaccagaccatcatactggtgacaattcactggtttatcatctttatgcctgcccaaagagaaaacactcttagagcagggtatggtcgccactattgattcctcccgccccctgcccccccgcaattgtttaataatgaaaacagaatttctgggacaacatactggaaaaaattccaaacaatttgatgccagagccaatattagacaaaaacaaaagagagaatgcatctctggtatcagaaatcaatcagtaaaaagaccagaaattcttaattcaattcttccaccactggctacagtgaataacaaacacaaatccctcttgaaagtttggagcccagaagatgcaaaaagatgactggattataacctttggttcatctttcaaagtttttgttttaaaaacatttactactttagtaataagtgttgacttgagccacattcagaaagctgtcttaactttgtagacatgctgcaaatcaatacaaatactaaactgccacaccagatcctttaaatgaggaggagggttactcacacttctccaataggtgcataagttgatccagttatggtaaactcattaagggaacaagtatcaccttccactctgtccagaatgaacatctgtagggggagagcgcatcagagtatttaaaagggatttttaaaaaatgctacacaaataaactacctttgttagcttaggacaaaggcaaacaacctctttcatttacgaaaacaactttaataaaactcactgaggctcactcagcatcagcagtactgtcccttaccctaactagcttaattatattagactgcttcgcccatcacacccccgaccaatcgaacagtatgaaaaacagcatcactgaggtgctgaatgaatgagcagcagtggcaccaaagacacaacaacccacacaaaatccaagttatgaggactcccggtcagcaaaaggtcagttccagagacaagttactctttagattgctcagaatcccaaatttcaaatggctggctgtgagagtggtattaggtagtcctgccttagagctaagcacaaaagcttgggaagaataaactcacatttcagagttgcataaacatttcccgagtaaaataagacaaactgcttctctgctccttcccacttatttttattgtggcaatagctcatgttctatgaagctgcataactatatgtatacagtaaggagcccgcagagctgaatgaattgatgttccctagacaatacagatggaagcatgcttaggaaaggattaattttattttttaaagcgacataagctattttcttaaagataatttttccactgcttgatttgcattcacaaattataattcagaagcccagtttggaaaagtaagatttaggcttgtgttttcattgcaaatgaaaacttgtaaaacctcctctaaaaagaaaaaattacagaaagtgatgtcaaaactatattttctcgtgctttctctgaaatatgagcaattaataatctgatcaaatcattctctaaggggaatttaaaaaatgtaaaactcaagttaaacaggccacgttgagctgggcacggtggctcacgcctataatcccagcactgagaggccaaggtgagtagatcatgaggacaggagctcaagatcagcctggcaaagatggtgaaacccgtctctactaaaaatataacaaattagccgggcgtggtggtgggcacctgtaatcccagctactcaggaggttgagggagagaagtgcttgaacccgggaggcagaggttgcagtgggctgagattgcgccactgcactctagcctgggcgacagagcaaaactccgtaataacagcaacaacaaagctatgttgtgttttaaaaacacatcttttcagagcaattcatctcacattcaataaggaaattagttaatctttattttaaaataacttttttttttttttgaggtggagtttcactctgtcgcctaggctgggtggactgcaatggcacgactcggctcactgcaacctccgcctcccgggttcaagtgattctcctgcctcagcctcccaaagaaattataggcgcctgccaacatgcccagctaatttttgtaatattagtagagacgaggtttcaccatgttagtcaggctggtctcgaactcctgacctcaggtgatccgcccgcctcggcctcccaaagtgctgaaataacaggcgtgaaccactgtgcccagccaaaaatgtgaaattctttgagtctataccaaagcccaaaatattctaaaagacattcagaatctgaatctacattagctaaatctaaatgtacttagacatttttgactgtgagcaagtcaaccatttaggatatgcaggatgaaaatcttcctaagtcaagggcagttatgcaataccactgcaagaagcctcctgcagaataccaattagcaccagcttcctgttgtgaggtagagcttcactcagaacaggcaggctttttctttattataagaaaacattttaagccaagccattcaagggagaaaagaacaaaaaaaaattatagtgaactgggaaactgaaattttaaaaattacaattttacacatggctttacacatggcttactttcacagacataaagactattctgaggaattaaagctttcaggctaagtgagacacaaaatcgtaaataagaaaattccctttctcttcctgaaacaaccagtatgacaaaactgacttttagccaattcatccaaccttttggttccaaaaaataagaacttaagtagctcaaacaccttaatatcctggagaaacctaagacaaacctagaagctttccactttgaaagttggaacaccccagttctgtcaattctaaatgtgggtttggacttcacaaggagcttgcgggggagggagaacctgtatctaaaaaatcatcatgagcttaaaattggcaagataaaaattcacagggcttaactgattataaaacaatttccgatgttaaaaataattatctaaaacctgacaaaaaggccaagataactacaccctttcaatatcatacagaagcattatttaacaagcccattctaggaaaatgtaacactgtgttactaaataaatgctcatgttatatgaggtttccctgtaagacattagttttgtaatctaacctagcaatccctattctaatattctaatattgaacacttcctcaaatacagattcccttgctaattaatgagccgaataaaatatgtgacaaatgtctactctgtatgagtcatgtgtaccttttggaatagacttgtaccaagttgtttaagcaaaacctaaggaaagtgaattatacaaaataatccagctgtataattattgcattatttattcagttgttacttttctaacagcaggtttaaattatttattttatcaaatgatggtcaaaaaatataggatggccgggcgcgggggctcacgcctataatcccagcactttgggaggctttcaaaagcgggtggatcacttgaggtcgcgagttcgagaccagcctgaccaacatggagaaaccctatctctactaaaaatacaaaaaattagccgggcgtgggggcgcatgcctgtaatcccagctacttgggaggctgaagcaggagaattgcttgaacccagaaggcggaggttgtagtgagctgagatcgggccattgcactacagcctgggcaacaagagtgaaactccatctcaaaacaagaacaaacaaacaaacaaaaatatatatgatgaatacacagaataaagcaagttaaaagcaattttagtcagccctctgtacctgtgggttccacatccacggtcaactaaacagcagatggaaaaaataactgcatctgtactgaacatgtacatttttttcttgtcattattccctaaacaacacaggttaactatccctaaacaacacagtttaactatttacatatcatttataatattacgttaggtactgtaagtaatctggagatgttttcaagtatactggaggatgaacaaggttatatgcaagtactgaaccatttcatttcagagacttgagcatctgcagagtttggtatctgagggaggtcctggaaccaatctctaatgaatacagagagatgactatctactttttgagaaaaagcacgcttcattcaacatgtgatagaaaaaccaattaggacttcaggtagggaggttaactagcagctttctctagaacttgtctattaacatacacctagagacagaggatcaggaaaattagaaaggaggctgagtgtggtggttcatgcttataatcccagctctttgggaggccaaggcaggaggatcacttgagcccaggaattcaagaccagcctggtgacatagtgagaacctgcctctacaaaaaaaaataaaaaaactagtggggcatggtggcatgcacttgtggttgcagctacttgtgaggctggggtgggaggacttgagcctgggaggttgaggctgtaagtgagccacagctgtgtcactgcacactagcctgggcaacagaatgagaccttgtcttttttcttttcttttctttgagatggagtcttgcttgtcgcccagaattgagagcagtggtgtgatcttggctcactgcaacctccgctgcccaggttcaagcaattctcctgtctcagcctctcgagtagctgggactacaggtgcacgccaccactcagctaatttttgtcttttcggtagagacagggtttcaccattttggtcaggttggtctcaaacttcggacctcaggtgatccacccgcctcggcctctcaaagtgctgggattacaggcgtgagccactgcgcccaggctttttttttttttaattaaaggaaaatataatttctctaattctcttacatctaatacaagtatatcagccatacagatatcctgtattttgtgaaagttttaggaattaaatgattagatcctctcaaatattagaaattaagctcaggctatacatacagcccacagaaatgtatgaaattacaaatcaaaagttttgatggcatgaaggcatattggtaggatgaacaaagaaccacgacacggaatattctaaattactcctcttaccctgcagactgacatctggtttgttgtaagtgtaccagtcttgtctgagcagataacagaagtacaaccaagggtttccacagacgggaggcttcgaacaatggcatttttctttgccattctgcgagttccaagagccaggcaggtggtgatgactgcaggcagaccttcaggaatggctgctacagccagggccactgcaattttaaagtagtaaatagcacctctgatccaggaccctccatgaaccgggtcattgaagtgcccaatatttatgatccagactgcaatgcaaataagggagatgactttggaaagctgttccccaaattcatctagtttttgctgaaggggtgttctctcctgttctgttgccaccatttcatcccggatcttgccaatttcggtgttaactccagttgctaccaccactcccatagctttcccagcagcaatgtttgtaccctaggacagaagtagagaactggtcacaagatgaataccacatcccaacttaaataccgacgctggtttttgactagggcacccagattctctacacattctactaggtcttccactggctactgttcaagcaaccagccatacaactgtgacaacaagcaatgctccatgtgctacttacttatgtcaggcagctctgtactgacccacctagatttctatttgagcccggcttgcagaccatcttcaagcagtgctcttaacccctctgtgttcccaatttttcaaactcatatagttcaactctaagcattctccacttctggctccaacaactcaaggcccctacttttctcactgtaatagaaacggcaactagccccatgggctatcttgacaacccctactcatgtgacagggtccaaaaaccaaagaaatcaaatgtgagcagtctctcccatgccactttaattcctagtgttataagagaaggacatggcttcactattttcagggtacctctatttacttactatgggtagtagtcaggttctcatacaaacccacaaatgtccccaacttaaaatcatttcctcactattcaaagaatttttcacatcaatagaaaaagtgaaatagtaaaatgaacattcatatactttgcacctagactcaccattattaatggtttgccatgtttgctttctctctctctctaaacacgcacctttttattgtgaaccacatacaaatagcagctgtcatctacatcattttgaaaataccctttattggctaaggcttttccaaacaaatctacttttcaactatgtttgcaggtaagagtttgaagatgtataagctagtcattattttttggtcccccaaaacttgccaattaaaagacatctaagtcacacgttatgttactgccatattctgacacctaagactgaccatgaaaagtgtgattatcctttagaatgatagccagtgatggttggcagtgaaaaacataacatttgattaggctttggaaatgtctgtaaataaaaacacatttcataaagtacttacagaaaacagcatgttctttttatcttggttgacagctcgtgggtcagggacgggatcagtgtgcttgatgacagagacagattcacctaagcgggttgtgagacagaaaaaacagatctctgcgacccacaccaagaacctagaacctctcattcatgcccacccattaccactcttgggatactgttagtgtgagaaaaggttggcaaaaggcccaattcattcaaaggaggtaagctgggaaaacttagtaatggaaattaataccagaacaaagggtgtcaggataaaaatcaacacaattccaaaataaaaaagtgaattttcaagtagaatccccattgattattttctggagtaactattcaaattaatttatttttcagtaatcattttatactctgatactgtgactgtattatttacatatatttgttgtatactttaataaatactttaacatatatactgatactttttttttttttcgagacagaggtcttgctctatcacccgggctggtgcaatggcaccatcacaactcactacagcctcaacttcctgggctcaagcaatcttcccaacttggcttcctgaatagctgggattacaggcacccaataccacgccgggttaatttttttggtatttttttgtagagatgaggttttaccatgttgcccagggtggtctccaactcgtggactcaaacaatttgctcatcttgtcctcctcaaagtgctggaattacaggtgtgggccacatctggctatgctctggagtagcaattagcaagtgtactggaaagatcgcatggtaaataaagaactactttttttttttttttgagacggagtcttgctttgttgcccaggctggagtccagtggcacaatcttggcttactgaaacctctgcctcccgggcaattttccagcctcagcctcccaagtagctgggattacaggcatgtgccaccatgcccagctaatttttgtatttttagtagagacaggttttgctatgttggccaaggctggtctcaaactcctgacctgaggtgatccccccacctcggcctcccaaagtgctgggattacaggcatgagacaccatgcccagctgatttcaatttaaaaatcatgtcatagatatataattagggtcaatctgagtaaaatatgtctctaaatgttactttaagttacaggtagcaaacttcactctcaatatttgaccaaaaaaattggttccacaagttagccaaaaactacattatgatttcttaatgaaagaaagataatattcgagaacctctatgaagtttaaatttttttttaaacttttaaagttttttattataggctgggtgtgatgacttatgtctgtaatcccagcactttgggggtttgaggcgggcgatcacttcaggtcaggaggtcaagaccagcctggacaacatggcaaaaccctatctctactaaaaatacaattagccaggtgtggtggtgcatgcctgtaatttcagctactagggaggctgaggcatgagaattacttgaaccccggaagcagaggctgcactgagctgagatcgcgccactgggccacagagtgcaactctgtctttaaaaaaaaaaaaaaaaagattttcattatagagactataactgctctctcaaactcttggccacaagtgatcctactgccgcagcctcccaaagtcctgaaattacaggcatgagccaccgtgaccagcctaaaaagtttttaaatgcctgtaatcccagcactttgggaggccaaggcaggcggatcatgagatcaggagttcgagaccagcctgaccaacacagtgaaaccccgtctctactaaaaatacaaaaataagctgggcatggtggcgcacgcctataatcccagacactcaggtggctgaggcaggagaacagcttgaatccaggaggcagaggttgcagtgagctgagatcacagcactacactatagcctgggcaacagagcgagactccgcctcaaaaaaaaaaaaattttttttaaatggcaactacgtctttagggcacactatgagaatttcacacatataacccaaccatttctccaacattttatggcttaattggcctccagcttgttgttgctaatgagaattttaataagtaagctatttataaagaaacaataccaaaaaaaatagagccaggttactcatataactgtctccatgacattagctgcttttcaaaattgataatcagataaatcttgagagcctttagactttatgtttactatttaatccaagttagcattgtatttaaagttaattcttctgacaaacttacttccagttagtatgaaccctccaccctagattgtgcttttatcacacaaaaacgggaaaatgtttcaaacaattgtgcaaattccaggtagtacaattttcatctcttatgggggctaacttttgttcattgtgtatttggatactgtaaagattgatacaacattagcactcctccagtgaaaaaaattacagcactggagtctatttttcttgcctggaaaaaggacatcgaataagtaatttgctttccacaaaacagacaacaattcaaccttaagatttacctatggtaacgaacaaattacaacttttttttggagacagagtcttgctctgtcccccaggctggagtgcagaggcacaagcatggctcactgtagccttgacctaggcacaagtgatcttttcacccagcctcctgagtagctgggattacaggcctggctaatttttgtattttttgtagatacggggttttgccatgttgcccaggcccgtctttaactcctgggctcaagccatctgcccgcctcagtctcccaaagtgttggaattacatgcatgagccaccgtgcccagccattttgttttgtttttaaatcatgcctttaaaaccgtatcggcagccaggtgcagtggttcacgcctgtaatcccagcactttgggaggccgaggcaggtggattacctgaggtcaggagttcaagaccagcctgaccaacaaggtaaaaccccatctctaataaaaatacaaaaattagctgggcatggtggcaggagcctgtagtcccagctacttgggaggctgagacaggagaactgcctgaacctgagaggcggaggctgcagtgagccgcaatcacgccactgcactccagcctgggcaatggagcgagactaaagcactaagaaataagtatcttagagaggattaagatgggataccataaagggacagtgaggcaagagccaactctattggcatggaatatgcgaaggtcttcagaaattcaatgacttaatatatcatatttacctgtgagaattgactggtcaactcttagtgtggtagatttgatggaagttaaccttatatcagcaggaactttgtcaccaactaattaggagaaaaaaaaggcggctgaaatgagcaacttttaaaactatgttatctaaagatgaatttgtctccaaatcaatttttaaagaaaataaatgatctgcatataacacaaatacataaaattcagttaaaacaagcaaagtgatcaacctatcttggagtcataaaaaactttagatggattcaagatttgaattaggaaggaagagaatgaggcttaaggaaacctaactacattattctaagaaattttgctctgtatcttcagacaggccttcaagctttcactttaaagaatactttcctacttagcagtaagtaaaagtcttactacatatacacaaggcacagcaaagagaataaagttgtatatgccatgattcattccatcaaaaaagctaaattattgtgaacaggaagcaaatggccccctttaaaaagatattcaattaacgaaacacatggcaaatgcaaaataaaactacacagtaacaccactttttttttttgagacagggccttgctctgtcacccaggatgtagagatcagtgaggcaatcacagctcactgcacccttgacctcccacttcagcttcccaagcagaaggactacaggtgcacaccacctgggaaacaaagctagtctccatctcaaaaagtaaaataaaataaaatgtttatttccaagttaatcttagctctttcactgtttcaaaccctttgatatgctcgtataacatgtaattaattcatactaaaatgacaacttccaatggtataaagaaacacctctgggaaggtgtagcaaactagtaacactgcacagctggggcatatatcctttgatactttttgaaatatcaattaatgggaggctgaggcaggagaatggcgtgaacccgggaggcggagcttgcagtgagctgagatcgcgccactgcactccagcctgggcggcagagcgagactccgtctcataaaaaaaaaaagaaatatcaattaaatgaataataaacctcttgcataacctgaagatctttaagtcaactgagtcttctttcctaggccaacaagttactttaatagctcttaaaaggcccaaatctcagcccctttccttgatgtgtgtacaaagtgaaattccacaacatagcccaagtaacagacaaagccatgcaccttgagaatagtgcccagccctctgctggtattcaaatactgctgaatgagtggcacaatcacacaaagcagctggacattaaaacagctgtccgttaatcccaacactttgggaggctgaggcgggaggatcactcgaagctaggagttcgagaccagtctggccaacatggcgaaaacctgtctctactaaaaatataaaaaattagctgggaggaatggtagtgtgcctgtagtctcagctactcagacggttgcagtgagccgagttcacaccactacattccagctttggagacagagcgagactttgtctcaaaacaacaataataacaacaaaacagctgtccgtgattttctgaaagataattaaggtggtttgtaagtcttacgaaagggcagctacaaattacataagaaaattctcccatacttgcagatggcattttaaaatcaaatcatttttcagacttactctctatactgaattgcatgttaccagtcatatacaaaatggcaaaatagcactcctgtccaagaagtaaacattgaatttcttattttttattttcttttcagagacagagtcttgctctatcacccagactggagtgcagtggcatgatctcagctcactgcaacctccacctcccgggttcaagcgattcccctgcctcagcctcctgatcaaccgggactacaggcgtgcgccaccacaaccagcctcatttttgtatttttagtagagatagcgtttcactatgttagccagactgatctcaaactcctgacctcaggcatccacctgccttgcctcccaaaatgctgagattacaggcgtgagccactgcacccagccaacactgaacttcttaaaccttcaaattagttctgatttttctctacttcggagcttaagttcagggagaatatggtttacttttttaatttgagtgcataaaaacaatgctatagcctaagtaagcaatgtggtcacaaggcggcacagtttgtcaatatataatctcaacaggcaaagatcacccttgcatttgactgcagggacacacaagctaaggtgaaattcctgctggaaatgcttgtgcaatgaacagcaatattcagactgaatcaacgagaacctttcattttaatataattctgctctaactacattgaagagagtacatctaacagatgatttaagacaacaaagtaactatattctaaactttagtggtctttaacagctaacatgccctatactgcactatttctgcctgtcatgattaacctgatcctacatgccctcgaacatttcaaaaagaggacaagttcaatgatgaatattatgaccctaaatggaaaatttatttccaaatgttcctttggtgtctgaggatttgatttacgtcaatgtcatgatcctatggagtagaagacttctgtccaatgtgagatagcggtcgtcaatctataagcactattttacttctgcattgtaactgctgaacagacttaaacaattcaatatataaaccctagctcatactctcatatacttgacaaattttaaaaggtcaacaaatctaatatttaaattgagtacaacctacaagaggatacaaaagcaatgttttggcatgtgttttgctgtgtttcagtggaagctcagaggatttgaaataaatagaaaatgtatttttcaggtaagaaataccaaggttaaatttcctgggtaacactgccaacatattacaggttgagtatcccttacccaaaatgcttggaaacagtattttaaaattaaaatttggagtgtttgatttatattcttactgttgaacatctctacacaaaaaactcaaaatctgaaatgctccagtaagtatttcccttgagcatcatgttggtgctcaaaaagtttctgatctttgagcttttcagattagggatatccaatcgttatctaacagtattaggtaggaccaatactaaatatacatatttagtatatatacacactgtatttagtaatggtcctacctaacactaatagatacacctacaggaccaacaggtagtacaggactataggtcttacctattggtcctatagtataaatatacaatatgtgtagtatagatttattatatatagtattaatatataatatagtatatattatgtatatgaaagattatatttatactggcattataaggaaaccaacatgtactctttccctttataaaggtctactaaaatatatgaaaggtgtttctttgctgtgcagaaactgtattgatacacatttaacttttggccaaatactgaggaataccttaaatgtcaaatgctagaggaacaaatgtcaaatgcctgggaaacccttaaatactgaccacagctgttctaaatgtttccatcttacaacttccattctaatcaagtggcaattaaatatttagaaacgacaagaagagttatctggagatcttttacagattctttaagagtatgattaaatgcatttggagtggggtctaggaatccactttttttttttttttttttttttcattttttattcttacagacagggtctcactctgtcacccaggctggagtatactggcgtgatcacggtgaactacagccttgaactcctgggctcaagtcatcttcccacctcagcctcccaagtaactaggactacgggcatgtgccattgcaccaggttaattttaaaattaagaatccatatttttaaaaaggttttacaaatacactagaaaaattaatgcaagagaaaaaatgcaatagctagagtcatggatcctatgaacagcttttctgttgtgctgtttctcatctatcaggcacaccaactcgaagctaaaaagctccaaagcctcccaacacttgggaaatatgctaccttagagtttctatgtttaattggcttctattagaaactgatctttgtagaaagatattgaagaaacataaatccaaaaaacctgccatagactgggcacggtggcttatgcctgtaatcccagaactttgggaagctgagacaggcagatcacctgaggtcaggagttcaagaccagcctggccaagatgatgaaaccccatctctactaaaaatacaaaaattagccgggtgtggtggtgggtgcctgcaatcccagctacttgggaggctaaagcaagactatcgcttgagccttggaggcggaggttgcagtgagccgaagttgcgccactccagcctgggtgaaagggcgagactccatctcaaaaacaaaccaacgaacctgccatattctagtattttcttagctagagggaccatcacatcatcttgaccaaccaatgtcctcttcattttatgcacaggaactcaggctaggaagtaaaagtagccttctctaaggaagctcaattaatgaaaacctttgtttaacttgctgtgtgactgttacattccttttgttgatatcagagtcaatttagggttgactctattaggaaaacaggttcttagagttaaaaggttcatgaaagtaaaggtccaccgaatacttttcaagtgaagacacaacaatttccctttgtctggagaggcttctgtgaatttcagacaaaggattttgtgcatgaagagcaggctaggctgttccgatgatcacatcctgtaacatttccctggtgaggcatgtcaatgctcttagggcaagtggtagtggaaaattcttactcttgccaaagggatgctctgcaattttttcttccaaatgtttttctctgactctttgggtggaggcaggtacaataaaagaataaactctgaattaccttccatttaacatctgacacctttcaaattcagctcttgaaaatccacagctctttaatttgctattacaataaagatttccaatcagaacaaaatcctcacagtatacttgcacaagagttcaagtaagagttcattaaattatcagtttgccacgttttagaactccatgcaaacgtttataagccatgatactgaaacattatttgtaccacttatgtcaaatataaatactgatggttaaaactaccattattcaagccgggcatggtggctcacacctgtaatcccagcactttgggaggccaaggcggacgaagcatttgaggtcaggagtttgagaccagcctggccaacatggtgaaactccgtctctactaaaaatataaaaattagcccggcatggtggcgggcgcctataattgtagctacttggaggctgaggttgcagtgagctgagattgcgccactgcactccagcctgggtgacacagtgagactccatctcaaaaaaaacccaaacaaaccaaaaatcagcattatttttttaaaaaatcctttttattaatcaattgtattatgcattttaaaaacctaatttattgtggcaaacaccagttattaaaatcttttataagaaaaacactatttaagaccagaaattaccttctaaatgccactgttgtttttgaatctaaatggctcctaggaaacacaaggcataacagatttatcttaaactacttaaacatttaactgtgactcaaaattttcaccgtgtttccaatttgagtcataaattttgtagtttagcagagactgaatgaaattcttcatttgagaagctctacttgactactttaaactacttccaggcctcacggtgaacagggaaggaacattacacaataccccattatactactgtggtttgctcccaatctgtttcttagacagtactgtctttaaaatggcaaacgtgatctcctcctgttttaaaatctttcaacagcttctttggcatcccaacccgggcttataacagcctccatgacccaagtgctgtttgcctgtcaccctctcacctccctctgagcatcacacactatgctcttcagttcctctaacttgtttctgggccttcacataccctttcttctcccataaatagtaaggctttcctctaactcccagattaggctggcatccctcactgtgtgcccacagagcatcctgtcctttccttacactcgcatggtcttcatgaatcttccccactaaaaccaaaagctccataaaggcagagtcactcagacatcactgatttcctagccctaccactatacctggcacacagtgggtgtcaaataaaatatctgtcaatgaataaagcatttggcacacatatttcctttagtatacatgtagcaaaagacttctaattaccaagttgaagaacatcacgaagctagaaacaataaaaaatcagggtccaaagagataacagctttggttaagctaaatgaggttcaataatggtagttgcttaaattctacgtttagactaaaaccaaaataatctatgccagtaaaagtctagaaatttaggaatggggggatgggaagaacacctaagaaagactgtagttttagctggtagagtaattaagactgccaaagaaatttccatagactgtcagaagacaaaaaatgtctagaatgacaaccagactccatttacataactgcattcaatctgggtaccaaagagaactaccaagatggtaaagcgtttgaaacaaatgctaagactaacttggaaataaacattttattttattttactttttgagatggagactagctttgttgcccaggctggagtgcagtggcatgatctcggctcactgtaacctccacctcccaggttcaggcgattttcctgcctcagcctcccgagtagctgggattacaggtgcccaccaccacaccaagctaattttgtttgtttgctctgtcacccaggctggagcacagtggcgtgatctcagctcactgcaacccccgcctcctgggttcaagcaattctcctgcctccctcccaaatacctgggactacaggcgtgtgccgatgcggccggctaagttttgtatttttagtagagatggggtttcaccacgttggccaggctggtctcgaactcccaacctcaagtgatccacccacctaggcctcccaaagtgctgggattacaggcgtgagccaccgcacccggccaaaaataaaaattttaggatacgctatactgctaacatttgacagtcctagtactgccacaaactgccacatgctcctggataagttacaaactctgagttttagtcttctcatcccctaaaataaggtttcataagctccccttcagatctaaactggtgataaatcagatttctatgtggctccaaattaaaaaagctaacatacacaacagacaaaatatattttagctcataaggaatattttataatgaactgactaaaaaaatgacactgatcattaagcaagtttccagttactagagttatgggggtagaaaggtaaccaattcattagatgttgcaaaggcaaccatgcactaagcaatgttagagtactccagcctacctaccaacagagatttttatcacaaaagaaaaatgcacgtttaaaaggtcaaacaccattcttcttcccctctttcaacagatatatatacagttaacagtatattgccgggcgcgatggctcacgcctgtaatcccagcactctggaaggctgaggcaggcggatcacaaggtcaggagaacgagatcatcctggctaacatggtgaaaccccgtctctactaaaaatacaaaaaattagccgggcatggtggcgggtgcctgtggtcccagctacttgggaggctgaggcaggagaatggcatgaacccaggaggcggagcttgcagtgagctgagatcatgccactgcactccagcctgggcgacagagcgagactccatttccaaaaaaaaaaaaaaaaagtgtatcttctggattttctggacatctctttatgtacaacattcactaaaacaatattagaccttttatatttatacatacctgtctcattttaaaaagtggctgtatagtaataataagcaatgaaattttgagactattatttctagaccaggtactgctggaacagcttcacaggttactaattcaatcttcacaactctaaggagggatctattatctttactccctccctgtttatagatgaggaaaatgagacactaaaaggtacttgttcaaggccacagtatttcacaaccataccatgaactaaatgaatcatcctctatttttatggctatctagttatttctaacatttccttttacggtgttacagggttaacatcttcgtctgttatcttttacttttgcatacaaatgtatactcccaccaagtttatgtccctcctgtttccccattctctcaatcttgtatttttctggcactgataatgccaagccctttgttttactttttttttttttttctttttttgagacagagtttcactcttgctgcccaggctggagtgcaatggcacgatatcagctcagcacaaactctgcctcctgggttcaagtgattctcttgcctcagcctcccaagtagttgggattacaggcaagcgctaccatgcccagctaattttgaatttttagtagagacagcgtttctccatgttggtcaggctagtctcgaactcctgacctcaggtgatctgcccgcctcggcctccaaagtgctgggattacaggcatgagccagtgtacccggccaccaagcccttggttttcaaaagttccattatcggccgggcacagtggctcatgcctgtaatcccaacactttgggaggctgacggtgggtggatctcttgaggtcaggagttcaagaccagcctggccaacatggtgaaaccccgtctctactaaaaaaaaaatacaaaatagccaggtggggtggtgcacacctgtaattccagctaatgggaaagctgaggcagaagaatcgcttgaacccaggaggcagaggttccagtggtccaagattgcaccactgctctccagcctgggtgacagagccgagactttgtctcaaaaaaaaaaaaaaaaaaaaaagttccattatcttttaatataaaagttggtcacagttaaatctgcccatctaggtggtttggtgttaatgcttaggaaaggtggttcccatggccagcagcggtggctcacacctgtaatcccagcactttgggaggccaaggcagatgaagcacttgaggtcaggagtttgagaccagcctggctaacatggtgaaaccccatctctactaaaatatacaaaaaattagccggacattgtggtgggtgcctgtagtcacagctaacggggaggctgaggcaggagaatggcgtgaacccaggaggcggagcttgcagtgagccgagatcattccactgcactccagcctgggcgacagagcgactccgtatcaaaaaaaaaaaaaaaaaaaaaaggaaaggtggttcccaaaccacatggtttcttctcctttttccaaaatcttcatctcagtagcaagaatgaaaaggttggcacttcctggtactgtgactaccactgaatcatggggagtagagaggaggtgattacaggaaatcaggaaggaaatgccagccccatgaaatcaggtcaggcttcaagatcaactggcctatcatggtctgatggttgaggagaactctcatttctcacagttcttaatgtcttagctattctgacagtgctcaggggctctcaaactcaaaaactctctatgctgatttttgttttagactattttgctcttctgcttatccgttttctagagtaataatttataccttggctttggaaacagaggtatagcttccaggatttacagaacaactaaagcaatttttcttttttgttttgttttcttttttttttttttttgcaacagagtctcgctctgtccctcagggtggaatgcagttgtgcaatctaggctcattgcagcttccatctcctgggtttaggcgattctcgtgcctcagccacccaagtagctaggattacaggcatccaccaccacacccgggtaatttttgtatttttagtgaagatgggatttcacagtgttggccaggctggtctcgaactcctgggctcaaatgatccgcctgccttggcctcctaaattgctgggattacaggcatgagccaccatgcccggcctgtacttcagttttcaaaactaaatagctagaatcctgaggtggactttctgaggaggaggacaaatgaacctcctgaagttgcacacaagattttcaatatatgtttttggggaagaaagtccataaatttcattaattctcaaagggactgtgatctagaaatgattaagatctgctctagagccttgctactcaaattattgacctgggagcttattagaaatgcagaataatcaggccccatttcagactgaaccaatcaaaacatacattttaacaacatccccaggtaattcctgcacacatgaagttagagaaacattgatctaagcagtgtgcaaaatcttaaggctccccaccccccgaactttttttgggagacagagttttactctgtctcactctgtcacccaggctggagcatactggcacgatctgagctcactgcagccctgacctcccaggctcaactgatcctcccacctcagcctcccgagaagcagggactacaggagcacgtcaacatgcccagcaaattttcattttttatttttttagagacggggtctttccatgttgcccaggctggtctcaaactcctgagctcaagtgaacctcgtctcagcctcccaaagtgctggcatgagccatggctcccagcctcactatgcaagtttttaaaactttttttgtaaagacaaggtctcaatatgttgcccaggctggtctcaaactcctgggctcaagtgatcctcctgccatggcctcccaaaatgctaggattgcagggataagccactgcacccagccaacacctttttttttttttttttaaacaattctcttttcatattttacaaaagactttggtacagagattgttgtggcccacaaaacccaaaatattagctggacgctatagctcacacttataatcccagcgtttttttttttttttttttttttttttgagatggagtctcgctctgtcccccaggctggagtgcagtggcgcgatcttggctcactgcaacctctgccccctgggttcaagtaattctcctgcctcggcctaccgagtagctgggattacgggttacgggtgcctgccactgcacccggctaatttttgtatttttagtagagacgggggtttcaccatcttggccaggctggtcttgaactcctgatcttgtgatccacccgcctccgcctcccaaagacctgggattacaggctaaggcaggaggatcacttgaggccaggagttcaagaccagcctgagtgacacagtgagacctcatgtctataaacaaacgaaccaaccaaccaacccacaaagatagtatgccaactcctctgctctacagcagactgactactctgttttgtgttaaagagcatttaatgtttgctaaatgtttaaagccagtcaattccaaccccaacagctttctaaaagcaaaaaaaagtccacatggactcatggccatactatctaaatcacactttttagagcaagaaagctccttgaaacagtactccaattacctaattctgcagaggttaatgtacatagtccaatgtcatgcagaactaggatcataatccaggttcttatatgaatccactcatctatttcacaactctgccttttactcaactgcttcaaaagcagtttatacctgctactaaatctcagtactgcatgttaactgtctgaagtaaaagtttccttcctttaaattgaaagttttcttcctttaaattgctgtcaagtttaagaattattctttttattcccgagtaaatcttgaaattgctggcaccctgttggctattaagtcttcattttaggaaataaaattatcaatttctgtacaagtgctaaagcaaatgcaattttaagattgtgttgcttccactacttaaatcttaaaagatgattcgctccagagtatatactacaagacagaagtcatctgagaatatttatttcctggtgctattcatcaaccctgggttaccaagatacataaagtttgttttaaacaaccctgaaaacagtgttcttaagaagtcaataaataacccctgcggcatatactagaagccccaaaattctaaaactaagacttctagctgggaatggtggctcatgcctgtaatcccagcactttgggaggccaagggaagaggatcccttgagcccaggagtttgagactaggctgggtaatacagggagaccttgtctcaaaaaaacatcccacaaaaccatggccgggcacggtggttcatgcctgtaatcccagcactttgggaggccaagggaggcagatcacttgaggtcaggagttcgagaccagcctggccaacatggtaaaatcccgtctctactttaaaaaaaaaaaaggaaaaagaaaaaaagaaaacagaaatgacttaggctattatagcttgattcactttcatgtcagcagataatacagaaagcttaaaaacaatgacgttcatttcttataagattatgtacaacttcactacttttggtttccatccatccggagaaatattttcttggccttaagataatgtagaattactgtggcttcttaagaggtgaacatgtgggtcactttctcttttttttttttttgagtcagggtctcactctgttgcccacgctggagtgcagtggcttaatttcagctcactgccacagcctcgacctcctgggctcaggtgatcctcccacctcagcttttcaagtcgttgggactacaggtacgcaccaccacgcctagctaatttttgtattttttgtagggatggggttttactatgttgcccaggctggtctcaaactcctggactcaagtgatctgcatgccttggcctcccccaaaagtgctgagattacaggcatgagccactgagcacagcctatgtgcgggttattttctccatgtttttatttgccatatcaatttcatttggctcttgtgttctagatacttaagactcacattagcatttgctatgtatgcttacccagtttctctttggaatgattagctggtatagcaacatataaaatttagtttcctggctgggcatggtggctcacacctgtaattccagcactttgggaggctgaggcgggcggatcacttgaggccaggagttcgagaccagcctggccaacatggtgaaaccctgtctctactaaaaatacaaaaattagccgggtgtggtggcgggcacttgtaatccctgctactagggaggctgaggcaggagaatcgcttgaacccaggaggcggaggttgcagtgagctgagatcacgcccttgcactcctgcctgggcgacagagtgagattccatctcaaaaaaaaaaaaaaaaaaaaaaaaaaaaaaaaaaattagtttccttaaactctctctccatatctccctcaaaaaaccacctattccagcttagtctttgaaaagttcagccagaaccatcctaccagatatcttccaaaagctgacaaagaattttaaagtcaggagatgacccttacattccaaacagtgactacaaaaaggtctgttcctttctgcaaatatcaaaatcgttaagtcagtacttttttattttcagcttcgaattagtttacaacactctccagttttccaacacatctgaaaaaccccttcacatccaatttcataatgtaaatgaaaatataaaagtcaccatgtctaaaagcacaatttatgccatttaatctttcaggctacgcaaatagtaccttcgactgacaagaaaaaattcagaattaaagttcactctatagttttcacaaaactgaattatcaggctaaatgctagattgcacagtcaatttgattactaattctaaaagaggtggaagtttaaaaggctcaacgtgtatagtcttaataaaataaatacctatttatctggcccaggttatacagtcacggtatgcttttccaaaatgttccatataatagttgcaaatgccttagaattatatcttacccaattcaatgacctgctggtcctagtaacccagcaaactatcatttctgatttgcatataagtttacaaacaccatgaaaggtcaccagagtatactgacaacctaaatattacagctgtaactaggcttcctcaacatgataaagggcacccgcctatgagacccacacctatgtcacacttcactgtgaaggactggatgctttcccctacgatcagtaagacaaggatgtctgctcttggtacttcaacgttgtattggagattctaaccagggcaattaggcaagaaataaagggcatccagactagaaagaagtaaaaacattttcatttgcaaatgcatgatcttgtatatagaaaatcttaaggaacccataaaaactattaaaactaactaatgagttcagcaagatggcaaactacaagatcaatacgtaaaaaactatttctacacgctagcaaagaacaatctgaaaatgaaattgaaaaaagaattcctaactcaaggcaaattaaagacttaaatgtaaggcctcaaactgtaaatatcctagaagaaaacctaggaaatactcttctcaacactgccctaagcaaagaatttatgactaagcctcaaaagcaaatgcaacaaataacttgacaattgggacctagttaaacgaaagagtttctgcacagcagaagaaatctatcaacagagtaaactgacaacctacagaattggagaaaataattgcaaactatgcactcaacaaaggactaatatccagaatctataaggaacttaaatccacacacaaacacacacacaaaatcactgttgaaaagtgggcaaagggtatgaaaagacacttctcaaaagacaacaatcaagtagtcaacataggaaaaaatgctcaacatcactagtagagagatgcaaatcaaaaccacaatgagatgtcatctcacaccagtcagagtgactattattgctgggcacggtggctcacgcttgtaatcccagcactttgggaagctgaggtgggaggatcactggagcccaggaattcaactactagccagggcaacatagtaagacctcatctctacgaaaaaatttaaaaatgagcctgtcatagtggtgtgtgcctacagtcccagctaacctggaaggctcaggtgggagggtcactagagcctggaaagccatggctcaatgagctataatcatgccactgtgttccagcctgggcaacagactgagatcctgcctcaaaaaaaaagaaaaaaaaaaaaaaaaaggtggtggggctggggggaacacttatacactgctggcaagaatgtaaactagttcagcccccgtggaaagctgtttggagatttctcaagaaactaaaaacagaatgaccattcaacccagcgatcccattactgggtatatatcccaagaaaaagaaattgtggccgggcgtggtggctcacacctgtaatctcagcactttcggaggccaaggtgggtgaatcacttgagcccaggaattcgagaccagcctgggcaacatggtgagaccttatctgtacgaaaaatacaaaaattagttgggcgtggtgggcatctgtagttccagctacaaggaggctgaggtgggaggatggcctgaactcacaaggaggctgaagtgggaggatggcttgagcttgggaggtggaggttgcactgagccaaaatcgcaccactgcactccagcctgggcgacagagtgagaccctatctcaaaaataaatgtggtatatatacaccatgtgatactacgcagccatgcaaaagaatgaaatcatgtcttttccagcaaaatggatgcagccagagactattatcctaagtgagttaacccagaaaaccaaatactgtctgttctcacttgtaagtaggagctaaacactgagtacacatagccattaagatgggaacaataaacactgggcactccaaaaagtgggagggaaagaggggcgagggctgaaaaactatctgtgaagtactatactcatcatctatactcatcatctggatgacaggatcagcagaagcccaaacctcagcatcacacattaaatccacataacaaacctgcacatgtaccttgaatctaaaaattttaattaaaaataaatatcactaggccgggcgcggtggctcacgcctgtaatcccagtactttgggaggccaaggcgggtggatcacgaggtcaggagatcgagaccatcctggctaacatggtgaaaccctgtctctactaaaaatacaaaaacattagctgggcatggtggcaggcgcctctggtcccagctactggggaggctgaggcaggagaatggcgtgaacccgagaggcggagcttgcagtgagcagagatcgtgccactgcactccagcctgtcatagcggtgaaagagcgagactccgtctcaaaaataaataaataaataaatatcaccaataggccaatttcaagttacaaaaaattattccaattacaaatattccccccgccaaaaatgcaataacaaaagaagcacaagacttgaacactgacaaccagtgttgaaagaaatgacagaccttaaaaaaaaaaaacaaaaaaaaaacagacatccctatgctcatggatccaaagacttgatattacgaccatatttcccaaactcatctatagatacaacacaattcttactgaaaataccagcttgctttctgcagaaattgacaagcaactcttaaaaatttatatgtaaatgtaaggaacccagaatgcccaaaattatcttgaacaaagttacactcccaagttcccaatttcaaaaaatacaaaacgacagctagctatcaagacagtatggtactgacctaaagacagagatcaatggagtaagaatagagtctagaaatacattcttgcatttgtaaattaatttttcacaaaggttgcaggacaaattagtgaagaaatcttttcaacaaatggtgctgagacaactaaatatccacatgcaaaagaaagcagctggatctcctacctcacaccatagtttttgctgttgttgctgtttttaaagaggcaaggtcttgctttgttgcctagggtggaggacagtggcaggatcatagtagctcactgcagcctccactcttgggctcaagtcatcttcgtacctctgcctcctgagtagtgagactacaggcctgtaccaccttgcctggctaatttaaaagtgtttttttcctaggctgggcatggtggctcttgcctataatcgcagcactttgagaggctgaggcaggcggatcatttgaagtcaggagttcaagaccagcctggccaaaacggtgaaaccccgtttctactaaaaatacaaaaattagctgagtgtggtggtgtgcacctgtaatcccagctactcgggagactgaggcgggagaatcgcttgaacccaggaggcggaggttgcactgagccgagatcatgccactcgctgcactccagcctggacaacagagcaagactccgtctcaaaaagaaaaaaaaaagtggtttttcctgcctcagcctcccaaagtgctgggatcatataggtatgagccacgacgcctggatcatatatactggctaatatataaagtctttgtgaccttcaattggcaacagtttcttagacatcacaccaaaagcacaagcaacaacaatgtataagtggactttatcatattaaaaacttgtatgttacaaagtatgccatcaagaaagtgaaaaaaaggaatccctatagaatggggaaaaaattttgctaatcacacctcataaggcaggatatgtaaagaattcttatacctcaacattaaaaagacaaataacctaatttaaacaggcatttctccaaagaaaacacaccgatggacaatagccacatgaaaagatgcccaacatcattaagaaattagggaaacggacgtcaaaaccacaatgatactcacttcctgggtaaaactttaaaacgatagacaatgacatgtcttgacaaggatgtagagaaactggaacttgtatacattgttggtgggaatgtagaacaatatcaccaccattctgaaagacagtttggtagctgctcaaaatgttaagtatagagtcactataggccccataattccatgcttaggtacatacctaacagagagaaaatgttatgttcacacaaaaattagtacaagcatgtatgtacaagttatagcactattcattactcataatagaccaaaactggaaacaacccaaatgtccatcaactaataaacattattcagcagtaaggaatgaaatacatgctatattcatgaacgaaatgtaacactatgctaagagaaagccagtcaccaagattgactccatttatatgcaatatccagaaaaacagacagtaatccacaaaacagataataaactgtggttgtcaggaactggtgggaggaaaacagggcaacaactgctaatgggtatgggtttttctgagggtgatgaaaatgttctggaattaagataataatgaggatcacacagaccttgaatatactaataatctggcattcaataattgtattgaaggccaggtgcagtggctcacgcctgtaatcccagcactttgggaggctgaggcaggtggatcgcttgaggccagaaattcaagacttgccgggccaacatggccaaactctgcctctactaaaaatacaaaaatattagccaggcgtggctgggcgcggtggctcatgcctgtaatcaatcccagcactttgggaggccgaggaggatggatcacgaggtcaggggcttgagaccatcctggccaacacggtgaaaccccgtctctactaaaaaatacaaaaattagctgggcgtggtggtacgtgcctataatctcagctactcgggaggctgaggcaggagaatcgcttgaaccagggagtcggaggttgcagtgagccaagatcatgccactgcactccagcctggcaacagagcgagactcgtctcaaaacaaacaaacaaacaaacaaacaaaaaagcaagcaagccaggcataatggcccaagcctgtaatcccagctactcgggagactgaagcaggagaatcacttgaaactgggaggtacacaggttgcagtgagccgagatcacaccactgcactagagcctgggtgacagaacaagactctgtctgtataatattataataataattgtattgaacacacacatacacttcaactgtttgttctgcacagcaactatgtttacattagctgagcctatcatatacttctgatttcaaatttcattcatagagaacttacgataacgttacaacagtcaatatgacagttctgtccttaaggtgctcactgcctagtagtatgacaacagtatttaataaaatgcccacatacattctaaacctagatgtctgttctgcattactcagttaaaaaggtcacaatttaagacgaaagcaagcagcacttaagagcccaatgtctcacacagctgggcttaactaaaataataataggccaggcacggtggctcacgcctgtaatcccagcactttgggaggccgaggtgagtgggtcacgaggccaggagtttgagaccagcctggccaatatggcaaaaccccatctctactacaactacaaaaatcagctgggtgtggtggtgcatgctggtgagcccagctaattgggaggctgaggcacaagaatcacttgaacaggcaggcagaggttgcagtgaaccgagatcacgctactgcattccagcctgcacagcagagtgagaccctgtctcaaaatagtaataataataataataataataatagtaataaaaataaaaattaaagaaaaacagagcccaacgtcaaagcaatatatacgctttttagcaattaccatactgtgggggaagagctggggaaaaaaagtggtaaataactaccagaatcagcactatctatgaaggattcagaaacaggtgaaaggaaaatggatttaaatttgtactccactttatagtagtagtatattcacctaagggatttaaactcaggttttttttgaatattaaattcattgtcttttgaatattcaaataaagggaatggttgccaggggccagggaagaggggaactggaagtcagtgtttaaggtgtacatttcagttagggaagataaaagttctggatggtgacagtcccaaaacaatgtgaatgtacttaatgccacagaactgcacgcttaaaaatggttaaaatgggtaagtttataatatgtatactttaccacaatataaataaggaaaatcccattagactgaaaatcttaagtcacatacactatagatcaaacattatttgtcctttctaaactatcaaatgcaacaacaaaactatattacaatatagaaaatgaaatttcagtgtgagaaagcgagataggtcagggtaataatcaaagcttcaccaccataagatcagtgcattgagcaaattaataaactctataaaatttgcctaaccttccaaaaaaaggtgactttggtggtactgaaaactgaaaaaaaggcctggatgtctgcaacatgaaggagcagcacaagatgaaatcatagaagaaagcaggaggtacatacacacaatgcaagtttatcaggtcagagaattttgtattttaagtgcaatggggaagtcccttaagggttttttagcagatgaataaataacacaacctttaagaaaccactctggcacttgtgtggagaatggactggaggaagacaacaaaggaagccagagcctagttaggagatgatgacagctgcggtgtgagatgatggctagactagtgtgctgaccaaggaaacggagttcacgaacttgggtgtgttctggagacagaatcagtggccttacggacaaatcagaggataagaggggggaaaaaatcaagatgacttccaagtttctcacagttaattaggttagagtgtcttacaaaagacgggaaggactggcaagaatcaggattcaaagatacagagaaaccagaatcaccaactgaagagaagctggcttttgtctctttcttcaaaaaggatggtgctttgaggtatcacagttgtagtttcctctgaagctgtctaccattgccatctactgatgcaaactaaggataaaggctttgggggtaatttctctaaggcttcaagtagactcaacacactaaaacagcccaacaaggcagagcacagtggctcacacctgtaaatcccagaactttgggaggccaaggcaagaggatcacttgaggccaggagtttgagaccagcctaggcaacatagctagactctgtctctatttttttaaaaaaattaaacaagaagaagctggagaaactgtaagcataaaatcaaacagaatctcatacacatatttaggtgatgtcatctacaacctcacccaccacatatatttgtggaaaaacaatctcctttccaatgtttccttctgtaggtagtagagtaccatcatcacacccagtcacgtaaactagaaatcttgccagtatctttgatttacacactctcctatctattatcaaaatctgttgctttgagccaggtacagtggctcacacctgtaattacaacactttggaaggccaaggcaggaggaggaggatcgcttgagcccagaagttcaagaccagcctggacaacaaagcaagaccccatctttactttaaaaaaaaaaaaaaaaaaaggccgggcatggtggctcacacctgtaagtaatcccagcactttgggaggctgaggcgggaggatcacgaggtcatcctggctaacacagtgaaaccctgtctctactaaaaatacaaaaaattagctgggagtgttggtgggcacctgcagtcacagctactggggaggctgaggcaggagaatggcgtaaacctgggaggcgaagcttgcagtgggccgcaatcgtgccactgcactccagcctgggcgacagttcaagattccgtctttaaaaaaaaaaaaaaaaaaaagctgggcatggtgtcatgtgcctgtattaccagctactcaggaggctgaggcaggaggacccccttgaagccaaggagttcgaggtcgcagtgatcacactactccactgtagcctggacaagagagcaagcccctgtctccaagttaaaaaaaaaaaaaaaaaaaagagagagcgagaaagaaggaaaagagggaggacagaaggaggggaggggaggggaggggaggggagggaaagggggaggaaggaaggaaggacagacggacggacagactgacggaaggagctgctttaggccgtgcgtggtggctcactcctgtaatcccagcactttgggaggctgaggcgggcggaccacctgaggtcgggagttcgagatcagcctgaccaacatggagaaaccccacatctactaaaaatacaaaattagctgggcatgatggcgcatgcctgtaatcccagctacttgggaggctgaggcaggactgcctgagcccaggagtttgagagacaagcctgagcaacatggcaagacccatctctacaaaaaaaatacaaaacttagccaggtacatggtggctcatgcctgtgatcccagtttttcaggagactgaggtgggagaatcacttgagcccaggaggtcaatgctgcagtgagccgtgatggtgccattgcactccagcctgggcaacaagagcgaaactccatctcaaaacaaaacaaaacaaatctgctgttttgtaactaagtcagaggctcactctttgaactactcacgatcagaactctgtacccaatggagattcagagttaatattctaggttgagacctgccaaaaacttttttaaaaagagtgcccccagatgattgtgatgtgcactcctgcttaagagccactattcatgaactcaaaaatctttccttcattattcttaatgttactgtcctcattatctcttgcctagactactaaaatagcctccctatatcttcagccttccccattctgacctattttcttcatcaccatcagaattccctaattcaaatattttttgctattaaaaaaaatgtgggccaggcgcagtgggctcacgtctgtaatcccagcattttgggaggctgaggcaggactgcctgagcccaggagtttgagagaccagcctgggcaacagggcaagacccatctctacaaaaaaatacaaaacttagctaggagcttggttgctcatgcctgtgatcccagttattcaggaggctgaggtgggagaatcacttgagcccaggaggtcaacgctgcagtgagccgtgatggtgccactgcactccagcctgggtgacagattgagaccctgtcttcccctcatcaaaaaaagtgataactggtaaattctgaataagatcttacatactattgcatcaatttcctaattctgataatcatactgaggttatataagagaacatccttgatactataaaacaaatgttatttaggagttaaaggggcatcatgcctgcaatatacccttcaacagttcatacaaaaatgtgtgtatacagagtgaaaaaataatacatctgtgatagtataacatttgtgtcaaaacagaaaatttgtttttttgagatggagtctggggctctgtcgcccaggctgcagtgaaatggcacgacctcggctcactgcaacctctgcctcctgggtttaagagattctcctgcctcagcctcccgaggagctcggactacaggtgggagccaccatgcccagctgatttctgtattttcagtagagacagggtttcaccattttggccaggatagtttcgatctcttgacctcatgatctgcccacctcagcctcccaaagtgctgggattacaggcatgagccaccacgcctggccaaaacaggaagttttaaaaaatccaatagccaagacatttcattctgagttgtactcttcttaacactatacttaaggaagctgttaaatcatttacacacaccatttacacacaaacactacacagtcccaaataattggcttactggcatatatgtaacactatcctttttttctggaggaacaacaaaaatttctggatgagagaataggacaaggcaatttcctttcagaggccaaagttgtagagcatgggttaaggaatgcagctctttcaattcattaaaatgagtaagacaataaagacaaagcacacccttcccaagtcaatataaaagcatattactatgagataattcacaaatagcaacaaagtaaatagtatacttaactcagaagggtatgaaaagccagataatctgaataacagtatgcaatgactctctaagtgaaatagccaaaacaaacaacccacctagactatcctggttggtcccaggggtgttgtgattttggactgtcagaaatatggctgctgggcacacctgtaatcccagcactttgggacgctaaggcaggatcacttgagctcaggagtttgagactagcctgagcaacatggcaaaactccctctctacaaaaaatataaaaattaggcgagtgtagtggcatgcatctgtggtaccagctatttggggggcaaagtgggaggatcgcttgagcttgggaggtggaggttgcagtgagctgagatcatgccactgcactccagcccgggtaacagagtgagactcccatctcaaaaaacaaaacaaaacaaaacaaaaaaacagcactaatctacagcagtgaggatactgacccttggaggtctgtggagcattctggactcacagtggattcatggactctttgaagctatctctggaattcaggcagagactcctggctcagtgtaacacataagtatttttaagcatactgttttttttttttttttttgagatgaagtctcactctgtcatcaagatggagtgcagtggtgcgatctcagctcactgcaacctccgcctcccaggttcaagcgattcttcctgctgcagcctcacaagtggctgggactacaggcacacaccatcatgcccggctaatttttgcatttttagtagagatgaggtttcatgttggccagggtggtctcaatctcttgacctcgtgatctgcctgcctcggcatcccaaagtgctgggattacaggcgtgagctaccaagcctggccaagcatagctttcagagtcaagaaattacccttgaccatgaactttggtgccaagaaacaaaacaggaaaaactgtgtcgtcattagccagtattctaacaaattgttcactataactaactgtcaaatcaacattaggttttacctctctagcacttgtgttctacaatgtatttaaacaagtagaattcaaaataccttgtttaaaaacaaaaaccaaaagccttatcaatgacaggaagggaggtgctaaaacatttcaaaataattttagagaatgtaggatttgtatgaatggcaataaaatgtgttaattgatacatgaaaacaattattttaaatataattatgagccttgagaaaaggactacattcagaaatactatctagaataaaagaaaaatgacaaactcaactcaccagcaatttctacaatatcaccaggaactatgtctttagctttaatccgctgcacactctttctgtcctgtcgatacactttgcccatttcaggctcatattccttaagggcttcgatggcattttcagcatttctttcctgtataaaagaaaacagaagagtagtaaagacctgcctgacactgcaattatttctaacccaaggaataaaatgttagaggtctaatctttaaaaagaaaggaagcccaccagtaacatttgtactaaacaattcacatctaaggcaacagacacaaggacatttattaatttgtattaaaaacgaaacgttaagtaccctcaattaagctaaggggataaaacaatgaggaaaagcaattacagactctgctgtccctaagactgtaaaacacagctttcacctttagccaaatccccctgccatttaaaatcaattctgtctcatgagaggcagtacagcttaatagtctgggctcaggaggctgaggcagaagaatcgcttgaacccgagaggcggaggctgcagtgagacgagatcctgccactgcactccagcctgggcaacagaaagagactatgtcaaaaaaacaaaacaaaacaaaacaaaaaaaaccccaacccaacccaactctgggctaagctgcccaggttcaatacaggctcttaacagctatgtcactgtagagaggttacacaacacacaagtttactgtctataaaatgacaacactaacagttcctacctcaaggtttgtgaggataagaagtcatatgtaacatgcttagattgtgtttgggcacacagtaaatgctatgagtgatgagtatctctcacaaattctaagaactatccctccagttgtaaagaccaatgaatggctggactctcatcatagcactgccagtcccaagctatatatttctcatgacatcatatatgaactatcaaccgttagaagtcacagtaattttcttcccgatttcagaatggaagttgtagaatcaaaccagcctaaagagaatcaaatgacacaaagatgaaagctggtaacacgtgtacctcagttttgatgtatataccccagaaaaagtataaaaaaaccttaattgggaaattcatgataaagttaatttcaatctcatatcagacattcttacccttcaagatcatgttgggtggaatttaactggactgctcaaggttaaacaaatatcccatgagcactgtattttgcatgtgcttaaattatcagctgagcacagtagctcatgcctgtaatcccagcacttttgggaggctgaggtaagaggactgcttgagcccaagagttccagaccaacctgggctgaacataacgagacagtgtctctacgaaaaatgcaaaaattatcctgacatggtgccatacacctgcagtctcagctgctcaggaggctgaggtgggaggatcactaagcctgcgaggcagagattggagtgagctgtgattatgacactgcactccagcctgggcaagagtgaagctgtcttgggggaaaaaaaagataaattatctctgaccctgagaacaaagatgacaattacaatcaatgaaaaggctgggcatggtggctcacacctgtaatcccggcactttgggaggctgaggtgggcggatcgcctgaggttgggagtgcgagaccagcctggccaacatggtgaaactgtctctactaaaaatacaaaaaattaaccaggcgtggtggtgcacgcctgtaatcccagctacttgggagactgaggtgggagaatctcttgagtccgggaggtggaggctgcagtgggccaagatcgtgccactgcactccagcctggttgacagagcgagactccgtcttaaaaaaaataaagccctccttgatgacactggtcagaaataaaagactatgcccctcatactaccttatactgtcattataattttccttactttcagaaggccacaaccctctattgctgctcataccattcagtatactaaagacttaagaatgttctttttttaaaaactcgaatcttttttttctgagacgaagtctagctctgtcgcccaggctcgagtgcagtggcatcatctcggctcactgcaaactccgccccctaggttcaagccctgcctcagcctcccaagtagctgggggcgcatgctaccatacccagctaactttctgtatttttagtagcgacggggacttgccatgttggccaggctggtctcgacctcctgaccttaactgatccacccgcctcagcttcccaaactgctgatactacaggcatgagctaccatgccctgaccaaatataatttttttgagaaaaacataagaagaaggccaggcacagtggctcacacttgtaatcccggcactttgggaggccgaggcaggcggatcacaaggtcaggagatcgagaccatcctggctaacacggtgaaaccccgtctctattaaaagtacaaaaaattagctgggcgtggtggtgggcacctgtaatcccagctattcgggaggctgagacaggagaatggcgtgagcccgggaggcggagcttgcagtgagccaagatcatgccactgcactccagcctgggtgacagagtgagactctgtctcaaaaaaacaaaaaaaacaacagccaggcatggtgacagtcacctataatcccagctactcgggaagctgaggcaggagaattgttcaaacccacaagacggaggttgcagtgagccaaaatcacaccactgcactccagcctgggcaacagagcaagactccatctaaaaaaaaaaaaaaaaaaaaaaaaatatatacacacacacacacacacacacacacacacacacacacatatatatggcacaattacaaatctctaagtaggccatctttctatgaacctaccacataaagatcgttaacatttattggtaaagattagaagtttacaatttcaacaggactaagtatgtttataagatgtgtcgggcgtggtggctcacgcatgtaatcctagcactttgggaggccaaggcagggggaatcatctgaggtcaggagtttgagaccagcctgaccaacaaaatgaaaccccatctctattaaaagtaagtaagttagctgggcatggtggcacgtgcctgtaatcccagctacccgggagggtgagacaggagaattgcttgatcccgggaagtggaggttgcagtgagccaagactgcaccattgcactccagcctgggcaacaagagtgaaagtcggtcaaaacaaacaaacaaacaaacaaacaaaaaaaaaaaaaaaaaaaaaggccgggagtggtggctcacacctgtaatcccagcactttgggaggccgaggtgggtggatcacgaggtcaggggtttgagaccagcctgatggtgaaaccccgtctctactaaaaatacaaaaattagctgggtgtggtgtcaggtgcctgtaatcccagctactcaaggaggctgaggcagaactgcttgaacctgggaggcggaggttgcagtgagccgagatcgtgccactgcactcctgcctgggcgacagagagtcggtctcaaaacaaaaacaaaaaaaaggtctacttcagtcctcaaaggggtgattatatccgtcaaatacctaaaagatcaacacttaacatgaattttaagtctcagagtctgtagtaagcactgaaggggaaacaatttttatagctaaacctaccaaaaaaacccaaggagaataaaaatgacatgtagcttttaaagtttgtcacaggaagcaactaggagacataaagataatggttctcacattctcatttccttaagcagcttctctcacccattttaattccttgctaccgtaaagaatgaacaatgtttttctgagacagtgttgctcctttgcccagactggagtgcagtgttacgatcatggctcactacagtcttgacctcctgggttcaagcaaccctcccacctcagcctcctgagtagctgagactacaggctggtgccaccacacttggcgaagaatgagcaatcttaactgcaaagtttatatgcattaaggtcaaaaatttgcaattaattaaattaataggccgggcatggtggctcacgtctgtaatcccagcactttgggaggctgaggagggcggatcacttgaggtcaggagctcaagaccagcctggccaacatggtgaaaccctgtctcttaccaaaaaatacaaaaatgagctgggcgtggtggtgcgtgcctgtagtcccagctacttgggaggctgaggcacgagaaccacttgaacctgggaggaagaggttgcagtgagccgagacaacaccattgcactccagcctgggcaacagagtgagactgtgtcagaaaacaattaatttatggaataaagggaaaatacatgtaaacttcccgcaaacatatttttactcaacacatcaggaaaaacagataacagaaagattaatacagccctaatcacttacataacttattgaaattttgcagtacaggaatttttgcttacctgccatacacccacaattgcattggctactaatatgagtaaaattacaaaaggttctacaaaggctgtaattgtttcttcaccttcttcaaaccaagccaaaacctagaagagaaatggcacgttagaatgtgtctttttaggcttaatgtcacttttttaaaaagtggctagcactggccgagcatggtggctcaggcctgtaatcccagcactttgggaggccaaggcaggcgatcacctgaggtcaagagttccagaccaacctgcccaacatggcgaaaccccatctctactaaaaatacaaaaaattagctggacatggtggtaggtgcctgtaatcccagctactcaggaggctgaggcaagagaatcacttgaacctggggaggcaaaggttgcagtgagccgtgagtgtactgcatgccattgcactccagcctgggcagcaagagcgaaaactcaaaaaaaaaaaaaaaaaaaagtggctagcactaaagggattatgatagacaaaatctattttctttctctagaaataaacggtagaaaatgcaattatataaacaactggctatgtcttgttcataagaattcttgaaagtcaaaactatacttcagctgggcacagtggctcacacctgtaatcccaacactttgggaggctgaggcgggcagatcacctgaggtcaggagttccagaccagcctggccgacatggcgaaaccccgtctctactaaaaatacaaaaaaattacctgggcatggtgatgtgtgtcagtaatcccacctactggggaggctgaggcaagagaatcacttgtacctaggaggcggaggtggcagtgagccgagatcgtgccactgcactccagcctgggcaacagagcaagactcggtctcaaaacaaaaaaaaaagccgggtgcgatggctcacgcctgtaattccagcactttgggaggccaaggcggggggatcacctgaggtctggagctcgagaccagcctgaccaacacgaagaaaccctatctctactaaaattacaaaattagcagtgtgtggtggtgcatgcctgtaatcccagctactcaggaggctgaggcaggagaatcgcttgaacccgggaggcagaggttgcggtgagccaagatcgcaccattgcactccagcctgggcaacaaaagcaaaactcaaaaaacaaacaaaaaactatacttcatggctgggtgtggtggttcaagtctgtaatcccagcactttgggaggccgagacaggtagatcgcctgaggtcaggaattcgagaccaccctggccaacaaggtgaaaccacctctactagaaacacaaaaaattagccaggtgtggtggcgcacacctgcagtcctagctagttgggaagctgaggcaggagaatcgcttgaacctgggaggcaaaggttgcagtgagctgagatcgcaccactgcacaccagcctgggcgttagagcaagactcagtctcaaaaaaacaactatacttcttaaaaataccttatcttttgatgtaataattccattttagaatccaaataaaatctggggagagggaataaattccattcattttatatgtatctatttagaaaaaataaaacttcaattcttgattaaagtaaaaggtgatcatctaacagtcatgttcatttagttattattcatatcaagtaatatccatgtgacataaatccacagtataaacaacttgatcactgacttaaattttagagcatatataaactgtttaattctaggccgggaacagtggctcatgcctataatcccggcactttgggaggccaaggcaggaggatcatttcatgccaggagcttgagaccagcctgggcaacatagcgagaccctcatctctataaaagaaacaaaaaaccagttaattccccgtttcttttcagtggtactactgaaggctgtttcagaaccgcaaagctgttgggagatccgaagtgtattttgtaggttatcctccatatgacatttatacagcaacacagcacttcagagataacctaagtccaaaaatgtaactggtcacagaacactgccccaagaaaatggggcagaggtttaaacttttagctcatacaactataaacttgttaagatttaaaaactacaaagtaagagtcacactgcacttcccaatccaacaactataaacgtggtaaaaagagagaactcaccacaatgaatactaagaataatgaatatggtaaagagtggtctatgtggttaaaaatttaaaaacctctttttgtggaaacttaccaatccagaaacagtgttaaccacatctaatgatttaatcttggaggtcgaattttttttaattaaaaaattgcttaaaatgtttgcatatttcataataaaatcttctttaaaagatctacttagtaaatcatgaaaacactcctccaaatgatttatggcaataatgaatccaaatgactcattagaagacggcatgaataagaaatatctgtttgagcaggacaaaaagaaaaataaaaacaggaggcaccaggaccaccaagtcctgacagatgccaatcaccaccaacgtccagtgagctagggcaaacagacaaccagaatgagtataataaatgttactgtatgctttcaacagggcattctagtgttaaggccaggaataatgccagaatgaaaacttctctaggaagttataaattttgatagatgcaggatcacagctgctctgatactagactttcaaacatttgccaaggagagcatatcagaaacaagaaactttaattagctcttgggggagaaaaatcgctcaacttgaagagtaactatgacctttccaaaaggtcagtgaggcattagcaactgtaagataagcttcacaccttgttaaagtgggtatgaatttccctcttggcagtaaagcctggggaacaaacttaaagcaacatcccctgatagctagagcaaagggaaagacaatggcaagcagtgatgggaccatcagagcaaacctctactttaaaatactacagcccaaaatgaagaacaaccatatcagatcatgtcgggcagtccttcacagttctgatctattggtaagaaaacctcttgccttgtgtaaggagaaagaggattgacaacagaaaccatgagactgggagggagatggggtaagagaaaggggaggaaaactggatgagtgacattactgaaacgcaagatcccttactgcagtattatagtactatagtaatgtgagttcataattatggtttgccagaagttatacaaagtatacttatacaaggaactgggaaaatgtttctaaaaattttgacaacaggttgaatataaagaattatctgtttcaagccaggagcagtggctcacacctgtaatcacagcactttgggaggctgaggtgggcagatcacctgaggtcaggagttcaagaccagcctgaccaacatggcgaaaacccatctctactaaaatacaaaaaattagccgagtgtggtggtggacgcctgtaatcccagctactggggaagctgagacaggagaatcgcttgaccccgggaggcagaggttacagcgagccgagatcgcgccattgcactccagcctggctgacaagagcaaaactccatctcaaggaaaaaaaaaaaaagaattatctgtttcagctgggtgaggtggctcatgcctataatcctaatgctttgggaaaatctcttaaggccaggaattggagactagcttgagtaacatagtgagaccctatgtgtataaaaaaaaatttttttttaattagttgggcatggcagggcatgcctgtagtcctgactactcgggaagattgcttgaaaccaggagtttgaggttataatgagctatgatcgtgccactactacattccagcctaggtgacagagtgagactctgcctcaaaaaaaaaaaaaaaaaaaaaaaagggcaaagcatgatggctcacacctatagtcccagctacttgggaggctcaagaatcaggcttcagcccaggtgtctgaggctgcagtgagctataatcgcaccactgcatttacccgctgggcgacaggagaccctatctccaggaaaattgaaaattttaaacagtgtgtaaaaggattatctgggctgggtgaggtggctcatgtctgtaatcccagcactttgggaagctgaggcaggcggatcacctaaggccaggagctggagaccagcctggtcaacatggagaaaccccgtctctactaaaaatacaaaaaattacccgggcgtggtggtgcatgcctgtaatcccagctactcgggaggctgaggcaggagaatcacttgaagctgggaggtggaggttgcagtgagccaagatcgcaccactgcactccaatctgggcgacagagcaggactccgtctcaaaaaaaagacagcgaaaaggtaacaagcttcatgaacagcagcaaagaaaagtaaaagagaagaccactgccccatagttttggacataaacagtgtttcttcttccctttgctttgtgctaaatacaataatacctgtcttctgggacatacattatcaaacaagttcaatgcttcaaatgtgccagtattattcaaagtaaccacttgctaatgaacactcaactacattaaactgttaaaaatagagtagggatagagtatctcccaattattatccacaagattaatctctgtacagcactgaaatactgtacaacactctgtactgcattatacttctgataagtatactaaagcaaaaaaaaaatttttttttgagacggagtctcactttgtcactcaggctggagtgcagtggcgcaatctcggctcactgcaacatccgcctcccgggttcaagcgattctcctgcctcagcctcctgagtagctgggattacagggacccaccaccacgcctggctaatttttgtatttttagtacaggtggggtttcaccatgttggccaggctggtctcgaactcctgacctcaaatgatccacccacctcggcctctcaaagtgctgggattacaggcatgagccactcactgcacccggccaaataaagcaaattttaatccaaggtaaaaagcacgttctgctgtaaactgggagacagtcatgatattgtgactcagatatctatacactgtgataataggaagagctcttagtatcataaaaagaaaacgaaagaaaaaagtgcttaaaaagatcataagcacattttgctcctagtattctcagaaacttgcactgtgcctttgggccctcaaacaattgctcaataaatgaagaaatttacatcaagtttttttttttttttaaataaagaggaaatggaaattaaacatttcgagaatgatacagagaattaccaataaacgttacgataatttctgggggaggactttcagtcattaataaaacggaaaaaaaagcatgaattagaactcgttcccttctgatccagatataaagctatgtaaaaacattcaatgctttcaggcatgagaaaacaatctttttaaaaagtactctattaaatccacctttcaagtcattattttaagaaaagctctgaataaactagttaaaccaatcagtaatttgcccttcttatcccatttttaaaatcaaaaattaaaagatacagaagaaaattaaaatcactacaaatccagtatcaaatgctttgagtattctcttctgagaaactacagtaaaaagatctcatgtattttcagaaaattctactgaaacaaactcacccaagtttttgtgacatcaaaagcactaacttaggccaggcgcagtggttcatgcctgtaatcccagcactttgggaggctgaggcaggtgataacctgaggtcaggagttcgagaccagcctggccaacaaaggtaaaccccatctctactaaaaatacaaaaattagccgggcgtggtggtggacatctgtaatcccagctactcaggaggctgaggcaggagaatcacttgaacccaggaggtggaggttgcagtgagccgagattgcaccactgcgctccagcccgggcaacaagagtgagactccatctacatttaaaaaaaaaaaaaaaaaaaagcactaactcaagggggtctagtaggaagaaaagagacacacacatgcaaatggtcaaatgtaacctaaaggttgagaagtaccacagtctagaaagttttattagcattttagggtcaatctaagtagctgacatgggaaacgacggtggaaggtagagaaacctatgcaaattattaccatattaattatgactttatgatttagacagatgggagaccaacatggccctaatgcccacctccttcagatcttttcgcaaatgtcaccttcctcaagaactttccggaccacccaatttgaaaactgttccccctttcacatactctgatatccaaacccccttgctttatttttctcagcagtattatcctccaggtaagggtctctgtctgttttattcactactgtatccccagtgtctgtgacaggtgctcaataaatatcttaacaaagcaggaaaagagaagaaagggcaggcatcagttaagcaaccatacgatgtgttacatttagaacaaagttggtaatcaagaagagaatgaaaagataaagtgaatgatagagggggggtcttcagtgtcaaattaagcaatttctaatgttcatatgcactggaagatgaagcttatttctttcaatccaagtgaccgtttcaaaaaaacactttggccaatattacaaattaaactagatccctacaggtcacaagcatagcttcctattctatgccacagcaaaatattaactatagttaacagtttactacttagtttgatatttgaagtaagtcactaatattctttttaatttaagcatgacttgatgacgcatgatgtatataagaatcgcctagtcacttctccaaaaaaacctgaatattctaccatgttttttctgttacatcaataggaataaactgacacaaaaagagagtcagtgctctttcttttaaaagatacagacaggaggaatgaaacactaaagacaatgcagcagcagtacccaaccccacatgaagaaaatcaacacaacaggtcttatatctgcaattccttgatcaaacaaaccaaagcaaattaattctatagaagtactccctaaacacttattcttttgctatttaccaactcataaaataaaaatgtaacacagttcatttcctgagcagtaactccacagttaccaaaaaggagctcaaatttcaactccaaaatatagctctataatgctccacaaagccaaggtcctatcttataaaaaaaattaaagcatttatttaaaaacctgcttgaaatgcttacaaactataagcctctaattacttcaaagtaaaaaatgaacaaacaaaacccacacacatcattaatttaaaatgctaatataaagtcactcaaactggccactcaaaaaacagacccagtgcaaccccaatagtaacaccagtggcatggtttcccacactgcttcaacttgtaacacagagaattcagtaaaaatgtattttgcttctggcttgtagtcagctgattaatttttaagaagttcccaatgaccttatcggaccccattatttaactgccaacgctattatgtacccagttaaatacaaatcttacactagctccaaatgtatcatttattttgccccatgacaatgtattgataaactatagttaatcgggtctactcatttcccttaattggtaaaacagcagccattttctgggggaaaattttttaatcaatcaagaagaaacattttatcagaggtacattgtgactgactcagaatgctgaatggtttgctatgtaagtccccattttaatcaatgaaaaccacagaaaaggttcttggggactgaattattaatggctacacaatacttggctaatatggcataataaagtatcatagcaggatttatgtaaaaattattccacaaatttatttactgctgccactatctacttaaaagatgggtataaatttaatcttttcctcatctgaactaaataaatgcccactgctttgtttatttcgttctcaaaatagccctctatggtatggttctcacaaagactgaggctgatccctgggacctgcatacatatatgtacaagaactgaaaccgtgaagttttgtcaattttgttttaactagaaagaagtactgcactgggtgaatttcacttatcgtggtttttgtaagaataacgtaattcaagaataaaaggcatctcatgctattagaattaggaacatctgtgtcctattcctgaccatttttaggaaaactagcaagcaatctactgcccaagaaaaaaaatgcaacaaaaaattaataccgaacatttaaaaaaaagttaaaaacctagaaatatacttgccaccccaacaccctttttctgctgtagttctttgcatttcactagtttcttagcaaccatatagcactcaagtgggtaagcacacacagaacaagaaaaaacaccatgctggtttttttcctttaagatctagaaccaactgtactaaaccttgttctttcaacctaagaatcacttaagacaggggtccaatttagataaatataccaccctaaaggtcagtgaccaaatttggtcaacaagggtgccatcacagccgtcatcattcttgtcaccgtcaggaacaactgtcaccttgccattaccaggaagggaaagcaactggaatattccttttgtaagttctatttacagactacaaagagtccaacatcatcttagtatgatcttacaacacgataacaatggaagaacccaaaacattaaaggcttcccagaaaagaactttttgatattaaaagctgataaaccacaagaatttctaagaccatgccacactctgggacaactcctaaccacactgtaaatgtcaggcatctattttctgaataccaatggcttcaagtgttttgttttgtaattttaaaatgcccagattgtttttaaacatagagacacagcttgcaactccaaatatgttttcacccaatggacatcatttgttttctgatttatctatggaatactttcagcttttggggggaaagaaaataaatttttttatacttacaaaagatatacatgctgccagtaataaaatcctaactagcaagtcttcaaactgctcaatcacaagttccagcaaggtttttcctgtaagaaacaaacacatgtgttttaactgtcatcttaccatcagcacaccaacagaggaaaaaaaacagaaacagcatgttaagattaccttcttcagccggtaactctgtagaatgtagaaattcgtcaagcaatgtgtcaagagggaggttaaaaaaaaaaagagagagacattttagcacttcgtttttctaaaaagaactgctacaattctaagcatcaatatctttaaaacacagacctagctataagaatatccgatttttttagcagagggcataccacgaagatatctcaaggaagcatgcactctttgtaatcaatggcctgaggtctagccctaagcgtgaaatcacttcgggctcctgaacctaggagtggtttcagcgatgtcatcacttctgccagatgtgtaactttgggtaggacaagaacggtcagaggccttccaacgacctcgactcctcataaatcggcaggggacgagaaaacgtcttgccgggctcaacctagctgcagaagccacgtccctccctccaccggggccggctgctgctggagagaagcctccgagccttgcgcgccgaaaaggtcgagggcccgagaagcgaagaggtccagggaaggcgaggcgaggaccgcagcccctttctctcccgcggggccggcgcgctggcccgaccctccgcccgcagctgtcggcgggcgcggagccgaagcccacgaggtggagcccggtcagccatcttccctggctctcccggccgcgccgggcccctgcagcggagcgccctgcacctaccgttggagccccatctctccttaagcttcttgacctgttccaggctcagccccgtactctcgttgacgccgaagtggcccagcacctcctccaccgtcttggtgtgcgcgttctccatggcttcgggggcccggccggcctcgcctcccgtccccgcggcctcctcgcctccgcctcgcactccggccgcgggctcgtgccaccccgggagcccaggcgcggacgggctctcccctcctcctcttgcggccgcttccgcctcgccgggcgctgaatcaccccgcgccccctcccccagacaaccgcccctcgcgcggccccgagctccgcagggcgggttgggggctcctgacccaccctccctcccctcgccagaagggagggcctccctcgccctcagccgcccgccgggagggcaggccgcggcccccgagccccctccccgctctcttgaggcgatcagaggccccgcccgggccggaggagggggcgcccggcagaccactgagggcggaacgcggcgagggaggcgagccggcggggcggtgcgcggcgcgctcgcccgggtccctcagcgccgcacgcccgacagcggcggaggaaactgcggcgaaggaaaaggaggtggcgtcggggacggctccgcggcggctgctctaatagcatttatcggccgctgcctcccctttcgccgccgccgcggcatgtggacgccgctcattggccgagagcgcccagcgcggcgcgggcggcgcggccccgccccctcctcccggctccctcctcccgcgcgcctggcgcccacgctgccgcgcaggccccgccccctcccgcgcgccgcccctaggaacccggatcgaggccgcgcgcgccgcggtcgcggggctggcggaggggaagctgggtaccctcttctgtgcctgcggttctctgacccacccacctgcagacgcagggtggggcgctcacagtgggcacgctgctctggggccggtgggcggatggttggaaggcgaggccgaggagctgggagcgcggtccacgcggggcgtctcgaggcgccctcgggctgatgtccttggctcgcctcctcgccctcggtcgcccgggctgcgctctgcatcctaatctggctccttcagagcccccctcagaaaccaaggggaggaattccgcagttcacttcccacacaacccaaatccttcatctgtcgcctcgggaacaccgcatcctacaccccctgccgccagctccttcgcacgccagccccgattcttccccagcgggttctgggccctgacgagggaacccccctcgcgggggggagggagaagagttgattttattattaatagctgacgcagcgcttgataggtgtctgcagggcagtcacagttcacgccgctggagctgccacacagcagctagacttgggctaggaggtgcttcgctgtggctttcagatgaaggccatttcatagactcacttccctcgacaggagaaaaggggacttgaatccaaagctgctcttaaaccacagatgatttgctctgctcgggaggacaaagcgcaggtcacagcaagataaagggaattttgccaatataaagaagctacattacttaacaaggggatgggaaattgcatggaattcatgaacaaaacatgaacatattctcttcacaaagaagagcagctttcttcacggagtaggttgcagaatgaagcaattagtccacttttgtgtttaacaataacgcaccatccgcatgagcaaaagcagagcagaaaaatcacctcagttgtctcaagtggctgggcttcaggacttaagataaattccttcagcagatgcaaattacagtgcatcaccagctgaaaaaatcaggcacgtcatgtcatttaattatttccaaggagtggacgttggcatgtagttttgattgatacttggaaaagaaccaacaaaaccctacacgaaacaaacaaacaaaaaattatactatatggcaacgcactgagagaagccaggtggaaactggttaggtcacaggatcagagccgcttcaagaggggcacgtgagtgcacggtgggagtgtggtcatggagggctggctgttgttgccctctgagaccagctctgcaccatttcgtaccaattcttctcccttacctcctctgtctctttcaggaccgatagaagcactgcaggcaggagaaggatggtttacctttctcagcctggaaattagcttaggcatttgatgttgaatattctgtgccactgtcactgcttggggttgtaagcacctctggtgcaattatgagcttctggaggagttcctgacctcagcctttgtatggaatgctcttcccacagatcttcttcacttgtgtcgttctctttccattcagatcgcagcttacatgtcccctcctcagagatgtctttgctgtctaaagtggctacccagccacagtggctcacgtctgtaatcccagcattttgggaggctgaggcaggaggatcccttgagcccaggagtttgagaccagcctgggcaatatagcgagactccatctctactaaaaaaaaaaaagaaaaaaattagctgggcgtggtggcctgaacctttagtcccagctactcaggaggctaaagagagaggatcgcttgaacccaggaggtcaagactgcagtgatctgtgatcacgccactgcactccagcctgagcaacaacagagtgagaccttgtctcaaaaaaaaaattaaataataaataaattaaaaagtggctactctcggcaattcaccttccatcacatttttcagttttcttttcttcttttttttcctttgagacagagtctctctctgtcacccaggctggaggacagcagcacaatcccagctcaccacaacctcggcctcctgggttcaagcagttcttgtgcctccgcctcccaagtagctgggactacaggtgcacgccaccatgcctgcctcatttttgtatttttagtagagatggggtttcaccatgttggccaggctggcttcgaactgacctcaggtaatctgcctgcctcggcctcccaaagtgctgggattacaggcatgagccaccgtgcccggtcagttttcttcacagtgcttacttgtgatgttgtattttggtttagctgttaactgcttgtctcctagtgtctcatggagctctaggacagaagctccataagaacagggcctgtccatcttgtccatcctcagtacaaagaacagtccctagtctatgctcctcatttattaaatgcctgctgtttgaatgaatgaattagtcccaccatccctagcccataagtgacttgcaaagggcctcccccataggaaggcctcagcaaattttcagtgaactcaagttcattgatttccaatttgtgaaataaactagagggcctctctgaactacctgcctcatgagaatgactgtgaagtgtagtcagtttaaaacaaacagacaaaaacaaagctagacagcattacaggtttctcagaaagaaggaaggttcaagttcacattggtactgttaccacgttgccattgccctcctagactgttctctgcaagctttctatttactggaggctggaatactctcttaagctgaaacagtgtgattttaagcccagaattggcccccttagacatcatcataacaattatgctcttggttcctcaacctgctggtgtctctgaaagctgttgttgatgggttgccaaaatttatcagaaacgcagtctcccaaaggcagaaatatctagtttctctcatgtagaaataaacttgtgcttaatttattttatgcatcgtgttgtacttgcttcttgttaagaagggtttttaaaagtaagaataggttttagaaatactctatttttcagcaaggattgcaggtacattcaatcaattgaggacagggagagaaaacagaaactgtgattcagaaagatggatgatttgattaaagaacttcaaaggcattaataaaggaggacattagctgctaaaaggcaagctggtttaaaaagcaagttagacagaaatggacagtggaaataagtgacttgtaaaagaggccccagccaacttcccaatgctctacagctccttgtaaagcagtggagattgtaaaaggcagtccattctgtatttggacagctctaatcattaaagcagtctcattctaggctggatccacctcccattggctaacttcatctatacattggatcttgtttagctctctggaaccattccaaatgaatttcatccctctttggtgtgagatccctttgagtatttcaagctatctactgtgttaaaaagtctcttctcagccgggcacggcggctcacgcctgtaatcccagcactttgggaggacaaggcgggcagatcacaaggtcaggagttcgagaccagcctggccaacatggtgaaaccccatctctactaaaaaaaaaaaatacaaaaattagccaggcatggtggcatgcacctgtaatcccagctactctggaggctgaggcggaagaattgcttgaacccgggaggcaggggttgcagtgagccgagattgtgccattgcactctggcctgggtgacaaagcaagactccatctagggaaaaaaaaaagtctcttcccggcttcttcctagatcatgagtttgtaatccctcagcaactttgtcatccagtcctagaggtacccagtactgaatacaaaagtctgggcatggggccaggtgaggtggctcacacctataatcccaacactttggggggccaagcgggtggaccacatgaggtcaggagtttgagaccagcctggccaacatggtgaagccccgtctctgctaaaaatacaaaaattagttgggtgtggtggcatgctcctgtaatagcaactgcactccagcctgggcgacagagcaagactccatctcaaaaaaaaaaaaaaaaaaaagtctgggcatggtcttgcagaggagttgtcatgcccacctttgtgctggatcttttccgctgcacactgtagatttgtgctaacagtcaactcaaaagagagtcctttctatataaactacagtcggtatatctcattgtgcacttgcactgttgatagtttttaacccaggcactgaacttctgtgtatacttgaatgttctcatgctctagacccatgtttagggtctgttctagtcttttgagatcttcattttcaaatactttagctatatgtcccagcttcaggttacatacaaatttgataagcatgacttctatgtctctatccagtagaacttctagacactcattccagattgaaaataaccaatcaaatgtatttaattgttcaactattataaaaatcaacttgactacagtgtccaaaatcagtaaagtgaaaatcttataaggcactccctgcctccttatcttctataatactttattacacagtgttgaaacagatcatttttcttttggttgagtgcctgatgtagtcagcttgatctaagggtcatgttatatgaaaacatccatttatgtaccaaaatcagaactggcacagtcagatgctttcactgagacaccaatgagaactaaggccgttcaaccaagtcacatctgtcatctcttattctggggcacatacttgttgagtagaatgatgagaattgcctgcattatttaagttgtcatataaagtcacttaagatgattaggcagacattagtctaccacccgcctttctctactttgtccataagaagttaatgagaggactggccaggcgtggtggcttatgcctgtaatcccagcacattgggaggccacggcgggtggatcacctgaggtcaggagttcaaaaccagcctggccaacatggtgaaaccccatctctactaaaaatacaaaaattaggcaggcatggtggcaggtgcctgtaatcccagctactcaagaggcagaggcagggagaatggcttgaacccaggaggtggaggttgcagtgagccaagattgtgacactgcaccccaacctgggcgacagagtgagactacgtctcaaaaaaaaaaaaaatggctgggcgcagtggttcacgcctgtaatcccagcactgtgggaggccaaggcaggcagagcatgaggtcaagagttcgagaccagcctgaccaacatggtgaaaccccgtctctactaaaaatacaaaaattagccaggcatgatggcgcgcgcctataatcccagctactggggaggctggggcaggagaatcgcttgaatccgggaggcagaggttgcagtgagccgagatcgcaccactgcactccagcctaggtgacagggcgagactccatctcaaaaaaaaagaggaagattcagagacattgtccgtaacaggctccaaatccacactctagtgctcttttcacagaaatgcatccactttggcatggcttgtgttactgaacacacaccagcacctagtgaccaccactttttctacatgcccatgaactataacttcaatatctgagaatttgtcaaacttaacacaatgtcttttccagaatctgccttccctgtacaccgcacgattataagcattctttagacggccgagggttaaaaatccaactcactattttatgcttataaaaaagggacttatagggaatagactccaaatttagaacagcttgatccaggtgctcaaagtcactgagaatctctctccacctcttagctctgcctctttccttttttatttatttatttattttgagtttccctcttgttgcccaagctggagtgcaatggcacgatctcagctcactgcaacctccgcctccggggttcaagtgactctcctgcctcagcattccaagtagctgggattacaggtgtgcaccactacacccagctaattttttttatttttagtagaaatggggtttcaccatgttagccacgctggtcttgaactcctgacttcaagtgatccacccacctcggcctccaaaagtgctgggattacaggcatgagccactgcgcctggcctccttttggtttttgttttgttttgttttgttgttttttttgttttgttttgttttgagacagagtcttgctctgtcgcccaggttggagtgcagtggcgcgatctcggcttatgcaacctccacctcctgggttcaagcgattctcctgcctcagcctcctgagcagctgggattataggtatgcatcaccatgcccagctaatttttgtatttttagtagagacggggtttcaccatgttggccaggctggtgatgaactcctgacctcaggtgactcgcccacctcagcctcccaaagtgctgggattacaggtgtgagccaccgcgcccagcttttcctttgctttttactctcaggcagtctctctccaggtggtggcagacatggttccagcatctccagtttctaattctccagtttagtgcttttggagcactaagctggagagaaaggcctaagattttctctgggatttgtgcacacccctggaagcaaagactatggtcagtgccatctgaactgcacgaactgagagggaaagaagtagttccctacagtggtggttttcacacgcatgcctcagcatcacctggagggcttctgaaaacaccttttgctggggcctacctccagaatgctcaattcagtaggtctggggtggacccaagaatttgcatttctgagttccccggtgatgttgatgctgctagttcaggacacacatgctggaaaacaaagcctcaaaggaaaatcctgctgctgttatcagaagagctgcaaatgttagatctgccaaacaacaaatgttcacttcactgaggaaagtcaaagatctcactggtctggaggaagcagaggtaactaccacagggctgggtgtggtggctcactcctataatcccagcactttgggaggctgaggtgggcagatcatttgaggccaggagttgaaaaccagcttggtcaacatagcaaaaccccatctctactaaaaatacaaaaattagttgagcgtggtggcgtgcgcctataatcacagctgctcggatggctgagtgaggagaattgcttgaacccgggaggcagaggttgcagtgagccgagattacaccactgcactccagcctgggtgacagagcgagacactgcctcaaaaaaaaaaaaaaaaagatgcaactagcacacaatactgaaaaccctgtttggagatgccctacattcttccactgtagtttgcagtgtcgtctgctacacatccaccaagacgtctcctccaattccaagctcctgacacaatgactcattatcccttccttgggacctctcctcaggctgttccttctgcttggatctgcctggtgaacctctatcacccttcaagatgaaggctcaaattccatctcatcttggaagtcttgcatgatagcagccttctccaacacttccatcatcagcgccccagaagtctcaaattgcactttgtttgttttagacaaggtctcactctgtcacccaggctggagtgtagtggcacgatctcggctcactgcaacctccacctcccaagttcaagtgattctcccgcctcagcctcctgagtagctgggattacaggtgtgcactaacatgcctggctagtttttgtatttttagtagagacggggtttcaccatgttggccaggctggtcttgaacttctgacctcaagtgattcgcccacctcagcctcccaaagtgctgggattacaggtctgagccacctgtgcctggcctcaaacagcactttatatcactcgagtatagtaacctgggttttccttccccttctctggttggtcgttttcaacctccttttctgtgcctccccctcttctacttaactttattctttttctttttgagacggggtctcgctcttttgccctagagtacagtggcaccatcatggctcactgcaatctcaacctctcaggatcaagcgatcctcccacctcagcctcccgagtagctgggactacaggcatgtgccaccataccctgctaaattgttttattttttgtagagatggggggtcttgccatgttgcccagactggtcttgaactcctcctgggcttaagcgatcttcccacctcggcctcccaaagtgctgggattatagatgtgagccactgtgtccagactcttctacttaactttaaacctggagtgtcccagggcttaggacccggcagtcttcctatctgtaatctttccttagtcccactgctttaaactccacctacataatgggtttgtttgtttgtttttttgtttgagacagggtctcactctgtcacccaggctggagtgcagtggcgcgatctcggctcactgcaacctcacctcctgtgttcaagctattctcctgcctcagcctcacaagtagctgggattacaggcatgctccaccacgcctgactaaattttgtattttttggtagagacgggatttcactgtgttggccaggctggtcttgaacgcatgacctcaaatgatccacctgcctcggcctcccaaagtgctgtgattacaagcgtgagccaccgtgccggcccacctacatattgttgactacacatttgtatgtccagatgcatatactcagctgctgatctgacatctccacttgactgggtcatggactcgcatttgagagtgacagaaggagggccaggaataatacagagtcctttgaaaatttagagccaagaagagcagcatcttgggcagaaggaatagcaaatgggcaaatgcacatatgagtaatactccttccttcatggcacttaatcaccctaagtcacttgtttattgtctgtcctcttccaccagactataaactccaggagaatggaaattgtcagaggcatgtgaaccagagcaactccatcttgaataggagctgggtaaaatgaggctgagacctactgggctgcattcccagatggctaagacattctaggtcacaggatgagataggagattggcacaagctacaggtcataaagaccttgctgataaaacaggttgcagtaaagaagtggccaaaacccaccaaatctaggatggcgatgagagtgacctctggtcgtcctcgctgctatactcccaccagcgccacgacagtttacaaatgccatgacgtcaggaagttaccccatatggtctaaaaaggagaggcatgaataatccaccccttgtttagcatatcatcaagaaataaccataaaaatgggcaatcagcagccctcagggctgctctgtctatggagcagccattcttttattcctttactttcctaataaagttgctttcactttactctgtggactcgacctgaattctattactcttttggggtctggattgggaccctttcctgtaatagaatcatatgcacttagaaggcatgcaatcaaaacttcttgaataaatgcatgataattatttgcaatgaggaccttgagtccttccttatctattttgtgcccccagcgaccagtgtagtgccaggcacatagcagatgctcagtgaatatctaccaaattaattagtgaagacctttgcttcctttgcaattactgctctgaagaaaaaaaaaaatcttgccatcttaaaaaaaagaaagaaaagaaacccatatagcagtgccaaacaaagtactgtggaatggttctcaaaaccatagctccctgatgggataatgtagtttaaatatagcagctatttttccctctagttggtttgttctttgatttttgtggaaagatttcaaaagttctcctccattgccctccttcctcaccccccaaggtgcttagactttaaatggtgaaatacttaaaatgcagagatggcctggcctcctgagcctggtagaagaaagaagagtgattaaatgcaattttaattttataggatgagttctctgattctcccttccctgccgggtgccagggtgttgctctcacagtagtggtagcagccccaagcaggttgggtttcagtctggcagaaatccaaggacagtgcacacagcagatagggttgctgtggacaaattcctagaataggatctttgttcccaagctgaccagcttgctcccttgatgtcccacaatagaaaaaaaaaggggggggggtgttggtggaggcatgtttaggtctcccattgtgatcctgctgtagttacctgatagttcacaaaagatcccaggaggttggcagccctcccaagttaccttgtgattctctcctgatttcaaatagggggagggaggaggacaccatgtatcctaagagaagcttgtctgacatgcctgatccgttccatctgggaagatgcatcatgaaccccatctggctccagcagtctggctaaggctgaggctgaggcagccgtgggctcccagcacacccccactagctccatccctctcaagcccgcttatccttcatcttcccctgaaagaaacagatcacagcttctgtcatttgcaagacctcccctgactccctatgccctggccttttctgcaatcgcctctgcttcttctccaactgtggcttctctgatctcccagccctctgcagatgccgtgttgattggaggccctctgcagatggcagggcccctgtgaaaatccagttctttcacctgatcctcctgcaccacccagagtatgtcctgatttgggagacagatacacctattataaggtcctgtcccgtgtcttgcaagctggagtctagaggtactggacaatcgttcccgttctgttagctgcttcccatctcaaccagtagagccatggcctctttggccttcaaccttaacatttaaatcttctcacgggggtccaatctgcatggatgggggatgggaggagtctaagaaagcagaggcttggctggagacgtttgcaaacattagacgtttctcttccatgactcatcggaggagagcagtcctccctcttcctggaatgcagcaaacccatggccaactcctacccccaccccatccccaaaataaaacaacccacacctagagctctgtcctcagaaatcagatttccctcaaacatctgacatggcaacttgggggcagggagcattctgagaccacagaacagcctctaagaggattctctgacctgaggggagagagggggctgcagtcatagcacatgtatcattaggatgggtcttttccagaaagcgccttcaccttcctgtcctcccccaaccgttcttcttagtagcctcccagtataaaactaggggtagacaaccgaccattccagcaaggcttgatttcattggtacataaaagggttctagaaaaaaaataggctggtgcagataaaaaggaaggaaggaggcagggtgcggtggattatacctgtaatcccagcactttgggagactgaggcgggcggatcacctgaggtaaagtgcagtttgagaccagcctggtcaacatggtgaaatc

SEQ ID NO: 3 - DNA, 72713 bp, Mus musculus
cactgagatgccaccccgcgaagggaagggactccatggtggctcaccttgtttggggctttgtttgcgttgctgtgcagttgtaatggaaaacgaataaaaataaaaatcccagggccctttttggccagcgcttgggaagttaatcccattgtcctggccaaatgccagctcaggtccacgcagttcgcagtcgttggcctcctgcagatcgctgcgggggtggggggtgggggggaggcgccccgcccccgccccaccccctcactgtgactgcaacagctgtccatgccccacccatgaagaggctgcatttctgcaggactcaaaggggccttctctcccttggctaggtctgggaggagggacaagacctaggtcaggacaagacaagggtcaggaattcaactgctgtttgcagcaggggtgatctgtgtctgaacactttcacacaccacagaatcactggcttctgtcgtgaaaacgactttcaggaatcgctaatgtcttcccagaactcctgcgtagagcccctcccttcgttttaggcagatttaaacgttttttgtatctaaagtacctccgagtttatctccgtggagcttgctgttgtggtgtcctctgattgcttcccctaatgcttaactctctttcctctacgagatttagtatattttatgatatgaagaattgacccgggctggcgagatggttcagcgggtaagagcactgactgctcttccgaaggtcctgagttcaatttccagcacccacatggtggctcacaaccacccgtaatgagatctgacgccctcttctggttcgtctgaagtcagctacagtgtacttatgtataataataaataaatctttgcgtgggagcaaacagggactgacgatcagaggtcctaaaaattcagttcccagcaaccacatggaggctcacaaccatttgtacagctacagtgtattcacatacatataataaataaatcttttaaaaaaattgatccggatctgggcgtggtgacacatgcctttaatcccagcactcgggaggcagaggcaggcagatttctgagttcgaggccagcctggtctacaaagtgagttccaggacagccagggctatacagagaaaccctgtctcgaagaaaaaaaaaaaaaagaaagaaaagaaaaaattgatccgtacaaattccattcaaataagcatcctgagtccccagcaatggaggaagtgaacagagaatattataaagatatttttctccctttaaaaaaaaacacttatttttattttatgtgtatgatttatatgcttgaatgtatgtatgtctgtataccacacactcccttggtgccagcagagaccaggagaggacatgggatctcctggcactgtagtttaagttgggtgtaagtcaccggatagaaccccagtcctccacaagaacagtaaagtgcgcttaaccactgagccatctgtctctccaggaccaaccctcctctctgtttcaagacagggtcttgctttatagcccaggatggctcagaactcaatgggtagcttaggctggcctcagacactacagtcatcctgcctcatcttcttgaatgctatacagaccacacgtgtgtatcatacctagctctggtttgtaagtgtgtgacttcaacaagtgacaacctgagaaccaattatcagaatcttgtgcgtgtgtgtgtgtgtgtggggggggggggttaatagaaatgacagtgacacctgacacctgaacctaaggatggaaggaaataacacgtgactcctgagcgtactgcacaagtggagagtttgccaaggataacatctgccttcccagtttcttttcccttttggtcttaattagcctgattccgtgtgtgtatttgactgttttctagaattatgttatgacccactgaagtccttgctggaatgttccaaaggtttccagctcaggttttctattaagaaagaaggatgagatggggcggggacacagttcagctggtgaaaggcttgcccagcatgcacgagccccttggttcggttcccagctctgtattgtaatcccagcacgcaggagatagatgcaggagagtcagagtttaaaggtcatccccagcctgggatacatgagatcttgtctccaaaaaaaaaaaaaaaagcaaaaataaagaaatatgtaaataaaataaggctagagaagataagggggcaggtattttctggacattcctcatgtgggtgcacgtatgtgaatgtcaggctgtacctccagccccagcttgcctttccttgggtcagagaagcctcttccaggatgttctttggcctcaaaaacgtcccctcccacaagttgccatagctgatctttgcgggtagctgagatttgaagagaaagcttcaagtgaaggctgattactttttggaggtgggggtgggggttggccttgcgtttgctgccttccaggaagaaggagggttctgctctcctctgatgagtcatgggagagagacttccaatctttgcaaacatcccggggccaaccctcgggagagcttgctggggctgtgtgcagcccccaccagggctcccaggacccacctgagaggacctcagggggaaagggtgagaggttctgccttcgcctgtgctggaaagcagccaaggaaatgggaccgttgtatgtctcggggctccagcatgtgaggcacaggagagggcctcctataggggtatctgtctacaaatcaggccccagactgggtcgtacgagaaggtcacgggcaggaagtaggcttttgaggcagctcagttggcgaagtacctatatcataacccaaaatcccaaattaccctacgctttctctagaggcctgcccctctgcagaagggatcctagaccagagaatcccagaccccaaagtggatacccagacccacaggtgaagggtatggtagaaaagaaggcagggcccgggggtgggggtggggggtggaggagtctgcaagggtcttcctgtccaggggagatgaagtagaagaagcaggttagggaagggttgaggctgctggtttgctgggatctgccgtgcctcagctcatgaggtctgcctgagccagatggagcctatgatgcaggcacccagatggaacggctcaggcatgtcagacacacttctctcgggatacacagcgttccccttccttccccctcgccaaaaggaggaatcacaaggtgactcgggccagcggccagacccctgggatttgcggagagctatcgggtgaccagaacggggatcacaatagacacctaaacgtgctcacgactctaccagtcaccctttcagctattgtgggacgtcaagggaaccagctggtcaaccttgggaacaaagatcctgttctaggaaactgtccacggcaaccctatctgtcgcttgctctatctgtccttgggttcctgccagcctgaaactctacctgttcactattgctatccccgctggggagcgggaccttggcaattagcagggcccctggagcctccagcctacctcggagagcctcgccgtcattcaccagcgagagtgtgttccttattttctgttgggctaggagactgaatcctctctgcacttaaagaattgaaacatttaagatctaagcaccttgggatacctgggggggggggggttgtgcaaggaggacagaggaaagaaacttcagaaatgttaacacaaaaatcaaagagcaagccaatggaggcaggaattgttgctatatttaaagtgcgttttgccccgttgggagccacagctttgaaagccatcccataattctttgcttttgcactgctctatggctttctgtctcttttctttttttctttcttcgtgaagatggcaatgctttggtccaccctgcacaccccacacacaccaccaccccccccccagcagcagctgcaaagagggttttattaattaattagttggatatgtgctggtacctgtggcccgctgggcgctgtgctggctgctggggacaccaacaggagagggttaaagggtctcagagacaacagttatcacccgtttaatctggccacttgttattacctgcagacccctggtctcctgggccttataatttgtcgtcagaagagaggtgacagtgggtgggtgacattgccatattattattcacatgtgactatgcctatttattattccttctgccacgaggagactgaacttcttggctctggatattctgtattatttatggctccctcttctaaaggacatgacctctcactcacccttgtcaccctcacacgggggcccgtggcttggatgggtggagacgcaggctggcagctgagcttgtcagtctggacgtggaaatgtgtgtgtcatgtgtccgtgggtggagttaaagcaatgtcgaaagggttgaagatggggaagaatggccagtcctgggccttgattcagagtcaaggagggagagaggcttgaaaatgaggcttagttagtgtgttggcattgagtacctactactatgagggtgaagctctgtgagctgaggctagcccagtctacacagtgagttccaggatagctagggctaccttgggagatcccgtctcaaaaataagtgagtaaataaatagatcactttgctaaactagtgagttacagactaggagtctctagaaaccgcatctgccaccacctgggacagccgggaggtggaggtgactttgcctgggtcagccattgtcagtctggactcccaggaagtctcacgttcataagcatcagctaagagctggggtttccaacactcgtccatgaaaaagacacttagttatacacgggaagaggggcactcggggaggagtgggagtcggcaacggtggtcacaaaggactagtgtgtgatcagtggcacatgtcatatgtggcatgcttgagtgaacgtgtctccacacaaagcctgacagagtggcggtctggagcccgttgtggacaaggactggtgagcacagctctcccgttaaattctcatggacagcggagaatggcagtgcacactgtcaaacctagcactcaggaggcctggggcagaaggacctgggctttgcatccagccagtatctcaatactgtgcccccccacccccaccccagccatcgtatcactcaacaagcacacagcccgagaagcgagaggtggcagatgggatcctgtcagaggtcttggctccttctggcctctcagtgtaagcatttcatgatgccaagtttggtcctggcacttaaatgggcatttctcatagtacatgaccttcaagttacatcaaccaaggaagggcgacagacgatccacaatatctgacagactatcagggaataaagaggcaggaacacccttaaagatccttactttcttgactttggaacttctggtcaagattcattcagttgattagcttttttttttttttaatttaacttttttgtgggggtgggggggttcaagacagagtttctctttgtagccctggctgtcctggaactcactctgtagaccaggctggcctcgaactcagaaatccacctgcctctgcctcccaagtgctgggattaaaggcgtgcgccacgactgtccagctcttaatttaacttttatatgctatggaggtttgaatattggaagtggcactattaggaggtgtggccttgttggagtatgtgtgtcactgtgtaggtggagcttgaaggctcctagtgctcaagctctgcccattttcggaagagaacctcctcctcctcctcctcctcctcctcctcctcctcctcctcctcctcctcctcctcctctttttcctcgtctcttcctggctgcctttggatcaagatgtaaaactctcagctccttctccagcaccatgtctacctgtatggtgccatgcttcccgccatgatgataatagactgaacctctgaaactgtgagccagccccaattaaatattgtcctttataagagttgccttggtcatggtgtctgttcttagttgtgagctgcccacggtactgggggtttgaactcgggatctctggaagagcacttagtattcttagccactgagccatctttccagcccctcgttagttatttttaatctggaatgagtagctaaaaaacctgttggatagtgatatagtcattctgtttgttaaattgtgtgtaaatcaaatctgagatgcatctctagaacactgtttagggttggagaggtcactgaacagttaggagcatgttttgccctctgtgggcactaggcatataatatattatatatatatacacacacacaaatatatatattatacacacacacacacatatatattatacacacacacacatatatatatacatatatataatgtacatatgtagtgtggtgatttgtctaggtatggccccatagactcacttgtttgaatacttggcctgtagggagtggcattatctggaggtgtggccttgctggagtaggtgtggctttgctggaggaagagggggtgggccttgaggtctcttatgctcaagctatacccagtgtgacacacagtcccctttctgttgcttgaggatcaagatacagaactctcagccccttctccagcacatgtctacctgcatgttgccatgcttcccaccatgatgataatctctgaaactgtaagccatccccaagtaaatgttgtcctttctaagagttgctttgagccgagcagtggtggcgcacgcctttaatcccagcacttgggaggcagaggcaggcggattctgagttcgaggccagcctggtctacaaagtgagttccaggacagccagggctacacagaaaaaccctgtctcgaaaaaccaaaaaaaaaaaaaaaaaaaaaaaaacaaaaaaaccaaaaaacaagaaaaaaaaaaaaaaagagttgctttggtcatgttgtctcttcatagcagtaaaaccctaaaaacacatataaaagacaagatactcatacacataaaataaatcttttttttcgtttttccttttattgagaatagatttttttttcatacattatatcctaattatagttttctctcccaccaccccttccagttgcaattctcctgccctccagatccactccctttctgtctcttgttagaaaagaacaggcttctaagaaatagcaaccaaacataagaaaataaaatataacctgaaactatcattttcaaagtggaatgcttcacaaatttgcatatcccccttgcatgggggccatgctaattttctctgtgtccctttggtatatgtgctgccagagtgagcacaagtctaaaaatttttttaaacgagagagagaaacaatgtcttgcagaggactttagttcttcttccagtccccatgttggatgattcacaagctgtaactccagttcagggggatctagcgccctctcctggcctctttaggtacctgcactcatgtgcacatactcccaaacagatacacaacacaaacacagagttaaaactaaataaatcttggggctggaaagatgcttcagtggttaagaacactggctgcttttccaaaggacccaggttctagtctcagcacccgcatggctgctcacaatcatctgtaactccagttctaaaggatctgatgctgccttctggcctccacagtggtacctaggcatatatgtgagcagaacattcattcccattaaaaaaaatctttttaaaaagactgcttgatgataagattataataagcacaaaaaacattcaattatagcagggctcagtgcctgggacagaaaaatcaacaagctaagtataccataaatagctttaacggggctatgattagtacgcaaaggacttgatttgagttcactgctagtactgtgtaaatggaaggacagagtttctctgtgtagccctggctgtcctggaactcactctgtagaccaggctggcctcaaactcagaaatccgcctgcctctgcctcctgagtcctgggattaaaggcatgcgccaccactgcccagcaggctcagacttgtatgctcagtactgggcgtgtccagagaggtcgagggactgagactcgggctataggagaacagctcagtgcccagctgctctttttagtgaagaaaggacacgttagtgggataaagatctggaaatactcaaaaggaatcacacaaagagggatttaagtttgttcaaggtggtttcggagagttaaataagaacggatgtagctaggaaaaggtggacatagcccaaaatggggctgctttaatgattggagctgtccaaatatggagcaggctgcctcttgtggcccccatcacctcccaggaggcctgcagagggctgagacctggccaaggcctcttttgcaagtcacctcctggcttttctatcggaatagctttttaaactaacctgctttttgttagctaatgtcctcttttatccgtgcctctgaaggtctttgatcacacttcatctttctgcattgcatgctgtgtctttcccttctcttcctgtcctcaagtgattaagtatgtggttatgagccttgctggaagacggtaacctttcttattaaagccttgcaaacaaggagcagagtagagcattgcacagaaaacagactgagccccagtttgctttttttttttttttttttaaggcaggttctcactaagctggcctggaattcactatgtagaccaggttagcctaaagctcatcctcacctgcctctgcctcctgagcgatggggttacaggtgtgcatgactacatcatgacgccgtcgtcatcgtcgtcgttgtcttcttcttcttcttcttcttcctcttcctcttcctcttcctcttcctcttcctcttcctcttcttcttcttcttcttcttcttcttctccttctcctcttcctcctcttcctcctccttcttttaaagtgagaccaaccctttgtttctcccaactttatttctacataaaagggaccatggattctgcttctgggagtcttgggttcatgatcagttttgccaacctctaagcaaagaggtgcccagctagaaagcatattaatgtttcagagagcagtccaaccttcagtagaaaatgctttgcagagaacattccagaagggcaatggaatatagtcccaggatctctgagactataggcattgtcttttctgggagggcagttttgccttctttttgttttgtttaagatttatttatttattattatatgtaagtacaccgtagctgtcttcagatgcaccagaagagggtgtcagatctcattacgcgtggttgtgagccaccatgtggttcctgggacttgaactcaggaccttcagaggagcagtcagtgctcttaaccgctgagccatctctccagcccttctttttggtttaaacctaagcttcacagccattcttctcataggtaagtggtccagaggccaaaataaatccagcttattgatgaatggaaaaattagtacactggagctgagcagacgtttgctgaggccttagtgctggcagagcccttcccaagtaactgatgggttgaggagggtggggctctcattggtttcatgcatttaaactgtaggcactcaataaatgatgagcagatgttggggactgtgctttgtactgagtatggaccagacagacaagcttcattctcaagtctggatgcccttacaagatgctaggaggcaggcaccgagcagctaaacaaaatctacagtgtattttccatagaaaagtgctagggcagcagagacccttgaataatgtgatagtaggcatcctggggaggggagctgctttagataataaagcatctttccggggggtgggggggactcggggatttagctcagtggtagagagcttgcctagcaagctcaaggccctgggttcggtcctcagctctggaaaaacaaaacaaaaaaaaccaccaaacatctttcaggaggggaccggacaaggaggaagatggcctgagggaaaaactgggaacccgtgttgtagggtgcacctccagcccctgaaggaggggactacagaacaaaagccaaacccagtgagcatcacagacaaactaagagaggtcatgaccttcctactctcagtgccccttgctgtaggtacgacagaactggaatccagctaggagggagacccaccagctctccatccctcccaccctctcaccccccacctcgcaggcagtcacctgatcctccagaagaggctgtgacctaaccagtttccaccttgcttctagggagtgcattgctatacactagaatttttgtttgtttgtttcgtgtagggttctgttggtcctgttccaagtatcaatcagaactgcgtgccagcctccactccttggaaataattaaatgaagtgacgtacttgattttttttttcagtcgggtaaagcaccatgatttgcatctgctgaaggaatctatcttaagtcttgaggcggagccttgtgggacgtctcaagtgattggggggggggggtggcgttgctaaacactcaagaagatgaaatgctttattttgcaatctatgcccttcatgaagccgcattttgtgaagatatttgcaaattcaatgcaaagggcctcctccctgttaagtatggcttcccacattcctctgctttttaaatttattttgtatgttttagacaaggtccaacgtggaagactgctcctaaactccttcagtgtctgtccatgaccttgaactcttgatcccgtggcttccacttctgttcgtgggatcacaggcgggctccgtatagcctctttatattggcaaaattaccttgcatgctaggctctgtacagacctcacagaaacaacagatgatctgtggtttaagaatagatttgggattgaaggctccttctctcgcattgggggaagtggaagtcttatatagcagccatcatttggaagccaaagccaagccacctagcatagctgctacagcataacctgtgacttctatgcagacgtgtgtcaaaggctgtgtgagctactaaaaacgaaataaaacttcctccttcctcccccaagagtgggattccctgtcggggcacagaacccgcaggggaaggaagggctggtgttggcgtgcgatggagatgaggctttcggctgggggtgtgggatgcggtgttcccgaggcgacagatgagcgcttttggctgtgtgggaagggaactgcggaattcctccccttggttgctgaggggggctctgaaggagacattaggatgcagagcacggctcgcgctgcccaggacgcggaggcaagccaaggacaccagtgcgagcgcgcctcggcccccctgcgttcccgagcctccctgccaatgcgcggtcccagccagtccccaacctcagcggcagggcaaccagcacagagcgcccacccgtgaactccgcgctctatccccgcgcgcggtcgatacgggaaaagccgtggccccggaaaagtcaggctcaccctccgcccgcgccggtggccgcagcgcatcgagcacagcgtggacgcagaggtggccctggccccgtgcgcgcgcacaggcgccgcgcgcggcctcgatccgggttcctggggggcggcgcgcgggaggaggcggggcctgctggcggcgtgggcgcgcggtgcgcgcgcgcgggagggcgccggaggagggggcggggccgcgccgcccgcgccgcgctgggggctctctcggccaatgagcggcgtccacatgccgcggcggcggcgagaggggaggcagcggcggataaatgctattagagcagcctccgcggagccgtccccgacgccgccacctcccgtctcctccgccgcagttccctccgccgccgctgtcgggggtgcagagctgaggggctcgggccggcgcgccgcgcagctcctctcccgtcgcctgcctcgcggttcccggcgccgagggctcggcccggcgccgctcctcatctgcgccccgtctcctcggcgcagcgcccggggcctgcgctgcccgcggccggctggcagctgctgaagcgacccacactcgcggcggggcgggaggctcgcagtccctcgggcgggctcggcgaggccgggccgcgtgcggcggtttctgggggagggggctcgggtgattcagcgccccggtcaggcggaagcggccgccgccgccgcggaggaggaggaggagaagaaaaaggaggggacagctgtccgcgcccgggcgcccgcggtggcacgagcccgcggccggagtgcgaggcggtaggcgaggaggccgcggggacgcgaggcgaggccggccggggcccccgcagccatggagaacgctcacacaaagaccgtggaggaggtgctgggccacttcggggtcaacgagagcacggggctgagcttggagcaggtcaagaagctcaaggagagatggggctccaacggtaggtgcggggcgccggggctgcagcggcgcggcgcgggcccgagcgccaaggaagatggctgacccggctccacctcgtggggcttggctcggcgcggcgcccgacggctgcgagaggccgggcggtccacgcgcgggtctgggccatcgccgacctctaggggtctcgagccggtgaccttcccggccggcgctcagcgagtcggattgggggggggggagagggagtgggaaggagggaggaggttcctgcggctgggctgagtcccccgcggatttatgaggcgtcgatgttgttgagaaaccctcggaccgtttcttgtgctccccaaagttgcacatctggcagaagtgatgacccagctgaaatgactgcatggtcctggaggccggagagggcttacgggcagttccgaggccactgattaccagggctgaataattttctcggggtatcaaagtggagacagattgttgtacgttcatacacctatatccgccattcagacaacgatggtggtgaatttagcagtttttaataaaagcgctaatacaatatcttcatttttctttctgctttcctcctgacacgttgctgtcgaatttcggccttctagaattgccggctgaagaaggtaaataatattaacatgttattttggagagatgatgtgtgcaggctgattgatgtggacaattgaaacaaatggtttgttttttttttttttttttttcctttccttttctaacaggaaaaaccttgctggaacttgtgattgagcagtttgaagacttactagttagaattttactgctggcagcatgtatatctttcgtaagtatttaaaaaattattttgtctccccataaaagttgaaagaatttcgttgggacaccagaaaataaataattaccattgagtttccgtgtttaaaaacaaacaaacaaaataactcaagaattagaggggggaaaatgatagaagctgttttgcttaggttacagtgcagtgagaggtgacccctgactgcgcagggtctctggaattcttgtgtctcaccagtttttagtatcagaaagttcctcactctaagtccttttctgttggggttcttccatttgttatcatgttgtaagatcacactacgatgatgttgggcactctgtaaatagatcgtacaaaaggaatattccagttgctttgccttcctggtggtggcaaggtgacagttgttcctgacagtgacaagaatgatgacggcagtgatggcaccactgttgaccaaatttggtcactgacctctagggtggcatctaacctggacccctgtcttgagtgattcctagagtaagagagcaaagttcagtattcttggttctaaatattaaagagggaataaaggtgaaggtggggtttttgtttgtttttttttctttctttctttcttgttctgtatgtgcttgagccagtgtggttgctaagaaactagagaaatgcagagagagacctgcctaagaaaagctaatggggacggcaagggtagttctaggttattaacattttactccaggatttttttttcctgggcagtggaccttatagtttcttttaaatggtgataatggtatgcagatgttcttaatcttcataacacacgccaatttttattcttagaacattgtattcttatactgtgataggaagtgaaaaatcatacagtacttgtcttaggtttcacaaaactgataactgtatggtttcaattatgtattcacacgtttaagtctgacccaggggttctgtggtcatggcctctatgaaaacattagcttagaggattgtttagagaacttactgaattcaggtaaaggaaagattaattttttagctatttttaaaataatagttaattggcagcaaaggggacttttaggagcagttgtatacatgaattttctcctgaaactttggtttgtcatctacgtgttgtgtaccccttactcgctagctcatttcgtaagaatttcacctgtggttttcactgaataaaatttattagattcccataggagaccattcagcatactgctgagttatttactctgtacttcttatatataatatctttttgtgattaatttttaaaaattttgtccaataggtggttgtttcatttgtaaacaagataaatggagttgattatagtttgagcgtgttgccatgtgctaaaataagttatatatgtgggggttgtttaaggtttgtatttatgcaggctacatcattctggaagtctctgctttcgcattaaatggtgccattcactaaggccatcaaggacttagaattagaaattaactagatgatatatacaagctgtaggcaaaatgcattcttactggtccctttcatattatttgaagcagttttagaaatgtgccaagtgaacatgtgaagtgaacaagtgaaatatgtgccaagttattttctattggatttcagaaggtttcaaattgtttgtggacagtttgactttttatcaagcagaattaatgattatagataaattttactttggagtaattaggaatttattctaattttcaaatttgaagtgcttaacagtttttgtgatagagaagacattgcctgttggtagttgaaatataagttcattttcaataactacttggaattcttgttcaggaaatgaactgctacatttttatgatatgagttgttaaatggaaaagaataagtgtttaggaagtgctttttctagaattcatttcatttgctttggtttatttgatcaagattgtgggtagattaagagactcttgagaggttgctctgaagcctataccacccctgacttctagcgtccatgcttaaatctgtattaaaacctttaaagataaactccaaggttgcttaacttcaaaagaagtagttcaggaaggcgaggcacccgtgcagcctgggctggaataagactgctcttaaaagctacaaagatggaaaagagaaaaattgtgctctaaaagatgggttttcctgatggtcttcatggagggttggtagtgctatatggtacttgtctgttctttccttattttctttttatttctgttactgcctatataatatgtatgtgcaatgtatgggtgtacttgttcaggtatgtggtgtacttgtgtgtgaatgtgtgtgcagaggccagaagttgacatcaggtgccttgcttaataattctcatctaaaatactgaggcagggttgctggattaaacccagagctcgctgattcagctagtttaggtagccagcttgcctctgcctcctgaatgctgcaattacagccagactgccatggcttgctggcctttatgcaagtacctgaggtttaaactcgggggcttaaacatatagtaaatactgcctgcctagccatctttcagtcccttttgttttgttttgattttgtgtttgttttttgagacagggtttctctgtgtagtcttggttgtccttgaactcactctgtagaccagactgacttcctctgcttcccaagtgctgggattaaagacatgcaccaccagcatcttactgtatcttagactagtctcaagctcactatgtacagcccagtcttacttgtttctcttgccttacttagccttttagacgccaggattgcaggcttgtgccacgaacttcagcttatttatttttatagcttccaaataagaacactgacttatttgttgtggtagtcagtgtattcttactggcataacaggaatatcacggttgtatacgcaggttctttgtagaagtgaacaggcagttctcataaatcatcagattctcctcaggttagaaagatattaatgatttatttcaaatatcagattagtaaactgttaactacagttaatgttttgctctggccaaaaaaaaaaaaaaaaaaaaacctgcattaatgttttacactggtggcccatggggacagtttaatttttagtatccaccaaaattgtttcttttaaaaaggtcaattcaaatatggtagtgcatgctataattgtaattagtgtttgatagctaagtaggtgagttaggagttcaaggccatccttgagtatacaatgagtttgaggttagcctgcagtacataagactatctctgcaaaatgcatctccctctgcacgtgggttagtttgacaccattcactgtttttgttttgtttcactgggtttccttctcttagattagtaactttaagtattctgcctaactggaatgcctgctccctcctcctcctcctctcccccagttgaacacctgacacacacactggggatatcagggaacagggtctgttgcctggaatggtacttttgagagagtaaagcgaatgggctgtgatagaggaattggctgtagggaataggagcgtgcaggcttttaatggctggttgtgtaacctcacaagatgacctttgaggaaagatctgaaggagtggtgagaatcagtagggccatgttggcattagctcatcggtctagaaagtagtggggtactgatgatgagagtctgtacaggtttctttacactactcaggttgattttaaaatacttttttgttgtgtttttgagacagggactgtctttgtagttttggctatcctggagaccaggactatatagactatgttggccttgaacgtaagagatcctcttgccactactgggtcgtatgtatcttcagtaccttaaatataggaatgaatttgcttctaggattttgagacattgataaaatatgctatctagttttactttgctggtttcaatgatcttcaggaagcaattgatagtgcatttatggtggttgaaattttttaattttttaaaaatacaatttaaaaggtggtttgaagatgaagcattaatgtttttcctcactttccctactatggggataaccacaatcctgtcatactgtgatgtgtctctctcccatgtctagcagaacacggccctttttgtgttagaacaaaatttgctttattcagtattcctgttagaagtcagtagtgccaggttaagtgtggtgacagacacttgtaataccagtcttgaaaaagctaatgtaggaagattcaagttggaggtcagcctgtccagcaacaacaggctagagagggctggagagacggcttagtggctgcacttgctgtacttgtagaagatgtggatttagttcccagaacctttatcaggcggctcaagccatctgtaacaccaattctggggtggtttgacacctttttggattctgtagacactggcacacgtgatgtgcatatacatattctccggcacacacacaaacttaaaaaaattatgggcattattagtgccatagtgccatttcttgcgtgtttggatagaacccaagacctttacacattttaggaaagtgttctaccactaagttatacactaatgcagagattgccctataaatgaatgtcagtagaaagatctccatcctacactgctcagcttaaaatgggatggcttagagtggagctggcaagtttgaacctttgaattcaggggaaaggcactgttactgtaacaatacagagttgagagagaagagggaaccctgtcttttcctagaactacactttgttcctttccttcagttattggtggagcgttggttgccttctttactcacagactctggcttggggctttttacttagctctgtgagcacttgtttcattgtctcccacttgtcggtattacacactgaggtattacacactgagcatcgtcggttcaccagagcatcttctgagcccctagggatgcagctataaacgaaggcagtataaagagaatccctgatgttcaatgtagtctcaaagaatttttttctagatatatttccccttttgtgtaaatctattttgtttaacttaggaaaacccatagttataactaaactgaccaaaccctaagagagcatctgtgtagttctccttacaccttctcccatcagtcatctgtcaggactgttttcccatctttataacctgataggattttttttatcaatagagcaaaccatgagacaccaaaaaacacaatctgagcatatatttgcttttgtcagtaaaatgtgattgatcttcaatttgagatgtaggatttgagtttctgggctatttattattttacaatagactatctttaagaaccttttacgttatttgcatctctgtgcatgtttgtgtgactatatgtcacatgtgtgtggacctctgggagcaggaagaggactcctggtcccttgaagctggaattacaagctgagctggagccctggaagaacagcaaggggctcttagtcactgagctgtctcttcaacctcagttttgtttttgttttaataaagtattcaagaaactgctgtggaaacccctgtcacctcttgtactggagactgactcagggcctggcatatgttaagcaaggtctctgtctctaggtactgcactatcttagcagctctgaatggatgctccttaaactttaaataggtttgaatgccattcttagagcagatttggccactagtttctcacccagcaataattagtatatctgtagagcctttgagtgtgggtagcctgtgttttctattcaacaggacacatggaaggcaaggttactgtactggttaaattaggattcttgcatttgataactattaggcatgagaacaatgtacatctcttgactgctaaaggtttgtgttcctctagtaattctgacactgctcaccctattccttcactccagctggtaagggacggtggcctaagttgtcctcaggattggctgccaagaaggaaattcatacccactttaacaaggtgtgaagcttatcttagagtcactaatgcctcactgaccttttggaaaaggccctgtcactcatgaagttgagcaatttttcttctttaagagctaattaaatttcttactctgatttgttctccttggcaaatgtttggaagggctgtatcagcagctgtgatcctgcacctatcaaaatttataacttcctaaagaagttttcattttggcggagatcctggccttaatactaggaatgccctgttgaaagcttgcagtcgtgtttattacattcattctggtttcctcttgccctacttgtcaatggtaattgacatgtgtcagagcctgtatactttttctttgataggattctttgctagttcaatgttattcctccttagagttttaattaccttttggtaacttgttatttgtgggttttttgttttgttttttaaaaaaccttagagaataaatgctatgtgggctcattattttacctttattttacttataacatgggatgtgtgtgtgtgtgtttacacacacattttacttataacacggtgtgtgtgtgtgtgtgtgtgtgtgtgtgtgtgtgtgtgtgtgtttacacacacgtttgtttggagacagggtctctttattatgtcctggaactcaccttatagaccaggctggcttcgaactcggatccactggccattgcctcctaagatccaggagtaaatggcttttgggggtggtggggaggggtggtatatacaaaggtcaaataactcaatgggattggttctttcctcccacttttatgtgggttccagggattgaatcaaagcttgccaagcttgtagagtaagtgcctttacctgatcagtcatcttgctagctcctaggtaatcttttaaagaaaaggtcttggttggtgagatggctcagcggttaagagcactgactgctcttccaaaggtcctgagttcaaatccatcccagcaatcacatggtggctcacaaccatttgtaatgagatctgacaccctcttcagatagtagtgtctgaagacagctacagtgtacttacatataataaataaatcttttttaaaaagaaaaggtctttattatgaaaatgttttcattttaagccatatagcctctcgtctcacgtgcccccccccccatgtaaagcaaggtccacctcccagatttagtcattcaggttggcaggtttttgataaaattgccactgacatttatcaggacttggccctggaaagtgggagggagcttatgtgcatatgtgacatgggcattgctgtatggaggtcagaggacaactttgagaagtcggttatcagatccttgcattgtgagtgtgaaacttgaacccagatcatcagacttggatagcaagtgcctttacccactcatccatggcacttgccctcctagttagctttgaattcagatcagcaagtccaacctatgctcatggcacctttgggggcgtttaatgatcctttttcaggggtcattaagatcaccagaaaacacaggtatttacattacaattcataacaaagcaaaattacagtcatgaagtagcaatgacaataatcttatggttggtggtcaccacatgaggaactatattaaagggtcacggcactaggaagattggagttttgtttaaaaaaaaaaagtggtgtgtgtgtagcattcatatacctttttggaatagtttgcctgttaccgtgtgattgaatttctagactgatagtctaggcagcagacacttttacataatatgccgcttccccagcccagtttattttatttatttggagggtaatttatataatttctgaagtgctgtattgcaatactaggtgctgtggtaaattgctttaaaaaatacatttctcgtctcagaacaagcttgtgattctgatgtgaccctcactaaccctgagaaggtagaaattaggttctactttgaatttgaataaatggtcaattttttttctccaaatgtttgcttgtttgggtgttttttgttttgttttgttttgttttttgagatggggtttttcagtttgcagaccaggctggcctctgcctcccaagtgctgggattaaaggtgtgcaccatcacgcctggctacttttttgtttgtcttttaaactgtaaattcatgccatgtatgtctgtgaattgatgtaaatttttaagaatttttttattaattgggtgtttgcctacatgtttatttgtataccacatgtgttcagagctttggaggccagaaggggtctttaagaccatacctactccccctctctaccctctactacctgagttacagacaactgctggggatgaaacctggtcctctggatgagcagccagggttcttaacctgagtcatctctccaggccctggtgtgaacattaactaaatcagtgtgggtataggtgtttacctggtcaccttttactataataaaatcgggaattttaagtttcatttatttgaaatgttacctatgaagtgaatgagattctttctttccaccaaaacaaacaaacgtaaagggaaaaaaaaaaacctaactcttaataagagttgttgagtaatcttaactaaggtaagaaaaggatataaaccaattgcttctgttattatattttgtcttatatttaggatgtaaggacaagggattttttttctataataacttacataatgttttatccttttattatgaaagtagctaagtgtaaaagcacataagcaagtccaacatgtgcaatttttccttttaggttttggcttggttcgaggaaggggaagaaacgattacagcctttgtagagccgtttgtaattctgcttatcttggtagccaatgcaatcgtgggtgtgtggcaggtaagcagaacactcctgcagccgacacagtcttcttttcttttttaaagatttatttcatgtaagtacactgttgctgtctttagacactccagaagagggcgtcagatctcattacggatcgttgtgagccaccatgtggttgctgggaattgaactcaggacctcaggaagagcagtgctcttaaccactgggccatctctccagcccattgtttgtttgtttttgtttttgtttttaagacaaggtctatttacacgaccgtggctgtcctgaaactacatagacaaaggtggtgctgcaggcctttaatcccacccagtacttgagaagcagaggctggtgatctctgagcttgaggccagcctggtctacagaacaacgtctagaacagccagggctacactgtctcaagggggttgggggggataagggaagtaggaagctgaatgagaaagaaaacagaatgaatgtgggtgagaagctgggtatgatagatcgtcccttgcatagcactgacgagtttgaggcaggatctttttagactatactgggcaacaaaaaaagaaagttgataatggaaagcttcagaaaaccaaagaatgtgagaaatataatcaacctttatatttcatgatgattttgaagaaaaacttcatgaaaatgtcttttaatttcctcagattgtggagtacggaggaagctataagaattcttaacccaaattgtttttaattttctccattacacagactttgcctgcacacaggctgaaagcttatttactagagaacagaaattgcatccttcaaaattgatctataggatctacctcaaaaatgtcaatatgttttgccttttgtttagagtttgacaagacacctagactaatatttcaaattcattttcaagttggtttcccgcccccttcaggtttttggtgtccttacttcttactttttttttttggttttttttttttggtttttcgagacagggttcctctgtgtagccctggctgtcctggaactcactctgtagaccaggctggcctcgaactcagaaatccacctgcctctgcctcccaagtgctgggactaaaggcgtgcgccaccactgcccggctggtgtccttacttttaaaactgaagtagaatgcttgacattctttggtcaatttttaaaaaatatttatgtatttttggtaatagcattttagcccaggttaactgcaaactcaagactattcttcgtgagccttccaggtctttgggattacaggggatcgctgggccacacagattactatccagcataccttacaaacaggcctggcctgggtgacctgtctgtaactccagctcttaggaggtgcaggcagaaagagcagtttgttggcctttgctatataatactccccaccccttgtcttcccatgttctaaattttgaagcaggatggtgaccaggcatactttttttttttttttttttggttcttcaatacagggtttctctgtgtagtcttggctgtcctgaaactcactctgtagaccacactgcctcaaattctaatgtgttgtgttttgtttttgaggcagtagctcataatgtagctcagggtggcctccaactcgccattctcctgccttaaatttcacacttcagggattacaggtatgcattgccccatcatatttattttatttttgagacagggttttactaggtaattctggcaggcctggactcacagaggaccgattgcctctgcctcctatactgggttaaatttaaggtatatatcaccttgtttagcctagctttttactgtataaataagtttgtaaatgtttgtattaaaataccaattgttgggctgagagatatctcagtggttaagagcacttgctgctcttctagaggtcctgagttcaattcccagcacccatgtgggtgacttacaaccatctgtaatggaatctggtgacctctcctggtatctgtaaagacagagcattcatatataaaataaacaaataagtaaataaataatttttttttcttcgagacagggtttctctgtgtagccctggctgtcctggaactcactctgtaaaccaggctggtctcaaactcagaaatccacctgcctttgcctcccaagtgctgggattaaaggtgtgcaccaccacgccaggcttaacatgctttttaatattaagattataagttttaatttctaatctagaaatatttaaaccagacagcctagtttaccatacttggcttttctttatacaggaaagaaatgctgaaaatgcaatagaagctcttaaggaatatgagcctgaaatgggcaaagtgtatcgacaggacagaaagagtgtgcaacgaattaaagctaaagacatagttcctggtgatatagtggaaattgctggtgagttgaattcagttttatttattcctagattatgtatttaacgttcttttctcaaggttcagattatatttaactctttgtgtttagatatttttttgtttttcaattttatgcctatgagttatttgcctgctcaggactgtctgtgcactgtgcatatgcctggtgcctgcagaatccaaaagagggcattggattccttggaactggagtaaactgacatgtgagctctgggatttgaactttggtctacctgaagatcagtcagtgctcttatccactgagccatttctctagccctggttttgttttgttttgtttgtttgttttttttaatgtatattttaaaatacacttttcatatatttaaaaataaaattttgtgacaagtgggtctctattttgtcccttctacctttccactctgtattcctccttcccttcctcccccttccgccttttaattttattgcttgttggtttttcctgtgcttggtctgcgtgtttgtgtctgtgtgaagaattggagccactgaaactttagttacagatgtgagctgccatgtaggtgctgggaattgagccctggttttaaaagagcaacaaatgcccttaacgactgagccatctctctagccaccttcattttctttttatatatgtatatatattgttggggtttttttgtttttgttttgctgctgctgtttgtttcatttgtttttagagatagggtgtctcggtagacaggctggccttgaactcagagattcacctgcgtctgcctcctgggtgttgagattaaagtcatttttttttagatttatttatttatttatccattcatttattatatgtaagtacactgtagttgtcttcagacacatgaagaaggcatcagatctccttatggatggttgtgagtcgccatgtggttgctgggatttgaactcgagacctttggaagagcagtcattgctcttaaccgctgagccatctcaccagccccaattaaagtcatttttaaatatttaaaaaataggcaagttaaatactcaaaaaactaagttaactattaaaaaagtaaaaaagatgaactttataatttgaatatagttagtcgtcattccctacattcacaactaagttcgtttgacctatttctgaatccttcatggccagttagccacttctgcacatcggtcgtgggaagcttgggcagagctttggcctagtgcccatgtgctcgcttggattttgatcgttctaagaggtgcagaacagagagaactagattttacatagatatatttttaagcctcttgtactcctttctttctagacatgtcctagtattctgtaatgctgaccaaaacatgaaatctcatctttatcataagatttgctctgcagaacagatagtaaatgagttcaggaataggcacttaagtgagaggatattttacaatcatacaaaattttggttaaaagccaccagctgctctaaatatgtcctattcaacttttctagttgaggaaaattacttgctgtagtttctaaagtatatacatgataaacatgtatatggtatgtacataagtcacatttcaatttgttggtggctcaggtcagtctttttagcatcttagctgacatggttgacatgccatacaaccttctcttccacatacaaagtcctgacctgttcacagagttctgtagccatcgctaattccagacattgatccattcgcagaaagttatcttttctagcaactgttccttgtctttcactgtgccctaacaacagcttgcttgactttccggggtttacttattctaagatgttagacacaataatagtgctttgagagccagatacacgtatgtgtaaaagtaaaaataagtttaaaaaaagaattaaattttaattatgagctaataacttaagagtttgtatggatattacaagtggcttatgtaaacctttgaactatcgagaacacatggagtcataaaactgactaggcaaaaagtaagagaacaactactatcatgtattatttctacattcttttttttttttttttttttggtattttgagacagggtttctctgtgtagccctggctatccaggaactcactctgtagaccaggctgtcctccaactcagaaatgcgcctgtctctgcctccggagtgctgggattaaaggcgtgcaccaccacgcccggctctctacattacttttaataccaggaaattagttctgatgaatggaaacaaaaagtagtaaagctatacttaatcttacattaagggaacatcagtggtattaaattttctgaattaatctgttaattttacaaatgtgaattaagctataatagcaaaatagtctctgaatttaggatttggcagtggctttgatgtatgtcctaggggcttatttattcaaggatttatttattgagccgggtgtggtggcataggcctttaatcccagcactcgggaggcagaggcaggcggatttcttagttcgaggccagcccggtctacagagtgagttccaggacagccagagctacacggagaaaccctgtctcgggggaaaaaaaagatttatttatttattttatgtatatgaatgagtacactgtagctgtacagatggttgtgagccatcttgtggtttctgggaattgaactcagtacctctgcttgctctgacccaaagatttatttattattatatgtaagtacactgctgtcttcagacgcaccagaagagggcgtcagatctcattacagatggttgtgagccaccatgtgggtgctgggatttaaactcagtactcttacctgctgagccatcttgctaaccccaagggcactgttctcaacactgttttggtaacagggctgacgatagcacagagcttaaattgctcctgtcctgaagaatcctctggaatgagctctattatacaagtgataaaaatgacacagtcaacaaaaaattgccttaagccttctgtaaaaaatattttatatttcctaaaatgaaaactaattgctcagtaacagggacagcattttccaataattcagtaataatgaggaatcattcataaacctgactatttaaagaatagtaataagatttagtaatataaagttatcttcacatgaggtggcacaccttttgttccagcccttgggaggcagaggcatgagggatctcttgaggacttcctggtctacatactgcattctaggacagacagagctacatagtgagactctgtctctctctctcacacacacagacacacgcacgcacgcacgcacacatgcacacatacctatatgtgactttgctaggcagttgaatacaaagcaaggttatgtaatagataacccaactcatttaagaaaaccagcattgtcttcctctgcttcacatgggacagagaaaattcagctctacagaattgggcagttaagacgaatttctttgagatagtttcctatagcactggctagtcatgagttcatgaattacccaagtcaagccatgagcgcagggtcctgaaatacaggtatatactgctattcctgtctctgatagattctaaggaacttggtgaatctaacatacatataaattggatagttgtgatcatgaggcttgattgttacgtttttttgtttggttggttttgttttttaaatttcttttaggaagctgtcatagttgagccagcctagctttgtatatttaacaaacatctaatcttatgagctcaccagccatgagagcagagagtaagtaaggcattacatgggattaagctttggtctttatgttggtgtccgtccttactgtatagaccaggccaggtttgaactcaagatcttctgcctgccccagcctcctatatactagaattacatgtatgtgtgactgtgccaaattggcaggcttttggacttttggggggttggtataaatccatttggtattttgagctttgtttcacagcaacaccttttttttcccttttttaaagcaatcactttttgtttgattggttggttttgtttttgtttgtttgtttgtttgtttggttttttttttttcgagacagggtttctttgcatagccctggctgtcctggaactcactctgtagaccaggctggcctcaaactcagaaatccacctgcctctgcctcccgagtgctgggattaaagacgtgcaccgtcactgcccggctaaagcaatcacttaaaataacatctcatctctgtaatctaagcacttagctgaccactagtttaaagggaggggaggtaaatttttgtttgtttgtttattggtttttccagacaaggggtctctgcatagacttggctgtctggaaactatgttgatgaggctggcctgtgaactcacaggtgcctctgcccccaagtgctaggattaaaggcgtacaccaccatgtcccacctgttgtttattttgcattatgggtgttttgtctgcatgtaggaacctgcagaagccagaagactacattagatcccttgagactggaataacagatggttgtgagcctctatgtgggtactagggattgaacctgggtcctatggaagagaagatagtattctttcacttccgagacagttatgcatctttacagccctgtttttaagtacaaaaccaaacacttttggttggttttgtttagagcaaaacctaactttatgggcaggttgattattaaagtctcaaatggagctgggtagtttctacatttctaaaagttcctaaaagtctgtcccaggatcctgtggggagctagagagatggcagttaagaatgactacaacttttgtagaatatcagagttcagttcacaactggcctctgtggatagatacctgcatgtacatagtgcatataagttcagacaggcatatatgtgaacatacacaaagaaacacaaataaaagatacaagaaaaattagttttcgaagataagattcactattttggcctggttggcctggaactcagattatctatctcttcaaaagtgtaaacgtgtgttctagcatgcagaccacattaaaattttaagtgtggtttaagcagtaattatcctgtttaagcagtttacagttaagcaatttaatgagatactagttttttctttacagaagttgagatttagttatgttttttatatatgtatctatacatatatatgtatacacacacacactttcacatacatctccacaccccaagagggccttctgatccaccatgtgggtgctgggatttgaactcaggatctctgaacaaggaaaccagtgtgctgaacaagagagatggtgcagtgcataaagcaattgctatacaagcatgaggataggagttaagtgaccactacccacataaaacatgggaatgtatggcctctcctttgtcagcaggtaagaaaaagtaatccctatgccaggttggctagctacactagttaaggtgagctctgggttcagcatgggattcatgctcagtaaataaagtggggaatgggtgacatctgatgtgaacctcaggcttccacacacatatatgtcctgtcccctaaatttttttaaaagtcaaacttatactaaaggggggggaaaagccagagaaacaaccaaggaaagcattgagcatgtctgtaaagttgtttcatagtgagggatggggtatctagattcaggtaacactagaaataatattgattgttcctaaaaatcaagtcctaaattcctcatgttaacttgtatgttaagaaaagcaaggactggagatgagcccagcagttacagtagttactacccttgaaaagacccaggataaaacctcgctcccagctggggcacctcacagctgcctgtaacttcagctccacaaagctgtcagcgcatgatggctcagatataactccagttccaggtgatctgacacctcttggcctttgcagacagacaacagacacacatgaggtacacgtgaatacaggcaaaagaccaccgtatacataaatgtgaatctcttttgaaagtacaaagtacttttgaaaaatgagtgtagatatattaagcagagtgctttgaggtcaagaccctttaacactgtgaggacaggtcataagacactgagaggtgaaggactatgggaggttccccacctccacacaccctcagaccatgacagaccagttgatcttgaagcttgacctgattacacggggctggcatttcctgatttcctgtaatcactcctcccgcttcatgactaatagtcagtgtcagtctttccattcttgccatggaggttaagacttttggggaaaaaaacagctttaaaaagaaaaaaaaaaaaaacaaaaccaacaacaaccacaggaaaggggtcacttttgctaagatattgtgacttggaaaaatacagtgtttaagcttttcttgtgttagaacatgtagaggatttggggaggtggctgggatgtgaggatagaatggtgtaattcctgcttccatgtattaatttgacctccagaagtgaaagatgttcatagctcaacgttcagtttcagggctttctgaactccacctgttgaggtacatgtccagcccaccccaaccccaagtgcttgggattaaaggcatgcaccactgcacccagctaaaataaaatactttttattcacccacatacatgtatacgtaaactgttttccttgcatatattattatttatgtttaccttaagtaaaaaagatgtttaagtattcttacttaaatctccttgtaaggtaaagaaaacttccattcatttataaattatcgcaaaaataacttttaaaaactgactcttaactgtattcttggtagactaacctttaaattgtatttttcttcagagtgaaaatcagtattgttatggaaaggaaagagctaagaacttacagagccaagaactacacgtgagcagtgtcaggtgttaagcaaatggaaggaggtttataacacatgctctcattcttcctgcctcagcccaaagagaggaaaaaaaatgtggaggaaaaaattgcagagcactcccttggcaagaataagaactttccactaccacgtgccctcaggcgctcactcgcccattagggaacatcactggatgtgatcagcagtgtttccttgcctgcttcccaggcagagccctgtctgaaactcacaggagcctgtggcgtaaagacaattgttatttttcctttgaaaaatattagacagatctttactttcatagatttattttttaaagctccttaatagatctgtcctgatgtgcaaccaaatagacccttagcaaaagatgtgaagcagtcataacaagctagaggaagtctttcattaattgagcttcctgaagtaaaactctctacttcctggccttggtaaaacaaggtcatgggttggccaagatgatgcaaaggctttctagccgagagaatgctagcacatagtgggttataaaaactaattcgggcatacttccttcatgtctttccacagagacgatcttgtgggagctagtatttctggtatgcaagaaaatgtaatagagactgttccaaaaagttcttttcagaatctgaacctgtggttatgagtattctccccatattgtttttttaattgtatttctgtgtctgtgtccatgttcatgtgtgtatgtgtgtgtgtgtgtgggggtatatatgtacaagaatgataagagaacaagttaggagttcactgtcttatacagtatgggtcctagggattagacttccagttgtcaggcttggtggcagtcgattttagctgctgaatcaccttggtagcctgccttgtattaaatttttacacttgatcttagctaaaaggctgaaaagtgatgtaagaagtaagtcagcagaggaaaatgaatggatagattcagttcagccctgtctgcctgaaattcactatgtaaaccagcctagactgtctttgaacaccatggagatctacctgcctcccaagagctggggttaaaagcttgtgctaccttacctggcatcaggtgttgcctctttattcatgagtctgatatatgtttttattttgtcttttaaactgttaactgaagttctttgtatgtcaccatgatccagcacaagttgaattacaaacaatactcctttccgtgcaggagaaagtatggcccacgcttagttttaacatgcaaatgtagagtccgccaaatctttggacagctatggcccatggagaccttggctcagaaacaacaatgcttgaagaagtagtgacacagaaaacagcaccccatattcttaatatatgaaggattttaaaatacaggaaattactcacccaataaacgggactataaaataggcccatggcttcagaaaaatctaccacccatggaattctagaaagaatccaatccttatagtggtcaagcacacctttcattccagcagttggcagacaggaaaggaaggtggatctctaggttcgatgccagccagggctacatagacagaccctgtctcagaggagagagagagagaaaaaaatacacctctagggctggaaagatggttaagattactgactgcctttccagaggtcctgagttcaattcccagcaactacatggtgggtcacaaccatctgttatcggatctgatgctctcttctggtgtgtctcaaaacagtggcaacagtgtactcacatatataaaataaatctttttttttttttttaaagaaaatgtacctggaaacttttttaagaggaatctgtttatgtcagcatctaattgacaatttaatcaaaatcccattggatcctttttatatgattgtctagtaatgtcccacaggcatccaaacctgggagtttgagaggtaatctggtcgcctccttggagtgtgaattgttaacgtatagaaagtaagaagatagggttggctttgttactttgctctttttttttttttaagatttatttatttattttatgtatatgagtatactgtagctgtacagatggttgtgagccatcatgtggttgatgggaattgaactcaggacctctacttgttccagccccaaaatttatttattaaaatatgtaagtacactgtagctgacttcagacacaccagaagagggcgtcagatctcattaaggatggttgtgagccaccatatggttgctgggaattggactcaggaccttcgaaagagcactttgctcttaaccactgagccaactcaccagccctgttattttgttttggctctaggtagttaacttcagtgttaaattgagccaaagtcattttctatatattataggcaacttacttttcttctactcaagaagataatcatactgagaaaagtcgtaaaaataatacctgatggttgagtaataatacctgatagtgtctggggactacacattaaacaccctaacagcctcattccttgagaccatggaggtgggtaaaattattacctttttttttttttttttaactgtccaagaccagtttaaagatctggtcctcagggatcatttgggcatgagagtaacttttagctccattaatctttcttttattggttattccaactatgtgaggataaatcaaaggccttgtttgacaactgttgcactaggaagtaagtaggaagtttcctgtttgttaaggctctctttgtagtgtggaccttgattagcactcaccacaggaggtctccctggacacaccctgtacttagctggctttggggagcaaggatgagagtcgtccttttcatccctctggccacagtagaaagaccttccgggggtattggacacccagaaggtcagttactcctgtctaggactaaagccagacacttttaaataaaagttcttgtaattgttgatctttgaccttagacacttggatattatacatatcatctcaactttatcctttatgtaccttaaattactcaaaactaacttgcatgagatttctacttttctattctgaaaacatccatcaatatagatttttttcctctcattaaaatttctttattaaaatacagtcttttaaatattttgtttactgatgtccttttttaacaacatgagaaaatagaattactgatgtctctgtttttgaggatttctcctgggggggggggtgactaaagcagtgtctatcaccctgggaaacaagtgagtttcttaggcttatttagaattgtcaagaagttactaacggggggggggggggggggtggtggtggtggagaagttactaacaggggtgcaggtgacataaagccacactggaaagtctttacccaggatgtagccgggctttcacatggccacacagggagctctccctttctctaggtttcccagtctgtcaccccagatcctctataacatcttgaagctttgtatgattatggtctcattataaagccagctgggatggccctgtccatctcctccttttgttaaggagtataacatttagcctgttcccctgtgatcaatgaagacaacacttagagcagaagccctgtactctaagaaatagacacatttacttttaaccttatctgtagggcagatgacctgctgtcaatagagttttttaagttttctatatgaatatacatattaagtatgaagtaagcactataaacactcatattactttgggttgggtttgttcatttgttttcttaaaaactgagtaaccacatagaaccaccattttctcttgggcaggggtgaaatgctccctcggatgaaagagctccaggttttagttggaccttttatgcaaaagaaaaagatcaatgaggcagcagttcaattcagccctgaggcacagagagggcaaaggggggggggggaaacgactggtcgagaagagaaagatgtgacagagaaggaccagatgtatatatattgtagaaggtgtcaatcaacattgttttctcaatgagtaacagtcttcatattaggggaagagtcattgactttataatgctatcataaatgtcttcatttagcatgtatgtttaggtattggttttaccttactctaatgttgtgttattcagaactttcatcttgtgcatttattgctggatgtggaggcacaggcttataatctcagcattctggaggcaaacgagactctgaacagagattttgtttcaagaaagcaaggatttgccttaatggccttggtttaatcttcaacaccattgggttagagggatggtttgtcagttagaagcaccacctgctctaacagaggaccaaagtcagagtcctagctggcacctatgttgggtagcttccaaccatctgcactctgagctccaagggatctgatgcctcttccttgacctccatgcacacacatatataagagcatagacatacaccccacttcccttcccccttggggcaggtgatgatagggtttcactatggctgtcttgaatatcctgaaagtcattgtgagaaacaggttgacctcaaactcacagagatccacctgcctctgcctcccgagtgttacggttaaaggtttagcatcatattttgccctttctattttattgtgatgtatgtataatgtgtgtgtgtgagatgtctcagtgtgctacagagtgtggaagttggttctcttctctttccaacatgagatccaaggattaaactcaggtcctcggcttgctctatgagagctttacctgatgagcaccttgtcagcattagatgatcttttaataatctgtataggtggtacgcctactcatgtctattcaccatattcccaaagaagccagaagagggcatgggatcccttggcattggagttcaaggcagctatgagccactatgtgaatgttgggaatcaaacctaggctctctaaacgagcagccagaactcttaacctctgagagctctctctagctctcttaggtggaagtttgtaaatacagttactgtctatcccatcagttatagtgcagagtcatgaatgacatcagctgtagattgctagcacctctgtacctcattggacaaaaaaagtcttgtctgtagctcccataggattattacataaatcacctcggacatcaaaggaacatttgaaatttttccatttagagttataatacttccagttgaccttgtactcatttcatgttaaatgttaaaaggcccagggaattagattaatttgtgacgtgcagaaacaatggtagtagtatagcataccagtatactactttgtatagtagagtggtagtggcataccactaagtactgtggctgagcaagaagattgccacaagttcaacactagtaagagactgtcttaaagaatacctagtttaaaaaacagaaccatacattccaggacagccacatgcccaggagaagttggccaacacaaaactaactagtatttttgtgaggtttttaatttttattttgtcttgtttgggtatttcttttatcttagtttttttgtttgatttgattgttttgtcggagagggggtgatttatttttatttttgttttgtgaaagagcataaagttggtgggtggggagctagggagagtctgggaggagaaaacatgatcaaacatattgtatgaaaagctctaatcagaaacaaaaccagagtcgctaagatggattagcagtaaaggtgtctgctgccttctgatgacctgagtcaatccgtgggacccacatgataacagacaactgacttctgaaagatagataacctctgaccttcacactgggatgtcccacacatacaggttttttgtaatttagtgattggtttgttgagacagggtttcacagcttagacctgacttgcctgaaattcagagatccatttttgcctgcagagtactggtattaaaagcatgcaactgtcacgcctggtcttaaactttttgttgttgttgttttgttttaatgtcataatcatttggatgtactccctttggtataccgtgaacaaagtacattaaagtggaaggtttgttttattcagttggaatgttgctcttggttgcataagcatttccagcaggaattctaccttcacctgtgtgtgtccctgtagtcaaatgcaaggatgatcttaacccctggagatcttggacctacctactagctttgtgtgctgccttgctttcctaggcgtagggtcgtttcatgcactaaaacagcaggggttgcatgtcagattcgcctcatatcagagatttatgttacaattcctaactagtaaaattacagttatgaagaagcaacaaaatatggtcgaggggtgccacacacagcatgaggaactggactaaagggattaagcattgagaaggttgagagccgccacagcaggaaagttttttaaaagttcgctatattctccttggagaagggttaacaagtgcagggcatacttctaggataggatggctgctttggcattttctagaccactttgcttggaagttttgcactttgaggctggaggcagtcccaggcactgctaagcaggctgtcttctgagcatagccagttcccatcttctttaaagttccactaaatgggcacattagttctcttgcagaggtgctgttctcaggggtacatagagcttgggttttgtcccttactcggtgtattttagcattttgctttatacttaccaagtgctcagctaggagccctgtggggctattacaggaactctacccaggaaacaggttgttgactgaaagatcttcaggttatgcaagagatttatttattagataatttaaaaggtactaaaggttatagggtgaaatgtctctctccactgtggcctggaaacccagtggtgctcatttgttaaacattacagcactatcagctctgtgtgtgtggttctctcctgtgatttcccatgtgatgtacaggtaccttaggaaattttcaccacagtgtgtaaagtggtcacagctttcactgcttacaaaaattttgagcaaagtcataaaattaagctttataaaagtataatgttggcctggagagatggctcagcagttaagagtactgactgctcttccagaagtcctgagttcaaatcccagcaaccacatggtggctcacaaccatctgtaatggaatctgacgccctcttctggtgtgtctgaagagtgcaatggtgtactcatattaataaataaatctttaaaaaaaaaaaaagaatgttgcagctttgagacagcaacagaagtcctgtccatgtttcatttcccttgtatcctgatttccgtgtctagaagcacaggtaaagtatgataatcaattagctagtcatactctgtgacacggaatactggatgagctctttatatacatggttcttctttagcactgagagaattttcattaatttctgcatttgtcttgctttttacattatttggaggtctggggacaacctgagacagtctgctctctccctctattgtggggatcagatcagccttcaagtgactacccactgcacaatctcactgacctacctcctacctctagctttttacttaatttttacgatttgtgttattatgttattgtgtgatttgtgttattgtgttattgtgtgtgagatgtgagatgtgggaagagactttgtgaagtccccccaccccccatgggttctgagaactgaacccatggaactctcatttctatgcttgcatggcaagctataattaacaacccatccccccagccttgtttgttctttctcacccctatggaagctggcagaagtttagacgttgtgaagtaagagtcatattaccatatagcttcaactcaggtctgttttcttatttcttgacacttggaaggtaaaatagcatttctactgctgtgtatttgttttgtgacataactgatggaactatttgtttgttgtctctgttgcttttctgatggatgttcctgtgtatttcagaaatattctgtgtgtgtgtctgtgtctgtgtatgtgttcggcctcagattcaatgcaccattgagggagagcttgcagtcttgatcttctggttggaattacaatgtgggtaccataggtagccactcagttctagggaccatgccctgtctaccacctgacccccccccagcccccatctagcttgctttaaatacaaactacattgtagtgtatgttgtgtttacaaaaagatcaagaagggggggatatgttctatgaaggtgtagtcaggtatgggggaggggtgcctcagtgggcccatgctaagacatcccttccccctgagggacagccacgtaaccatatagtatggggagaggggagtcaagagaatagtagaggcagagagagagagtagagaagtagaggccggccatgatcccatggggagaaaggagcaagagagcaaggagggagggtgcaagcagccccttttatagtgggttaggcctgactgttgccaggtaactgtgctggagcttagacagaatgctaacagtgtacattggccatattctacccttaatctgttcactctgctcagaaatagagacctatttacccattgtgttgtatgcaaggtatttggttttaaaaagcatgtttgatatggaatcattcatctttaggtaaccataaaagttgctcactttaactgacccctccccccttttaatctcttaattagttggtgacaaagttcctgctgatattagattgacatccatcaagtctacaactctaagagtcgaccagtcaattcttacaggtaagtattatatatatattggaaaatcactcaaatttgaagcctcttatctctcagctatatgtacccctttatgggatcctaccctaaccttctctaagatactttatttcttagttatcatgatccagggtggaatgatatctgctggcagggttgacaggtttaaagaagtgctggcaggctggagacatggctcactggtaagagcaccaaccactcttccaaaagacctgggttcgatccccagcatccaccaggcaatcacaactccagcaccctcacagacagacacgcaggcaaaacccaatgcacacggaacaaaagagaaccacacagtacattgatgataagccaggcatggtagctacacttctaatactagcactttggagacaggcaggaagatctcttgtgagttcaaggccagcctattctacagaacaagttcaggacagccagggcttcacagagaaaccctgtctcaacaaaacaaaacatacatataacactttctcttcccacccccatacatacattttttttaaaagatttatttatttattatatgtaagtacactgtagctgtcttcagacactccagaagagggagtcagatcttgttatggatggttgtgagccaccatatggttgctgggatttgaactctggaccttcggaagagcagtcgggtgctctaacccactgagccatctcaccagcccacatacatttttttttttttaaatttaagtgctaacctgaatagcaagtaaatataaactttaaaggctgtcaatatttatttgggttccgttttaaaagtaactaactgatcataattcggtaagtccatgccacctgaagccccccttttttttaaagatttatttatctatttcatatatataaaagcacactgttgctgtcttcagacaccagaagacatcaagtcccattacagatggttgtgagctactatgtgcttgctgaactcaggacctctggaagagcagtcagcgcattaacagctgagccatctctccagccccaatccagtcagctgggctttaaacacttgttttatacaactgcttaactagtaaaattccctttagcaacatcagcttcaagttatttaggccataaaatgttagggaaatgattggactgtatacctgaaatcctcgggtatgcctagaaataggagagaaaactgaaaagggatcagaatcttgaagggtccctgtttttcctcttggctttttgaagcaggatatcctgtaggccaggctgtcttatcctgtaggccatttgatatatagctcagaataaccttgagctgctctgtttactgtctgtcctgtccagcagttggcataaaagcatgtgccgccactctcggcttcatatactgccggagatcgaccccagactttgcatgctaagtaagcactctgtcagctgaactccattcccagcccaactgaatgctatactaaacataggtcagacaaatcactgtatctttggctcttccaggaatatttcaggatgttatttcaacattactttttatttttaaaattacactttttgtagtcctgacattctctccattactctgacattaatctccattactaagttttcctagtttgcctgttttggatcggttgagccctttgttctttctcccatgttggaaatggctatgaactttcttgcttgtttatgactgggtctcactgtgttgctcatcccgcaaactggatgtgtagcacacggtggccgtgaacttggaacttgacttgcctcagttcctgtgtgttgggattataggtatatgttaccacaactgctcacattggcagtgataaaacagtgggaatggggtgctgtgggattggctatgccgcagatagcgttaaccatcctgtctcataacctgcataggtgaatctgtctccgtcatcaagcatactgaccctgtccctgacccccgagctgttaatcaagacaaaaagaacatgctcttttctgtgagtacttttatcagatgttgggggtaaggtttcctgggggttgaaccaagggcctcagctaagagtgtacttttatttggagatagtccctgtcttaattagggtttctattgctgtgaagagacaccatcaccatggcaacttttataaaggaaaatgttttataaaggaaaattaagggtagcttacagttcagaggtttagtctgttattatcatggcaggaagcctggtggtatgcaggcagacaaggtgctggagaggtagctggaaaaagttctacatccagatcttgaggaagtgggaagagagagtgagcctcaagaccccacctgttcccaataatgccactccttatgagtatatgggggcgttttcattcaaaccaccaacatcccaaagttctgagtcttttctttttactggccactctcagtggccagacgtaaaaaaataatcagttattccaaagataattattctttggtatgtgtgtcagctgtcagaaaaaaagaaaaaagaaagaaacatagctgggggagtgatttgctgaaggcactggcaacaaagcaaatgaaccaaactagagactgtaaaatagtggcatgtgtgacttgatgctcatttcagttgccatctaatgaaatgattagtgcaaacatgtttaaaccccattggtaacacttgagaagtaactgtttataggttgcaggcattgctgctgcatgtggctgtgatttaaaagaagtctgtgtttggaaagagcaagcatggtttaccatgtgagccgaggtgaagaaagctcctgtgtgcttattttttcagttgaaaatgaaattttttcaagtagtatagaaatctatgtgttttgattatttacaatctagcttagtatatttcaaggtgcgggctttgctggttagtaggagcacttaaccacagcagcaagtagatcgctctagtgagaatgattgctgccctatccagttaaggtggaatagggcgagaatactcacgtttcacatctgacttcactgacctcagtagtggtactggagtagaaattctgaaacagcctacaaggctgattatccacgcttagctgtgacaaaagtggagtgagaaacaaagataaaagaatccatagtgctgagagctgcatagaatttgaaattacaaaagtgagagtactgccgagcccagagcagatctgtaggcaggttccctgtgtggagagccgtcctgtcccagggagtgagcaggtgctctgtggagtccaggcagtatccacatcaggatttaaggtgggatgtgctggtgccctcatgacccattttcctcttctccctagggtacaaacattgctgctgggaaagctatgggagtggtggtggcaactggagttaatactgagatcggcaagatccgggatgaaatggtggcaacagaacaggagagaacacccctacagcagaagctagacgagtttggggagcagctttccaaagttatctccctcatttgcattgcagtctggatcatcaacattgggcatttcaatgacccagttcatggtggctcctggatcaggggtgccatctactactttaagattgccgtggccctggctgttgccgcaatccctgagggtctgcctgctgtcatcaccacctgcttagctcttggaactcgtaggatggcaaagaaaaatgctatcgttcgaagtctgccttctgtggagacccttggttgtacttctgttatctgctcagataagacaggcacacttaccacaaaccagatgtccgtgtgcagggtgagtaaggggcgttctctgtgattcttgcctgcagtctgtgggtggtcatcccacgtggtggaggagagaaaatgctcctcaaagttatcctctgacctctgcatgtagttccgacacacacaaatacgtggtaaaaattaataatcccccactgccttgggaaatacagaatagctgtaaagcttatagatttttattaaagaagtaactggaggtttcatcctctttctctacatgtgtgtccagaggaagcaactagttaaacctcctgctgaagtcagttgccatttccatagcacgctaaatgaaacacggtttctctctgacacatatgagcagatacttgcttataagttggcattttctgctttcttctcttgttagaatgtcgtttgaagtaaaataagaaaccttttaatgtgctcagtaagaactgaaactgagcacagtgacccacacgtgatcagtcacagtcctgcaggcgaggcagcaagatcagacgtcaggattgttcttgactacacagaaagtttgaggctagcccaggttgaatgagacattatctatcggatttaaagaagaaaacagaagaattgagaagctaattgttacaggcatatgcatatggcatatttgaggctggaacaatagacttttaagtggtggtgagggtcacattttcaatgaaaggtcaaggtaggtttttttttttcccacagaaaagataggctactaactcaggctttgctgtttaacttagtgatttgtgtaatcttgagtgaacctatttttcctatgatttttctataaaatgagcacgcacacccatgtagtggcacatacttttaatcccaaaactcaagctgaagaagcacacatcatctctgagtttgaggccagctacacagtgaaatcctgactcccaaaaggaggtagagggcgatggcaagcaagcagctccaggactgatagacactgattggagcctggttaggaagaggggcccaggtattctacagcagctctgcctactttacttgagtgttttgactctgaactatgagtttcttcttcttatgcctgtttttaaagtaaaacaatagaatgaaaatctctgggctacttgatgtagaattctgagcattaaaaacaatcattggtgatttgctgactaagaatccccctatttttgcttgggttatcttagactacatcactgtttagacagttaggttgaaggctctctgagctgttgatagagcattgctgtgagggggaacctggttgagcattgttcagacttccttttttgttttttggaggcagggtttctctgtgtagctttagatgtcctggaactttgtaaatcaggctggcctcaaactcacacagaggtctacctgcttctgccgcctgaatgatatgattaaaggcctgcaccactaccacctagcacaaaccaccttctgaaatgacaggatttttcactgtagacaaggaattcttttgtgtatatcttacataaaacttttgttttgtgtttccttgtagatgttcattctggacaaagtagaaggtgacacttgttcccttaatgagttcagcataactggatccacatatgcaccaattggagaagtgtgagtaagctctgtcactatggtgacttctggttagaccatgagggatgggtctagaaactgttgctgttgacagaggtctgacttagtgatggacctaagatatgccttgctgtgatccccagaagctctgaataaacaaacagcaggatgtgcatagtgacactgtggcaggtcacaagatcgtagccagcctggactccgagagaaactgtctcttgtgtgctctctcttagactcacacaaaagaaactgttgctagatggctgactggctcaagttagtggtttttaattaataataccttttgaagcctagacttgctggtgaaggctttgttttgttcttcacttactggtacactgttgggttttgatgaaaatttctggtcattcaaattttttttgagtctattccaatttgttcttcccaaactccattttcatccttggggacagggggctgtcacatgcctacggaagttcagggccatgctggaatagaaagtgagttctagttttcaacaaatgggaggtagagtgtaaaaagcactttctctgtgtgtgcagcaatgggagtccatctcacgacccttagtggtgaaggagaggaggaccttccacaatttgtcctctgacctcctctgtacatatgtgccgcattgtggcatacagcttctgtttaggttctgtttgtttgtttgtttgtttgtttgtttgttttaaaactaaagttgagtaaagctgtgatctagaaatgtttttctctttttataggcaaaaggatgataagccagtgaagtgccatcagtatgacgggcttgtagagttagccaccatctgtgctctgtgtaatgactctgctttggattataatgaggtaagactccttgtaatgttctgatgctggctcaagggtagggtgagtggaattttatttctgatttctagtcccgtggcctggctgaaaaaaggccaggtgcccttcacagacctgcagctgggcactacagcttgttttactaagatacatagttgtcatgatgttctgaccactgatgcaccctttaaaggaccagagttccagctacaagtctttctgagagtgagggtgaggactgtactttttttttttttttaagatttatttatgtatgtgagtacactgtcactctcttcagacaacaccagaaaagggcaacggatcctcccattacagatggttgtgagccaccacgtggtcgctgggatttgaactcagaacctttggaagagcagccagtgctcttaaccgctgagccatgtctccagccccaggactgtacttttaaacaccaattgccatgtatcctcgagcacagtctggagctgaaagggttgttttggtggtgtagtgaagagtgataaccaagagaaccttttacaagttaaatagtggggttattgatttgctttctttttcaaaggtcattagaataataaacagtgacctgaaatggtcaaggactttaaatgaataaacatcttaatatctgggtttggtgtctcatggttacaccgtcttttctcacatgaaccggggaggacaagctattctgctgacattgacttcttttgacaatgcaggcaaagggtgtgtatgagaaagttggagaagctaccgagactgctctcacgtgcctggtggagaagatgaatgtatttgatactgagctgaaggggctttctaaaatagagcgtgcaaacgcctgcaactcggtcagtattgagctcagcacagtatgctgctcttcttcattacactgttggtttaactgttgttcttcggcattagtttcctgatggtcacagtcaggtacgatggtctctcatgcctatatttctagagctcacgatgcaaataccaggagaattgccacaaattgtagaacagaactcattagacagacgaccaaatcacattttaaaaaacggaccaaaacaaaacaaaaatagcccagcaatcattagtaccttgacataggtgtatcataagggctctaccaagggagctatccctagtcctgagaatacccagccctcctgcctgcatctcagtgtctttctctgtgcctctccagtagcataaagaaaataattgtatgcttttaacattagagctgtcccttgccctaattgtcatttgacaccccatttgtttaactcgggtgaaaaaaactgttgagtgttcattctcacttttttctttttgtttggttagttggttggtttttccagacagggtttctggctgtcctggaactcactttgtagacccggctggcctcgaactcacaaatccgcctgcctctgcctcccaagtgctgggattaaaggcgtgcgccaccatgcccagcttgtttcatttctgttttctcaaatccattccagtcaggctcttgcctccacctatcagtccatcaaaacctcttttggatcacttataactttgtgctgaatccagtggttaatttgtttataactgttaaatgtaacaaaatagacaagtcagcagttgtggattttggacctggagatggctccatggttagaagttttaagggcctggatttgactccctcctcaccccaccccggcacctaagaactgtctgtttctcctgtcagacggtcagagggtgccctctcctgccttccatgcaccaagcatacatgaggtgcaggtgtgcatgccaaattaaaatggtgtgtctcggagagacagctcagtggttaaaagtactgactgctctctcagaggaccagccaaggttcgtttcccagggatctgacattttcacacatgcatgcattcaggcaaaacaccaaaggtcataaaaaattagcactaaataattattttgagaaatgaaaaagaaagctagaaaatgagggttctgatgtatcccagaaatcaacctaatgactactgagatggaaaacaacatttgaacaacaatcaccaaaacttgtttgttagtttggttttgtttttttgttttgtttgttttgttttgtttttcctgttctgttcttccaagaccttatttctcagtgtagcccaggctgtcctgcaagttgctctgtagacttggctgtctagaactcaagaaatatgcctgcttctacctcctaaccctaaccaccacacccacccgtttttctttttctttcctattttttagttgaggctgggggttcttttagtattttcaaatgcatacagatgactcaaaatagaaaatgctgctgttccatgaagcaaggctcatcaattaatcatgcagactatgtttttaaaaagtcagccagctaaccctgatgatattgaagtgtgttgataactatcaagttctctatggatttgtttttagagtgtgtattttgtggatgggcaaggccagcagcaggcctgtggttagcattgcttgttaccaggacacagcctgccatcactggaaaggaaatgtcagtgaagagttgtctacattggcctttaagggattcccttgagttaattgaaatgggaagaattctgaactaccctggtagaaggggctactaaggactagtgtatatacactagctctttgctcttgactgcaggtgtactgtggttaattctctcaagttcttgccagataggctgtgacttgcaacagataaactccctcctcttatgttgccactatcaggatatttcatggccaaccaggaaaggcactcaggtacttaaaaccccaggttgggaggctcttaagttcatggccaacctaacctgggctatttagtcatctcacagagttgatatagagttagaaattaatgctacaattttcagttgagagaatgttaaaaactgaaaactaatgactataggattacaattataactcagcatgtgtttaaggaagcacagcacacacacacacaaacacacacacacacacacacacctcaagcagttacaatctatcagtcacctaacagctaaaaagttaaaaagttgatgggtcatctcataactttcaacaatgacataaggatattttaatgcttaattagagcattataaaataataatctaataatgatctgcataatcctaatggcaaaggtcattcagtggggcagtggtgggggatacaggaagtagctgtgaatattgaatcacctacactttgtgggggtggatctagacagcgtttctctgtatagccctggctgtcctggaactcactttgtagaccaggctggccttgaactcggaaatctgcctgcctctgcctcccgagtgctgggattaaaggtgtgcgccaccatgcccggcaaatcaccttgagtcttgagcatagccataagctagcatcagcatgggcaatcctgcctgtccaggaaccgctgctgtgcacctccagaccatcatactacagctatctttccacactcttcctcctcttcagcttgcaatagcttcatgagattagccagtctgaagttgaataaaacagttttgtggctgctgacagatatttgccacctagttattgtctctatagacagatcgattctacctgtcactctgcttggcttagaaccttccgtaagggtgaggaagttgctcaatggtaatgtatttgcctgacatgcacaagctttatcctgctcaggtaggtaagaaatgatgtacagacaggatacggtagtcggagtgtcagtcagcgggagaccactgagtgcttgaaaaaaacacttgctcctctgctccctcattgaagttctgtgtccccaggcgtggcatctctcttgggtatctgatctcccctagcctaccaggaagtagatggtcattcccaatctctggccatttttgtgtctagccactcccatgcagcctttgaatactttgacggttcagagtctggtgggtcatagccaagctctctgtaacacggaagactgttctcttgctgcacccacagaacacatttagtgaccctcactgacagaacagtgtgactacaaggttttggagaacgcactctggacccacaccctgtgccattggagtagtcagctaactggcactgtatgacatgtgttacatgtctgcctttaagaaattcactatgtagctggggcaactcttgaacttggtatctatcctcctgctttggcctcccagtgctaggattatgcgcatgcagcaccacaccagctctctacacagatttttttgttttttgggttcttttgctttttggtgttttgttttgttttgtttgagacagggtttctctgtgcagccctggctgtcctggaactcactctgtagaccaggctggcctcgaactcagatatctgcctgcctctgcctcccgagtgccaccgcgcccggctgtgctatcagttctcaatagccaatgtttaaagctttccgtggttgtcctgcacaaatttttgtcccctatggccttcagtatatcttagttttacattctaatctacttccaaaccagagaacacttttgtgtaggtgcttgctatcttgttcaccgctgttgaggctgccaaaaagaccagtgtgatgaagatatctaaacaggggcaggctctatcatttaatgaaggtctaatgcgtatctgagcaggtataaaatgtctcctctctgatccccccacaggtcataaagcagctgatgaagaaggagttcactctggagttttcacgggatagaaaatcaatgtccgtctattgtaccccaaacaagccaagccggacatccatgagcaagatgtttgtgaaggcaagtgctgtgcagactgaggctttcctaccagggagacgggcagggcagttgctaatctgagtctcacattctcagggggctccagaaggtgtcatcgataggtgcacccacatccgagttggaagtaccaaggtccccatgactcctggtgtcaaacagaagattatgtctgtcattcgggagtggggcagtggcagcgacacgctacggtgcctggctctggccactcatgacaacccactgaagagagaggagatgcacctggaagactctgctaacttcatcaaatacgaggtacctccacctcacccgcacagccactgtccagcctctgctgccagaggagccacaggagtcacccttgtttagattgctgcttccaacagaaatagttaaggatttagtaaatctggtttcaaagtagaataatcaaaacaagttcagacaagcctgtcaaagcctaatggaaaccaagttactaatggatatttaaaaaaaattaagtattggtaaaaggctgagagatttcatttccacttcttccttagaccagaattttatatcagggatggaagctactaaacagaagggacagctttgctgtggcactgacactgccagcctctgagtgttcattctttaacactttgttctgttcctgtggtcaatctctcaaattccataatacaggccagacatagaaacacatggaagcagaatgctgctacactacaggtttcaggactgtagctaggaaaaccttgtttgaaccaagggcaagcagaaagagaaaatgacaaactcacagttgtagcaagagtgagctgccaggacactcgggtaggggtaagctgtttgagctcatgtggctctctcactttagaccaacctgactttcgtcggctgtgtgggcatgctggatcctcccaggattgaagtagcctcttctgtgaagctgtgccggcaagcaggcatccgggtcatcatgatcactggagacaacaaaggcaccgctgtggccatctgtcgccgcattggcatctttgggcaggatgaggatgtgacatcaaaggcttttacagggcgagagtttgatgaattaagcccttcagcccagagagatgcctgcttaaatgcccgctgttttgctcgagttgaaccttcccacaagtctaagattgttgagttccttcagtcctttgatgagatcacagctatggtaagattttagctagacttacacgacacaacagtgtacgtgtgcctataatcctggcacttagactgaggcaagcctgtgctacctagtgagatcttgtgcctaaaaacaaaaccaaatgaaaaaggcatgttcttaacctgtaagcaatacttagtgtgattatgtgtctgaggtgtgtaaatgaccttaaattatgtggccccaccacaaatggctctcaggttttgagtgttggtataaggcaatataagcagatgtccagtctccttagttctacctttctgtgatatgactctttaagcttgcatggctgtttttgtattttcttggtaaagtatttgacacagctactgctctgtcccgtttcctcctgcatcagtgcctctgcctagagctgtgccacatgggtggtatctgaatcaactgcaccttccctttcagactggtgatggtgtgaatgatgctcctgctctgaagaaatctgaaatcgggattgccatgggctcagggactgcagtggctaagactgcttctgagatggtcctggcagatgacaacttctccaccattgtggctgctgttgaggaggggcgagccatctacaacaacatgaagcagttcatccgctacctcatctcatccaacgtgggggaagtggtctggtgggtgtctgactggaactaaacagtatctttcaaggctggggccagggtgttgagctttctcagattgctgcttctgttaggacaaatttggttgttggcttgagaggagagaaatctcatgggacttgtctgcagctgaccagtggtgcagaaaatattcttaaaatggtagtttaaaatcataaaagtcttggtcctctaataaagtttcatatgaacttagattagatgttgtctgatgctcctggcttggggagataagctatttccatagttccaaaactcactgagttttttctcttcttcccttggatggaaacagtatcttcctgacggcagcccttgggtttcctgaggctttaattcctgtccagttactctgggtcaatctggtgacagatggtctgcctgccactgcgctggggttcaatcctccagacctggacatcatgaacaaacccccccggaacccaaaagaaccactgatcagcgggtggctctttttccgttacctggctattggctgtaagtacagttgttgtttgtgtggaaggatgctgtgtgcagtgcaggtcacccactgaaagcctctgttgaacaagcatcctgtccttccttgggttatagagaagcaacagttagacatcaggctttttatattttccccttgctcagagtgatgcaaataccaaggcatgccagagcccttccctgttgcgagcgccaggctgagacttgaatgggttattaccaactaggggacaagaagagtccactagcagaggctaatgccgttctttgtcatagttcagtttaaagagcatacaatctagagtggctgccagttcctctggccttcacagtatctcgtggaccagctgccctttgggcaaataaaaatttccattccctgtcttttaaactagtgccctcgtgcaccactgtaattccaggttagctgtgtgctctgctgttggttaggtgattgaccgtggataaaccagtctcagctttgcaaatttcctgaaattgatgaggaatggcctctgccttagacctaactctggtgctgaggggtgggggccagcattgtaatggcagttctttgaaagggttctgcttggccatacctggaacagtgcagttacctagtgtccaacaaggtcacctccgtttgcctatagactggtgtgacttggtttcctcagttccttgtgtgttctgtctgctgggatggatgggcctgacctccacctgttgtctgaagcctatacttgctctttagctctgtggcacctagtgcagggcgtgggctggggtcagcaggaacatttcctcacaaactctagagacattgcctatttcctttttagaccagaaacgccctgtctgtagtcagctgctctggccagtgtggtaacctgcagctttgtttctaggttatgttggcgctgccaccgtgggtgctgctgcatggtggttcatcgctgctgacggcggtccaagagtctccttctaccagctggtatttagccacttttttttaaagccctgtgtagtagagtgaattcttgtaacctttggtctttttctgtggtttggggtcagatagttgcctcaggtagctctaagacccagggcttctgccgagctgtattccgtattggtgttgggccttgaactcagtgtggaattggcatctacatttgggaagtactcccggctgatggaatgtttggactttgttgcagagtcatttcctacagtgtaaggaggacaacccagacttcgatggagtggattgtgcaatctttgagtccccatatccaatgacaatggcactttctgttctagtaaccatagagatgtgtaatgccctcaacaggttagtggatcttgtaggctatggtcctagggtttatgagaaaatcatggctgatagctcttccctcacaaaaaatgacatagttttaagctattgttccccaggaaacagtgggggttgtccccatcatgggttcctgatgcggcagggtgtatgaatgggaccagcaatccagactatgcctgtaccctagagagtggagcacaagaagttccatctaaccaagccactgatggacacaagtttccaaatggctctaccttgggtcatcaccagcagctttgagcctgctgagatgggcctgctgcaccaaagcctccagctccccgcactggggaaagcaggcctttagagttagttaggtcagcaggcagtagcatcactaaacccttgcctgcttgtgtgtcactgacgcatgcctttgcctctggtgaggtcacttctcttctcacctgtagcttgtctgaaaaccagtctttgctgaggatgcccccctgggagaatatctggctcgtgggctccatctgcttgtccatgtcacttcacttcttgatcctctacgtggaacctttgccggtgagtcatgatggaccccgggcggggtctggggtagttcctttcaggcagggccagaagcttgacccagccttgtttgtctcagctcattttccagatcacaccgctgaatctgacccagtggctgatggtgctgaaaatctccttgcctgtgatcctcatggatgagacgctcaagtttgtggcccgaaactacctggaacaacccggtaaagagtgtgtgcagcctgccaccaaatcttcctgctccctgtcggcatgcaccgatggcatttcctggccgtttgtgctgctcattatgcccctggtggtctgggtctacagcacagacactaactttagcgatatgttctggtcttgactgacagcgctacatacagaagatgtttaacttaatcaattaattttttattgtttaaagcaactgtctatttctgctgaattttcacatgaacatattggctggtgaaggaggtttcatatctagattttgttttgctttttctgactccagtgggacaagattttcctttttttatacacataattaaagtgtccattgacgtgtacagagaactaacactattttatgcagatatttttttgtagatgaaaaagcatgtacagtgttctgtttaatactcatacttgtacaaagatagttgagccagcagacattgtcagcaaattaattggcagcagacttaggaaatgaatgtgtgtggtttttaaaagaaaaaaaactaaatagcatgtattgtgtcttttgcatgattctctggatttaatttggtatcacagtctaatttttattcataagccaatttttctgcactgagcagagtcctgctacctcagtcagtatttttggtttgccacttcctgcaccctcagcctctgtcacccccagcccaccccagcctgctcggcttcttctgtaggtctgatggttctgtttacatccgtcttcacgagaggtttgcctgtctcgcttgtgcagaaaacattgctccagatccaatcgactgggtttctgtcccttcgcctagtttttaaggttatttatttaaatgtctaatgtattttattgtaacagacattgttttgccaacattgcctattcaatggcacttcacaatctagtttaaaagaaaaataaaacattttaaatggacagagaaaaataactgtcttgttcttaatggccttgaattacgtataatcagttcaaatttctgagcttctcagcttagagccttagtttcctgttctgagaagagtcctgttctgccgcatagtaggattttatttataatgtataggcacgatctgtcatgtgatatacattactcaagtttctgctggcccgttgtatgtaggttggtgtaagggcaagtgtgtgtttatgtgtgtgtatgttttgtaaaatctgtaaatagcacatgaccaaatgaacatattgtatagaaatatttttatttgactatggcactaaccaccaccaccatgactgatgaacgtttgcgcatgttcaaggtcagtcttaacggcagtgtgagtcattaacagtcctaactgtggtgttttcctccaatgccttccaacatccatcaactaacgtgagtatcttccctgtgggactggggtgctgtggcctgtgtacaggtggtgccactgatgagctggcccctgttgctagtgagctgcatggctcctgtgtccaccaggcagccactcactacacaggctaccctagtgtagacactgaccaggacagcgatccctatgagctgtgggaaggagagccttgggacctggctgacttcaggctgaaggagctgtgtcacctctagtaccaaactgagactggacacaaaccatgtcacaaggctatgggttttcagtggctgaggaagactaggaaagccagctgactccgcataggcagcttttgtcacccttcaggacatgtctcaaccctctggtgtgcagaggcctggagactgcgacctcctccctaagttgcaggagaaagtgccaggttctgagggaacctggcactgacccttccttggggaggcctctgtgtgctacagggagcagtgattctcaggaagcaggcaggttttgatggagtgggccaaacacaaaggtacagctgagttaaagaccaaatcagaatgatagcgtgctgggccctaacaccatgctgttcagtgccgtttacgaatgagtgggccctaaaggaaatggacctcatccctgagtgctgtgttgcttactgggacctgttcaaccccaacagatagactaacacttgacccatccagccacaagcaaggctgacaaaaccttcccctggcccgcatagaccaaggccaacagcacagtcccagccacaggccacctcctgcatgtcctcagccctgctctcacccagcaccctcaagaagggacagcatttattgtgtcagcatcatgctcaacccactagggcagtctagcctggaccccagccttgaactttcccggaatggcctcttcagcaaagctgtctaaaggttccaccctgcagcccactcagcaaaattcaggtggtggcctccccggagagctagcagggctactaaggctggagaaggctagccatctcacagcagctgctatcacagcaccctcaaaatagggtctcagccccaacaatggcacaggcctcaggaacatctaagatggcagcattggctcggtgcctgcagagccgcagagccaaaaagcatggttgccctttgtcgtgagctgccaaactccattaggactgacccctgcaattgggaaaccttcaaagcagagctgagcctgtagcccaggactggctgccatagagaacagggagggacaggaaggcctctcccctggtgccatgccactcactgctccacctgcctcaccctctgcatggctctcagccctgtacctgacatgccttctagtttctgcctcctggaactttggtaggaggcggcccagggcagtcaccaagccactgcttctagatgtgcctgggcagcaagcacttggaacactccgtcagaaatgctggttttgcatctagaccaaatgcagtgttctttctgtctgtccctgttgttgtgtcttaacattgctctacgtttcgaaaagctgatttcctctctctttccttttcagcaatactggagtaaccgcttcctaaaccatttgcagaaatataagggtgttcgggtgcgtgcatgtgcgttgttagcaacacatctaccagccctctgcatgactgaggttggggaaaagaaaaatagaaacagtccccaactcactgtgtgatgtggaggaaatgtgtattaccagtggggttttagctgttcaatcaaaataataacaaatgtacaatttagcataacaaatcagagagcctctccagagaagttggtttctttgctgcgagaaggaggttctgaaaccttatccaagaacagaagccatcagccaagtctccacatttctctgcaaaatgtcatagcctctctaactgtatgataattgtaatgcatgccttcagttgtaagtggccagattgctctacagtgacattgaaacatgctttctaatgggccctgtacagtttgcttatttataaattcatttaaaacactacagctgctgaatggttacaacataggcctccagtcctaacttcagttgtttaggtgtgcagccagctgttccacactgtattattgtaacttatttaatgaagtcagaagcagtagacagatgttggtgcaatacaagtattgtgtgcatttatcgtaataaagtgctcagcgtcagttcagttgctcacagcttctcacagcgcatgtttgactgtagtctgtaaatagaggtcagtttctgtgctggtaacaggtattgcacagacatgatttcaggtaaataaatctattctacgataaaccctcagcagagctgtggctgatttacaggagggtggggacgggcactgaggcctccctgggagactggttttgtagttaacctggagggaagcagaatgcgtgtcacagtgaccttcagcagaaatcaggccttttcagctcagactagaagtctacacgtgactagcctcgggagttgtgtgactgttcagatgcaaagtgactgtgacgggagacagaagtagacctgaaaggatcctgaattctcccttaaactgctattctggccttacttggcagagataagcttcaaatgagtcctgtcagctcctgtaataggacagctttttgacagcatccagggccaagatggctcagcaggtaaaggcctttcccttaagatgagtctggagtcctgggcttgactcctagaacccatgggagaaccagctccatccacaaacttgtcctctgacctccactcctgcccctttcagaataaacaactcgagttattcctaacatttcagaattacaggatcactgtccccaacacttcagctcatattcaacgaagaaatttctcagaaggaataaagaccaggctggcctggaactctgtctctgcctcccaagtgctgcgaggtgtatgtacgcaccacagccgcccagcagacatcctgttcttagcaacctttagtaacttctaagaccagatgtcaacacaattcttttaatctaataggcttgtttttcatggacatgaagtatgccaagcaggaggtctgaaggccacttgagcccttgtgcttggcagaaacacttctatatctttaggcccaatctagtgcaaatggattaaagggttttaatgtctacactttggaagagaaagtcatgagcgcaggatgctgtcctgtgtaagctgtgcgttttccatggctggtgggagcccagtgccccctggagaacaactgggtgtcacctaagtccaaagcccttcgtgacctagcaggtccactctaggcctcacagggctacagcacggtttgcagtagagaagcaaaactatcgagtgtgtagctgtaagaagcctcggagcgtgaagcaggagtcagcattgagggtcagtacagacccagcacccgtgacacagcactaggccctcaacagtgggtgtgctagtcaaggcctcaccatggagcctctcacatccttgtctttttaaatacaaggaggaaactttgcctttcttggcaagacctgaaactgagggggaggggggaatgacggaagaagacaacaatcctagccagaagacaggtgattacactccagagtcaagtaaacagatttcttgtaactgagcagagaagtaccctctaatggcattgtagggatggatatgcgctctcaccactctggaggaggttgtctatccccagactccacttttttaagtctcatgccgtggtctaaatctcaaaagctgttcctgcctcccaagtgctggaattaaaggcctgcatcatgcctagcttcagatctatttttaagggcccaacccaacaacacgctgcagttcccaaatatgtccagacaagaagaatccattttagttttttaggtagagcctcatggcccaggctgtggcccaaacagcatatagctgaacctgcccttcaactgttcctgctgcctccacctcctcccaagtgggcccgccatgcctggcttcccacttcactattacaaagactggaaataatggctgctaccaataaacaagatccagagcaggttctcagtcgttctgatgctgggacgcttttatcatagttgctcgtgtggtgaccccaaccatgaaattaatgttactgttgttcataaactgattttcctagtgtaacaaatatctgatatgcagggcagtcttaaaagactcctgtcaaagagtcattcaacacccctcatgggtcaaagtctacaggttgggaacacactgattagaatatccaaaccatggaaaaaatcgaagtgagtgatgcgcattctgcccaaaatagctccgtacagaaggctggttccacctttctggagctgtacaagatccaccagcctctacctcctgagtgctggaattaacagcatacatcaccactgcctggccaaaatctcttttaaaggaaacaaaaataaatcaattccttgtctcaaaggttgtaagcaaaggactccaagatacaggcagcagattacaaaggctgggggtttaggaggtgagaaccatcaagtcacaaattgagtgggcatggatgcattctggcttagctccaatcactagggcagatgagcaccggcaggttcctgacagaatgtccacccagcagcagggatcacgcatgctcccatccagacttcctgagaccactttccaaacggtatggggcatagcaagagacaagaccaagacaagtgcaaataatcacaggctggcactggcaggaacagaggttaaaagggcacagcaagcactgcatagcgcaaactcaccagcagtggtgaaggtggcacccctcccaagggacgctggacagtgtgggcagggaaggccacaaaacacataccaggcaggtgctacttcagccaggcaagcacctttggtcccttagaatgcttcacacctcaggccaaggccaggaaaacatctgacaaaactccaaagaagaactactgttgagtaccccaacacctcaagataatccaaaatctgaagtgtgtgggggaaaaaaaagaaaaaaaaaaaggtggccacagaaatcccggacttggtgatgggctggcattagggacagagcagcaactaaggttggtgagaagacactagcaagaattagcaggaaccatggacagctggatgcaggtgagagcatcaagcactcccttgtcacttcacccttgtgagttagaaagatggatcctttgatcagcagagaatattccagaactggcaaaagatcatgacctgtaactggaaacataacttccacacaggattcaaaaccgcacatcgtggagataaggtaaactgcagaacacagaaaaactttcacagatgggggggggggggatgaggaatccttttcaggaatgaccgtgaagccaccagaggggactttcagcaacctggaaagaatgcacaaaattaaagaactgaggtgacaaggtatttcagacagaccataataactcagttgggacaataggtggacttgaggtgacctgagacctctgtcatccaggacaaggagacaacagttcatttccggcttggacatctgtgttgctgtcccagaggagccgctgagagaacagaagcagcagtggccgtggatgcagcagcagggtagacctaggaggacctgagccagaggtttccatgtgatgtgtacactgaactctgtgatgtcactctaggaccaacgcatccctctgctcactgtttctatgaaaagccccacccccaccccagcattggctcaatgagcagctgtgctcttgacgggaaaagagagcatcagtgcgtgctcggagccccaccattgtggagagcgactgaccctgaaaattagtagcaattataaaacgtgaaggtggaaatgtccccaagtgcttgatctatgaccctgtacggcttgactttaatcctccttttctatgtacaaacgccagagtttaaaatgagggttggtggccagttgcagtggcacaagcttttaatcccagccttcgggggacagagacaggaggatctctggctctgagggcagcctggtgatctatgtggcgagttccaggacagccagggctatataggaagaccctgtctgaaaaaaaaacaaaacaaaaaaacaataaaacgacacagctgagaatctgagtatggctgctcccagagtcgcagacgtaagacacccaagggtgcatcccaggctggcctcacatttaccatgtagctgaggtggccctgactcctatttctacctcccaaatgctgagaagtccaggcctctcacctaactacagctttatttaaggaataagcactgtctggatggtggtggcacatgcctttagtcccaactcttgggaggcagaggcaggcagatctctgtgagtttgaggccagcctggtctacagagtctacatatgagatcctagctccaaaaataaattgagagaaagaaaccactgtgcatcccctgggaagtggtagctctggactcactgggagggtcctccgtggctttgagcttggaggtagcaggtccaatctgccctctaatggcacgaggggtaatggccattcttgctctctctggttcccactcaagtcctgaggcaaaaccctgctgtgtgcgagctcacagaggcagccctttgtgctgaggggttggtatgagttgttgtaaaactcagcttctgcaggccttgagtctggctaaaggcagcagcaaggagatccgagccttccccaaagcaggcctggcctacagatagaggtcaatcatgtccatgggaggctcgagcccaaaggaccagccacatgctctagcctaggtccccagggatgtgctgacactcagaacagagggccataggcatggagaacggaaggccctggcagagaccagaaaggacgaaggagcctcacatgccctcctccacagaaacatatccaggagccacccctcagcctttaggcaaggtggtctgactttagcaccaccttgggggaatgagttcttccaaggcagagctgggcacaaggaagtatcatcctgcgacctcaggcctgagaaaacagtcaccagcagctcccagcaccggtgaggaatggctgccacttcaaacagggtcctcatttgtaaccccaacctcatttgtaaccctacatacctcaagtatgtgggagctgaagagatggctcagtggttaagagcactgactgctcttctgaaggtcctgagttcaattcccagcaaccacatggtggctcacaaccatctgtaaagagacctgaccgccttcttctggagtgtctgaagacagctacaatgtacttacatgtgataaataataaaattaaaaaaaaaaaaaaaagaatgagtatgcatagggagatggtacaactggaataggacacaaaggggactggtccagcctgggctaccatattcttatagagcagacatctggccagcccgctggaaagttccaagaaggatcactccacgctcggcaacaggctgctagggatttacccaaagaagggaaagctgggagcttagagaagccgccagagggctgtttataaagacaggctctaaagatctaagctgtgggagaaccggtctcaagacgccaccaccctggccagactggctggcagcctgagcgcagccaggccgggcatgacaactgttcagaagacaaagccagggcattgagggtgagaggtgtcttgggttggaagagccacagcatgtgacctcaggggtgagctgctgccagcccagaggcccacacattaagtgtctggtaaaccctaagccaaggcaggttggagtgtcctgggacagcaagggttctagtctgtcaccggagagtgactgccaacatccacaatgagctcatggcatataccagcccacaagaatgtggccgctgggggtgggtggatatgggggacttttggtatagcattggaaatgtaaatgagttaaatacctaataaaaaatggaaaaaaaaaaaaaaaaagaatgtggccgcctcctgtcctggggccgttagatcagtgtctctgacatcacagactaggctgcagacaagcatccagcaacagcccagggccacacaggggctctgcacaccacctaacaaatgtagccaggggacagagcagcccaagagacccaggtccagcagagcctggattttcattccattctgtatgctaggcacagatggttcatttcacagactgtgttaatggtttagctgggggaatcacaagttatctctatacgtttaagggtaaaaatatccaataacttttcactgctttttacagcattttcctaggcctaggcctcgctgtgtaacagctgcccacagtactgaagcgttcccagctgcagctctccctggcccagtgagaggactgtgactcccaggtgcctgggatgagcagaaccaatgtatcacctgtcctgtgactgagtgctctcctctagtgtaacactctcaaagtgcactcaaagtggttccagttttgtgacccaaccatcccgtgtacacactcttaactagaagcctgggttgttcctacctcttgtcaacggtgaatgcaggtgtccagtccctgtctgagcttttattcctttgggcatctaccccaaaataggaatggggggtccaactgagtgttgagactttgggtccaccagaattttccacacggccacgccttttccatcctactgatacttagcaatcaccgtttcctactgatggccatatggaaggcaatctgtaaagttctggattcttcttagacttgtaggtgctgagtggtttgtaaaataaactctatcctgccaatgacgaacatttaagagtcaaggcaaaccccatgccctggccctgaccccgaagcatgctgggcacatctacagttgattcaggcatggagggagcttgatggcaaaagccagccctttgtgcccctctacctccccaagaaagtggtggcagctgacgcctcaccctctgcccctggggaaggacgtgcctgggtgggatggcaagtctgaacaagatgtttacctcagccgcctccctagagaccacggtgaggtctatgtccagtctggcctgtctgtcatcagcaaatgatgtggcccctgagaactggtctcggcagagtttgtagtgactgtgctggatttatgctggcagcttaacagtgtgacactaccggccggagatggccccaggtgagctgggtttaagctgtaaaacccagagaccacaggtgaggccagttaaggcccattttctccactcacaaaggtctacagggtggcgctccagggcctctctgggctcaggctcaagtccagtcagcttgccaacaacaggaagttgggcagagtgaaaatgctcattccgcagtccagggtcccaaacctcaaagtctgtggtgctgagaaccagggtctaagtgtgagggtagctagacagggcagaaactgaagctggttccgtgttcccaaggcaggctcagaaacaggtatgtggctaccacgggtcctgcggatggaccacacataccagaccccaacgcccagcagggactgagcagtggggagaagcccatgggaagggcggggctgtagatcccaccagtgaagattcgctgcaggcatcataccaatggtatctgttagggttttactaagaatgggcccccacaggctcgtgggggtggggtgtggttttgttttgttttcttccaagacagagtttctctgtgtagccccctggctgcctcgaactcagaaatccaccagcctctgcctcccatgtgctgggattaaaggtgtgcgccaccacggccggcccaggctcgtgtatttaatgctttagctcccggggaatggcactatttggaaggactgaatgggtgtagccttgttggaggaaacccatgctgggcccaagctcactctgcctatggatcaggatagagttcttcagaactgctggtctacacagcaagaaaaacataggataaataaatgagtcaagcctcacgaacctgcctgcgagccgcacactacctgccatgataatcatggactgaacctgactgtcagcaagcccccaattaaacacttgccatgctcacggtgtctcttcacaccaacagtggctgtgagtgtcagagcgctgtgccgggctctcgtgcttgcagagtcctaagccccagagtcagaggctgcagacagcattcagagcggctgccttcacactctaggtgggagcactgtcctcaccccaactatgacacactaaagcctcaaggtccctgtggccctcgtgcatgttaaaggacacccccactcaggttaccctggtctcctagaacaatgttcaagtggatagccacggggctcccaaaccacatggccactgtgctttcatctctgtttaaggcacactgaggggtggctggtgctgctggaatggaggggtcacactggcctaaaggctcccagtagcaatggaggacacggaggaaggggaggaatcccagcacactgaagggagagggggatccatctcgaccggtgggaattcagccagccatgaagacaggagggtggactgggttcaatttgtggctgaaggggtcttgccgtctctctcagcactgactggtcagtggggctcctggtgaggccaagccaggaaaagccccacccacatgctgcctagggagcctcagagatggcttgggacagctagcgtgcagaggctgaagctcacactggtacactttgcggagacctcgtccatttatcatgtatcttaggacaagtcttgctatgcagcccagcacatctcaactgtcatgcctctgcctctcaagtgcaggcttccagaacgtgtctccaccagacagaccaccctgtcccacttcttactgcgctgacagtgttctgattattcacaatgaatcaacctctcacattcctagcaccttgatctgcatcttgaaaggcatcacacgcgagatgcagatgcaggacggagggcgagtcgacctgctcccaggtgctgaggaataatgcaggcagatgctgaaggcatctcagtgaagagccaggctggttcatgtgacaggctcggggctcggccgcccagcacatgggagaagacagtatatttatatcaaactgtctaggcccacatggctgcctctgacaaggcgataaaaggaagagtctcaaagggtgtcatgtgccaccacactgaacagtttattaggtgagcctgtcctgtgtgtggccatcatctgctcctcagatctgcccactggggccaagtgctgctctgcagtccgtgaagcacggtacccgcatccggaccatcatgactatagggagtgtggcagggaggaccctgactcccaggaaccagattccctctggcaggaccacccaggtgcatgtgcccttaagaggatggctcagttctgtgtacccgtcataaagagaaaaaggcatcgtccactgggtacgtcagaaccatccataatggtgagtctgcagcttggaactcgctcagtcctcagcaaagcagacaggtagacaccagtcccgactactacttggaaacaggcagggagccctgctgtgagcacacttccgacagcatctgtcactctcggaacaccaggcgctgccactgtgccttcactgcatgccgaaccactgctcctggtctgcccactgggctgcctcactgtcgctgccctccaggtccccttcttccccactcccctccatgtcgtccacatcttcctcctgagtggcatccgtgggactctcctccttctccatcttctgcatcccctcgagagacttctggtcattggggtccaaactaaggaacaacaaaacagaggagaggctgagcctgccctgtttcttgggactgtcactgcgctggttcagcagtgagatgactaggtcagagatgctgcaaactgtggcgtccatggctggatccagggagtccatcagagacgaaacgggacattgttctacgttttacaatttttaaatgaaggggccggagaggtggctcagtgattaagagcatttgttgctgggttcagttcccagtacccatatggtgactcatgactgcctgtgactccagttcccaagtatctgatgccctcctctggcctctctgggcaccaggcacacacatgattcacagacatacatgcaggcaaaacactcatctacataaaatgtattttaataaacaattcatttaaaaaatggcaattaaagattctaacttcactagcactctgctggaggcagtggccagtcaggaaagagtagagggactaacaggaggcctggtgctcacagccaggcacagaacacagcccagcacatgcaggagggaaccaggatcagaacaccaaggccagcctcaggtacatgatgaatacatgcagcctgcctcaggcaagctgttcttccgggtgtgacactgtttcacattctaccatgaactgtgggtaactacagccatcagtcctgtacacaggtacacaggacagattctaagtcctgaggacagagccaggaccaaagcatcctcattagtagcaaccccacaaagcccagcgtcccagaatcctcactgatttggctcctaagaaatctttaaaagggaaaacaaggtcctggaaaggaatgctcaggcctcgcccacgccgggcaggagctccgcgccactgaagcaacttcaggatcacagcctctccctctgcccaggcagtcgggtcagcaagcgtccctcaggaaacttgctgcctggtttctcgtgccaggccatgctgcatcctgtcctatgcacagacacagtggagtctgtgacatctcttctttacccaaaccttccacaaaactctgcctacacagaggcttccaccctgtagcccggccctgcagactgcttggaggttctgagtactgagtgctcaaaagcactgcctcagctatctcctggacaagagaacggacgcacgcgacacctgatgaggacaactccttgcctaagacacactcgcaagtctcagagaatcacttctaactaagccacaccaatccctctacttattacctactgcataccaggtccagcaccaaaagcttcctactgaatacgctggatcctcgtccaaccatttatttatcttaaaaattaaatttattgggctggagacatggctcagcagttaagagtgctgactgctctcccagaggtcctgagttcaattcccagcaaccacatggtggctcacaaccatctgtaatgggatctgacgccctcttctggggtgtctgaagatagctacagtatattcatatatgaaaaaataaacaattctttaaaaattaacattaaaacttaactgtattgctattagcgcatgtgcacgcacacacgtacgtttgtctgtgtaatgtgtaagtcatggcatgcatgcgaggtcagagggaaaccgtggagtcagttctctcctgcaaccttcacaggggctctggggatccacttgggtctccagggttatgtggcaagcactattaccttctcaatctttttggtttttggtttttcgagacagaaatctctgtgtagccctggctgtcctggaactcactctgtagaccaggctggcctcgaactcagaaacctgcctgcctctgcctctgcctctcaagtgctgggattaaaggcgtgcaccaccactgcccggcacattctgaattttgatacccctaattaatgtccaatgaagaaggtatagacaaggaaactggttagtattttgaccaagatgacaggtaaaagctgtattcaaacttcagaatttaagtttttaattactatagtagacagaaacacaggaacatacttagcaatagattttaaaaagcagactgtaaaatctccactagacgtaaccctctgaagccatggggtgtgggcaagcacaggagagctgtacagtcagcctgggtgctgctcggatgtgggctggggaagaaggataactccgctaatgtgctttaggaaaatatgtcaggagtcatgaattcacaaacaccttctctcgttactattctcatcctgccttcaactgtggg

SEQ ID NO: 4 - DNA, 72713 bp, Mus musculus
cccacagttgaaggcaggatgagaatagtaacgagagaaggtgtttgtgaattcatgactcctgacatattttcctaaagcacattagcggagttatccttcttccccagcccacatccgagcagcacccaggctgactgtacagctctcctgtgcttgcccacaccccatggcttcagagggttacgtctagtggagattttacagtctgctttttaaaatctattgctaagtatgttcctgtgtttctgtctactatagtaattaaaaacttaaattctgaagtttgaatacagcttttacctgtcatcttggtcaaaatactaaccagtttccttgtctataccttcttcattggacattaattaggggtatcaaaattcagaatgtgccgggcagtggtggtgcacgcctttaatcccagcacttgagaggcagaggcagaggcaggcaggtttctgagttcgaggccagcctggtctacagagtgagttccaggacagccagggctacacagagatttctgtctcgaaaaaccaaaaaccaaaaagattgagaaggtaatagtgcttgccacataaccctggagacccaagtggatccccagagcccctgtgaaggttgcaggagagaactgactccacggtttccctctgacctcgcatgcatgccatgacttacacattacacagacaaacgtacgtgtgtgcgtgcacatgcgctaatagcaatacagttaagttttaatgttaatttttaaagaattgtttattttttcatatatgaatatactgtagctatcttcagacaccccagaagagggcgtcagatcccattacagatggttgtgagccaccatgtggttgctgggaattgaactcaggacctctgggagagcagtcagcactcttaactgctgagccatgtctccagcccaataaatttaatttttaagataaataaatggttggacgaggatccagcgtattcagtaggaagcttttggtgctggacctggtatgcagtaggtaataagtagagggattggtgtggcttagttagaagtgattctctgagacttgcgagtgtgtcttaggcaaggagttgtcctcatcaggtgtcgcgtgcgtccgttctcttgtccaggagatagctgaggcagtgcttttgagcactcagtactcagaacctccaagcagtctgcagggccgggctacagggtggaagcctctgtgtaggcagagttttgtggaaggtttgggtaaagaagagatgtcacagactccactgtgtctgtgcataggacaggatgcagcatggcctggcacgagaaaccaggcagcaagtttcctgagggacgcttgctgacccgactgcctgggcagagggagaggctgtgatcctgaagttgcttcagtggcgcggagctcctgcccggcgtgggcgaggcctgagcattcctttccaggaccttgttttcccttttaaagatttcttaggagccaaatcagtgaggattctgggacgctgggctttgtggggttgctactaatgaggatgctttggtcctggctctgtcctcaggacttagaatctgtcctgtgtacctgtgtacaggactgatggctgtagttacccacagttcatggtagaatgtgaaacagtgtcacacccggaagaacagcttgcctgaggcaggctgcatgtattcatcatgtacctgaggctggccttggtgttctgatcctggttccctcctgcatgtgctgggctgtgttctgtgcctggctgtgagcaccaggcctcctgttagtccctctactctttcctgactggccactgcctccagcagagtgctagtgaagttagaatctttaattgccattttttaaatgaattgtttattaaaatacattttatgtagatgagtgttttgcctgcatgtatgtctgtgaatcatgtgtgtgcctggtgcccagagaggccagaggagggcatcagatacttgggaactggagtcacaggcagtcatgagtcaccatatgggtactgggaactgaacccagcaacaaatgctcttaatcactgagccacctctccggccccttcatttaaaaattgtaaaacgtagaacaatgtcccgtttcgtctctgatggactccctggatccagccatggacgccacagtttgcagcatctctgacctagtcatctcactgctgaaccagcgcagtgacagtcccaagaaacagggcaggctcagcctctcctctgttttgttgttccttagtttggaccccaatgaccagaagtctctcgaggggatgcagaagatggagaaggaggagagtcccacggatgccactcaggaggaagatgtggacgacatggaggggagtggggaagaaggggacctggagggcagcgacagtgaggcagcccagtgggcagaccaggagcagtggttcggcatgcagtgaaggcacagtggcagcgcctggtgttccgagagtgacagatgctgtcggaagtgtgctcacagcagggctccctgcctgtttccaagtagtagtcgggactggtgtctacctgtctgctttgctgaggactgagcgagttccaagctgcagactcaccattatggatggttctgacgtacccagtggacgatgcctttttctctttatgacgggtacacagaactgagccatcctcttaagggcacatgcacctgggtggtcctgccagagggaatctggttcctgggagtcagggtcctccctgccacactccctatagtcatgatggtccggatgcgggtaccgtgcttcacggactgcagagcagcacttggccccagtgggcagatctgaggagcagatgatggccacacacaggacaggctcacctaataaactgttcagtgtggtggcacatgacaccctttgagactcttccttttatcgccttgtcagaggcagccatgtgggcctagacagtttgatataaatatactgtcttctcccatgtgctgggcggccgagccccgagcctgtcacatgaaccagcctggctcttcactgagatgccttcagcatctgcctgcattattcctcagcacctgggagcaggtcgactcgccctccgtcctgcatctgcatctcgcgtgtgatgcctttcaagatgcagatcaaggtgctaggaatgtgagaggttgattcattgtgaataatcagaacactgtcagcgcagtaagaagtgggacagggtggtctgtctggtggagacacgttctggaagcctgcacttgagaggcagaggcatgacagttgagatgtgctgggctgcatagcaagacttgtcctaagatacatgataaatggacgaggtctccgcaaagtgtaccagtgtgagcttcagcctctgcacgctagctgtcccaagccatctctgaggctccctaggcagcatgtgggtggggcttttcctggcttggcctcaccaggagccccactgaccagtcagtgctgagagagacggcaagaccccttcagccacaaattgaacccagtccaccctcctgtcttcatggctggctgaattcccaccggtcgagatggatccccctctcccttcagtgtgctgggattcctccccttcctccgtgtcctccattgctactgggagcctttaggccagtgtgacccctccattccagcagcaccagccacccctcagtgtgccttaaacagagatgaaagcacagtggccatgtggtttgggagccccgtggctatccacttgaacattgttctaggagaccagggtaacctgagtgggggtgtcctttaacatgcacgagggccacagggaccttgaggctttagtgtgtcatagttggggtgaggacagtgctcccacctagagtgtgaaggcagccgctctgaatgctgtctgcagcctctgactctggggcttaggactctgcaagcacgagagcccggcacagcgctctgacactcacagccactgttggtgtgaagagacaccgtgagcatggcaagtgtttaattgggggcttgctgacagtcaggttcagtccatgattatcatggcaggtagtgtgcggctcgcaggcaggttcgtgaggcttgactcatttatttatcctatgtttttcttgctgtgtagaccagcagttctgaagaactctatcctgatccataggcagagtgagcttgggcccagcatgggtttcctccaacaaggctacacccattcagtccttccaaatagtgccattccccgggagctaaagcattaaatacacgagcctgggccggccgtggtggcgcacacctttaatcccagcacatgggaggcagaggctggtggatttctgagttcgaggcagccagggggctacacagagaaactctgtcttggaagaaaacaaaacaaaaccacaccccacccccacgagcctgtgggggcccattcttagtaaaaccctaacagataccattggtatgatgcctgcagcgaatcttcactggtgggatctacagccccgcccttcccatgggcttctccccactgctcagtccctgctgggcgttggggtctggtatgtgtggtccatccgcaggacccgtggtagccacatacctgtttctgagcctgccttgggaacacggaaccagcttcagtttctgccctgtctagctaccctcacacttagaccctggttctcagcaccacagactttgaggtttgggaccctggactgcggaatgagcattttcactctgcccaacttcctgttgttggcaagctgactggacttgagcctgagcccagagaggccctggagcgccaccctgtagacctttgtgagtggagaaaatgggccttaactggcctcacctgtggtctctgggttttacagcttaaacccagctcacctggggccatctccggccggtagtgtcacactgttaagctgccagcataaatccagcacagtcactacaaactctgccgagaccagttctcaggggccacatcatttgctgatgacagacaggccagactggacatagacctcaccgtggtctctagggaggcggctgaggtaaacatcttgttcagacttgccatcccacccaggcacgtccttccccaggggcagagggtgaggcgtcagctgccaccactttcttggggaggtagaggggcacaaagggctggcttttgccatcaagctccctccatgcctgaatcaactgtagatgtgcccagcatgcttcggggtcagggccagggcatggggtttgccttgactcttaaatgttcgtcattggcaggatagagtttattttacaaaccactcagcacctacaagtctaagaagaatccagaactttacagattgccttccatatggccatcagtaggaaacggtgattgctaagtatcagtaggatggaaaaggcgtggccgtgtggaaaattctggtggacccaaagtctcaacactcagttggaccccccattcctattttggggtagatgcccaaaggaataaaagctcagacagggactggacacctgcattcaccgttgacaagaggtaggaacaacccaggcttctagttaagagtgtgtacacgggatggttgggtcacaaaactggaaccactttgagtgcactttgagagtgttacactagaggagagcactcagtcacaggacaggtgatacattggttctgctcatcccaggcacctgggagtcacagtcctctcactgggccagggagagctgcagctgggaacgcttcagtactgtgggcagctgttacacagcgaggcctaggcctaggaaaatgctgtaaaaagcagtgaaaagttattggatatttttacccttaaacgtatagagataacttgtgattcccccagctaaaccattaacacagtctgtgaaatgaaccatctgtgcctagcatacagaatggaatgaaaatccaggctctgctggacctgggtctcttgggctgctctgtcccctggctacatttgttaggtggtgtgcagagcccctgtgtggccctgggctgttgctggatgcttgtctgcagcctagtctgtgatgtcagagacactgatctaacggccccaggacaggaggcggccacattctttttttttttttttttccattttttattaggtatttaactcatttacatttccaatgctataccaaaagtcccccatatccacccacccccagcggccacattcttgtgggctggtatatgccatgagctcattgtggatgttggcagtcactctccggtgacagactagaacccttgctgtcccaggacactccaacctgccttggcttagggtttaccagacacttaatgtgtgggcctctgggctggcagcagctcacccctgaggtcacatgctgtggctcttccaacccaagacacctctcaccctcaatgccctggctttgtcttctgaacagttgtcatgcccggcctggctgcgctcaggctgccagccagtctggccagggtggtggcgtcttgagaccggttctcccacagcttagatctttagagcctgtctttataaacagccctctggcggcttctctaagctcccagctttcccttctttgggtaaatccctagcagcctgttgccgagcgtggagtgatccttcttggaactttccagcgggctggccagatgtctgctctataagaatatggtagcccaggctggaccagtcccctttgtgtcctattccagttgtaccatctccctatgcatactcattcttttttttttttttttaattttattatttatcacatgtaagtacattgtagctgtcttcagacactccagaagaaggcggtcaggtctctttacagatggttgtgagccaccatgtggttgctgggaattgaactcaggaccttcagaagagcagtcagtgctcttaaccactgagccatctcttcagctcccacatacttgaggtatgtagggttacaaatgaggttggggttacaaatgaggaccctgtttgaagtggcagccattcctcaccggtgctgggagctgctggtgactgttttctcaggcctgaggtcgcaggatgatacttccttgtgcccagctctgccttggaagaactcattcccccaaggtggtgctaaagtcagaccaccttgcctaaaggctgaggggtggctcctggatatgtttctgtggaggagggcatgtgaggctccttcgtcctttctggtctctgccagggccttccgttctccatgcctatggccctctgttctgagtgtcagcacatccctggggacctaggctagagcatgtggctggtcctttgggctcgagcctcccatggacatgattgacctctatctgtaggccaggcctgctttggggaaggctcggatctccttgctgctgcctttagccagactcaaggcctgcagaagctgagttttacaacaactcataccaacccctcagcacaaagggctgcctctgtgagctcgcacacagcagggttttgcctcaggacttgagtgggaaccagagagagcaagaatggccattacccctcgtgccattagagggcagattggacctgctacctccaagctcaaagccacggaggaccctcccagtgagtccagagctaccacttcccaggggatgcacagtggtttctttctctcaatttatttttggagctaggatctcatatgtagactctgtagaccaggctggcctcaaactcacagagatctgcctgcctctgcctcccaagagttgggactaaaggcatgtgccaccaccatccagacagtgcttattccttaaataaagctgtagttaggtgagaggcctggacttctcagcatttgggaggtagaaataggagtcagggccacctcagctacatggtaaatgtgaggccagcctgggatgcacccttgggtgtcttacgtctgcgactctgggagcagccatactcagattctcagctgtgtcgttttattgtttttttgttttgtttttttttcagacagggtcttcctatatagccctggctgtcctggaactcgccacatagatcaccaggctgccctcagagccagagatcctcctgtctctgtcccccgaaggctgggattaaaagcttgtgccactgcaactggccaccaaccctcattttaaactctggcgtttgtacatagaaaaggaggattaaagtcaagccgtacagggtcatagatcaagcacttggggacatttccaccttcacgttttataattgctactaattttcagggtcagtcgctctccacaatggtggggctccgagcacgcactgatgctctcttttcccgtcaagagcacagctgctcattgagccaatgctggggtgggggtggggcttttcatagaaacagtgagcagagggatgcgttggtcctagagtgacatcacagagttcagtgtacacatcacatggaaacctctggctcaggtcctcctaggtctaccctgctgctgcatccacggccactgctgcttctgttctctcagcggctcctctgggacagcaacacagatgtccaagccggaaatgaactgttgtctccttgtcctggatgacagaggtctcaggtcacctcaagtccacctattgtcccaactgagttattatggtctgtctgaaataccttgtcacctcagttctttaattttgtgcattctttccaggttgctgaaagtcccctctggtggcttcacggtcattcctgaaaaggattcctcatcccccccccccccatctgtgaaagtttttctgtgttctgcagtttaccttatctccacgatgtgcggttttgaatcctgtgtggaagttatgtttccagttacaggtcatgatcttttgccagttctggaatattctctgctgatcaaaggatccatctttctaactcacaagggtgaagtgacaagggagtgcttgatgctctcacctgcatccagctgtccatggttcctgctaattcttgctagtgtcttctcaccaaccttagttgctgctctgtccctaatgccagcccatcaccaagtccgggatttctgtggccacctttttttttttcttttttttcccccacacacttcagattttggattatcttgaggtgttggggtactcaacagtagttcttctttggagttttgtcagatgttttcctggccttggcctgaggtgtgaagcattctaagggaccaaaggtgcttgcctggctgaagtagcacctgcctggtatgtgttttgtggccttccctgcccacactgtccagcgtcccttgggaggggtgccaccttcaccactgctggtgagtttgcgctatgcagtgcttgctgtgcccttttaacctctgttcctgccagtgccagcctgtgattatttgcacttgtcttggtcttgtctcttgctatgccccataccgtttggaaagtggtctcaggaagtctggatgggagcatgcgtgatccctgctgctgggtggacattctgtcaggaacctgccggtgctcatctgccctagtgattggagctaagccagaatgcatccatgcccactcaatttgtgacttgatggttctcacctcctaaacccccagcctttgtaatctgctgcctgtatcttggagtcctttgcttacaacctttgagacaaggaattgatttatttttgtttcctttaaaagagattttggccaggcagtggtgatgtatgctgttaattccagcactcaggaggtagaggctggtggatcttgtacagctccagaaaggtggaaccagccttctgtacggagctattttgggcagaatgcgcatcactcacttcgattttttccatggtttggatattctaatcagtgtgttcccaacctgtagactttgacccatgaggggtgttgaatgactctttgacaggagtcttttaagactgccctgcatatcagatatttgttacactaggaaaatcagtttatgaacaacagtaacattaatttcatggttggggtcaccacacgagcaactatgataaaagcgtcccagcatcagaacgactgagaacctgctctggatcttgtttattggtagcagccattatttccagtctttgtaatagtgaagtgggaagccaggcatggcgggcccacttgggaggaggtggaggcagcaggaacagttgaagggcaggttcagctatatgctgtttgggccacagcctgggccatgaggctctacctaaaaaactaaaatggattcttcttgtctggacatatttgggaactgcagcgtgttgttgggttgggcccttaaaaatagatctgaagctaggcatgatgcaggcctttaattccagcacttgggaggcaggaacagcttttgagatttagaccacggcatgagacttaaaaaagtggagtctggggatagacaacctcctccagagtggtgagagcgcatatccatccctacaatgccattagagggtacttctctgctcagttacaagaaatctgtttacttgactctggagtgtaatcacctgtcttctggctaggattgttgtcttcttccgtcattcccccctccccctcagtttcaggtcttgccaagaaaggcaaagtttcctccttgtatttaaaaagacaaggatgtgagaggctccatggtgaggccttgactagcacacccactgttgagggcctagtgctgtgtcacgggtgctgggtctgtactgaccctcaatgctgactcctgcttcacgctccgaggcttcttacagctacacactcgatagttttgcttctctactgcaaaccgtgctgtagccctgtgaggcctagagtggacctgctaggtcacgaagggctttggacttaggtgacacccagttgttctccagggggcactgggctcccaccagccatggaaaacgcacagcttacacaggacagcatcctgcgctcatgactttctcttccaaagtgtagacattaaaaccctttaatccatttgcactagattgggcctaaagatatagaagtgtttctgccaagcacaagggctcaagtggccttcagacctcctgcttggcatacttcatgtccatgaaaaacaagcctattagattaaaagaattgtgttgacatctggtcttagaagttactaaaggttgctaagaacaggatgtctgctgggcggctgtggtgcgtacatacacctcgcagcacttgggaggcagagacagagttccaggccagcctggtctttattccttctgagaaatttcttcgttgaatatgagctgaagtgttggggacagtgatcctgtaattctgaaatgttaggaataactcgagttgtttattctgaaaggggcaggagtggaggtcagaggacaagtttgtggatggagctggttctcccatgggttctaggagtcaagcccaggactccagactcatcttaagggaaaggcctttacctgctgagccatcttggccctggatgctgtcaaaaagctgtcctattacaggagctgacaggactcatttgaagcttatctctgccaagtaaggccagaatagcagtttaagggagaattcaggatcctttcaggtctacttctgtctcccgtcacagtcactttgcatctgaacagtcacacaactcccgaggctagtcacgtgtagacttctagtctgagctgaaaaggcctgatttctgctgaaggtcactgtgacacgcattctgcttccctccaggttaactacaaaaccagtctcccagggaggcctcagtgcccgtccccaccctcctgtaaatcagccacagctctgctgagggtttatcgtagaatagatttatttacctgaaatcatgtctgtgcaatacctgttaccagcacagaaactgacctctatttacagactacagtcaaacatgcgctgtgagaagctgtgagcaactgaactgacgctgagcactttattacgataaatgcacacaatacttgtattgcaccaacatctgtctactgcttctgacttcattaaataagttacaataatacagtgtggaacagctggctgcacacctaaacaactgaagttaggactggaggcctatgttgtaaccattcagcagctgtagtgttttaaatgaatttataaataagcaaactgtacagggcccattagaaagcatgtttcaatgtcactgtagagcaatctggccacttacaactgaaggcatgcattacaattatcatacagttagagaggctatgacattttgcagagaaatgtggagacttggctgatggcttctgttcttggataaggtttcagaacctccttctcgcagcaaagaaaccaacttctctggagaggctctctgatttgttatgctaaattgtacatttgttattattttgattgaacagctaaaaccccactggtaatacacatttcctccacatcacacagtgagttggggactgtttctatttttcttttccccaacctcagtcatgcagagggctggtagatgtgttgctaacaacgcacatgcacgcacccgaacacccttatatttctgcaaatggtttaggaagcggttactccagtattgctgaaaaggaaagagagaggaaatcagcttttcgaaacgtagagcaatgttaagacacaacaacagggacagacagaaagaacactgcatttggtctagatgcaaaaccagcatttctgacggagtgttccaagtgcttgctgcccaggcacatctagaagcagtggcttggtgactgccctgggccgcctcctaccaaagttccaggaggcagaaactagaaggcatgtcaggtacagggctgagagccatgcagagggtgaggcaggtggagcagtgagtggcatggcaccaggggagaggccttcctgtccctccctgttctctatggcagccagtcctgggctacaggctcagctctgctttgaaggtttcccaattgcaggggtcagtcctaatggagtttggcagctcacgacaaagggcaaccatgctttttggctctgcggctctgcaggcaccgagccaatgctgccatcttagatgttcctgaggcctgtgccattgttggggctgagaccctattttgagggtgctgtgatagcagctgctgtgagatggctagccttctccagccttagtagccctgctagctctccggggaggccaccacctgaattttgctgagtgggctgcagggtggaacctttagacagctttgctgaagaggccattccgggaaagttcaaggctggggtccaggctagactgccctagtgggttgagcatgatgctgacacaataaatgctgtcccttcttgagggtgctgggtgagagcagggctgaggacatgcaggaggtggcctgtggctgggactgtgctgttggccttggtctatgcgggccaggggaaggttttgtcagccttgcttgtggctggatgggtcaagtgttagtctatctgttggggttgaacaggtcccagtaagcaacacagcactcagggatgaggtccatttcctttagggcccactcattcgtaaacggcactgaacagcatggtgttagggcccagcacgctatcattctgatttggtctttaactcagctgtacctttgtgtttggcccactccatcaaaacctgcctgcttcctgagaatcactgctccctgtagcacacagaggcctccccaaggaagggtcagtgccaggttccctcagaacctggcactttctcctgcaacttagggaggaggtcgcagtctccaggcctctgcacaccagagggttgagacatgtcctgaagggtgacaaaagctgcctatgcggagtcagctggctttcctagtcttcctcagccactgaaaacccatagccttgtgacatggtttgtgtccagtctcagtttggtactagaggtgacacagctccttcagcctgaagtcagccaggtcccaaggctctccttcccacagctcatagggatcgctgtcctggtcagtgtctacactagggtagcctgtgtagtgagtggctgcctggtggacacaggagccatgcagctcactagcaacaggggccagctcatcagtggcaccacctgtacacaggccacagcaccccagtcccacagggaagatactcacgttagttgatggatgttggaaggcattggaggaaaacaccacagttaggactgttaatgactcacactgccgttaagactgaccttgaacatgcgcaaacgttcatcagtcatggtggtggtggttagtgccatagtcaaataaaaatatttctatacaatatgttcatttggtcatgtgctatttacagattttacaaaacatacacacacataaacacacacttgcccttacaccaacctacatacaacgggccagcagaaacttgagtaatgtatatcacatgacagatcgtgcctatacattataaataaaatcctactatgcggcagaacaggactcttctcagaacaggaaactaaggctctaagctgagaagctcagaaatttgaactgattatacgtaattcaaggccattaagaacaagacagttatttttctctgtccatttaaaatgttttatttttcttttaaactagattgtgaagtgccattgaataggcaatgttggcaaaacaatgtctgttacaataaaatacattagacatttaaataaataaccttaaaaactaggcgaagggacagaaacccagtcgattggatctggagcaatgttttctgcacaagcgagacaggcaaacctctcgtgaagacggatgtaaacagaaccatcagacctacagaagaagccgagcaggctggggtgggctgggggtgacagaggctgagggtgcaggaagtggcaaaccaaaaatactgactgaggtagcaggactctgctcagtgcagaaaaattggcttatgaataaaaattagactgtgataccaaattaaatccagagaatcatgcaaaagacacaatacatgctatttagttttttttcttttaaaaaccacacacattcatttcctaagtctgctgccaattaatttgctgacaatgtctgctggctcaactatctttgtacaagtatgagtattaaacagaacactgtacatgctttttcatctacaaaaaaatatctgcataaaatagtgttagttctctgtacacgtcaatggacactttaattatgtgtataaaaaaaggaaaatcttgtcccactggagtcagaaaaagcaaaacaaaatctagatatgaaacctccttcaccagccaatatgttcatgtgaaaattcagcagaaatagacagttgctttaaacaataaaaaattaattgattaagttaaacatcttctgtatgtagcgctgtcagtcaagaccagaacatatcgctaaagttagtgtctgtgctgtagacccagaccaccaggggcataatgagcagcacaaacggccaggaaatgccatcggtgcatgccgacagggagcaggaagatttggtggcaggctgcacacactctttaccgggttgttccaggtagtttcgggccacaaacttgagcgtctcatccatgaggatcacaggcaaggagattttcagcaccatcagccactgggtcagattcagcggtgtgatctggaaaatgagctgagacaaacaaggctgggtcaagcttctggccctgcctgaaaggaactaccccagaccccgcccggggtccatcatgactcaccggcaaaggttccacgtagaggatcaagaagtgaagtgacatggacaagcagatggagcccacgagccagatattctcccaggggggcatcctcagcaaagactggttttcagacaagctacaggtgagaagagaagtgacctcaccagaggcaaaggcatgcgtcagtgacacacaagcaggcaagggtttagtgatgctactgcctgctgacctaactaactctaaaggcctgctttccccagtgcggggagctggaggctttggtgcagcaggcccatctcagcaggctcaaagctgctggtgatgacccaaggtagagccatttggaaacttgtgtccatcagtggcttggttagatggaacttcttgtgctccactctctagggtacaggcatagtctggattgctggtcccattcatacaccctgccgcatcaggaacccatgatggggacaacccccactgtttcctggggaacaatagcttaaaactatgtcattttttgtgagggaagagctatcagccatgattttctcataaaccctaggaccatagcctacaagatccactaacctgttgagggcattacacatctctatggttactagaacagaaagtgccattgtcattggatatggggactcaaagattgcacaatccactccatcgaagtctgggttgtcctccttacactgtaggaaatgactctgcaacaaagtccaaacattccatcagccgggagtacttcccaaatgtagatgccaattccacactgagttcaaggcccaacaccaatacggaatacagctcggcagaagccctgggtcttagagctacctgaggcaactatctgaccccaaaccacagaaaaagaccaaaggttacaagaattcactctactacacagggctttaaaaaaaagtggctaaataccagctggtagaaggagactcttggaccgccgtcagcagcgatgaaccaccatgcagcagcacccacggtggcagcgccaacataacctagaaacaaagctgcaggttaccacactggccagagcagctgactacagacagggcgtttctggtctaaaaaggaaataggcaatgtctctagagtttgtgaggaaatgttcctgctgaccccagcccacgccctgcactaggtgccacagagctaaagagcaagtataggcttcagacaacaggtggaggtcaggcccatccatcccagcagacagaacacacaaggaactgaggaaaccaagtcacaccagtctataggcaaacggaggtgaccttgttggacactaggtaactgcactgttccaggtatggccaagcagaaccctttcaaagaactgccattacaatgctggcccccacccctcagcaccagagttaggtctaaggcagaggccattcctcatcaatttcaggaaatttgcaaagctgagactggtttatccacggtcaatcacctaaccaacagcagagcacacagctaacctggaattacagtggtgcacgagggcactagtttaaaagacagggaatggaaatttttatttgcccaaagggcagctggtccacgagatactgtgaaggccagaggaactggcagccactctagattgtatgctctttaaactgaactatgacaaagaacggcattagcctctgctagtggactcttcttgtcccctagttggtaataacccattcaagtctcagcctggcgctcgcaacagggaagggctctggcatgccttggtatttgcatcactctgagcaaggggaaaatataaaaagcctgatgtctaactgttgcttctctataacccaaggaaggacaggatgcttgttcaacagaggctttcagtgggtgacctgcactgcacacagcatccttccacacaaacaacaactgtacttacagccaatagccaggtaacggaaaaagagccacccgctgatcagtggttcttttgggttccgggggggtttgttcatgatgtccaggtctggaggattgaaccccagcgcagtggcaggcagaccatctgtcaccagattgacccagagtaactggacaggaattaaagcctcaggaaacccaagggctgccgtcaggaagatactgtttccatccaagggaagaagagaaaaaactcagtgagttttggaactatggaaatagcttatctccccaagccaggagcatcagacaacatctaatctaagttcatatgaaactttattagaggaccaagacttttatgattttaaactaccattttaagaatattttctgcaccactggtcagctgcagacaagtcccatgagatttctctcctctcaagccaacaaccaaatttgtcctaacagaagcagcaatctgagaaagctcaacaccctggccccagccttgaaagatactgtttagttccagtcagacacccaccagaccacttcccccacgttggatgagatgaggtagcggatgaactgcttcatgttgttgtagatggctcgcccctcctcaacagcagccacaatggtggagaagttgtcatctgccaggaccatctcagaagcagtcttagccactgcagtccctgagcccatggcaatcccgatttcagatttcttcagagcaggagcatcattcacaccatcaccagtctgaaagggaaggtgcagttgattcagataccacccatgtggcacagctctaggcagaggcactgatgcaggaggaaacgggacagagcagtagctgtgtcaaatactttaccaagaaaatacaaaaacagccatgcaagcttaaagagtcatatcacagaaaggtagaactaaggagactggacatctgcttatattgccttataccaacactcaaaacctgagagccatttgtggtggggccacataatttaaggtcatttacacacctcagacacataatcacactaagtattgcttacaggttaagaacatgcctttttcatttggttttgtttttaggcacaagatctcactaggtagcacaggcttgcctcagtctaagtgccaggattataggcacacgtacactgttgtgtcgtgtaagtctagctaaaatcttaccatagctgtgatctcatcaaaggactgaaggaactcaacaatcttagacttgtgggaaggttcaactcgagcaaaacagcgggcatttaagcaggcatctctctgggctgaagggcttaattcatcaaactctcgccctgtaaaagcctttgatgtcacatcctcatcctgcccaaagatgccaatgcggcgacagatggccacagcggtgcctttgttgtctccagtgatcatgatgacccggatgcctgcttgccggcacagcttcacagaagaggctacttcaatcctgggaggatccagcatgcccacacagccgacgaaagtcaggttggtctaaagtgagagagccacatgagctcaaacagcttacccctacccgagtgtcctggcagctcactcttgctacaactgtgagtttgtcattttctctttctgcttgcccttggttcaaacaaggttttcctagctacagtcctgaaacctgtagtgtagcagcattctgcttccatgtgtttctatgtctggcctgtattatggaatttgagagattgaccacaggaacagaacaaagtgttaaagaatgaacactcagaggctggcagtgtcagtgccacagcaaagctgtcccttctgtttagtagcttccatccctgatataaaattctggtctaaggaagaagtggaaatgaaatctctcagccttttaccaatacttaattttttttaaatatccattagtaacttggtttccattaggctttgacaggcttgtctgaacttgttttgattattctactttgaaaccagatttactaaatccttaactatttctgttggaagcagcaatctaaacaagggtgactcctgtggctcctctggcagcagaggctggacagtggctgtgcgggtgaggtggaggtacctcgtatttgatgaagttagcagagtcttccaggtgcatctcctctctcttcagtgggttgtcatgagtggccagagccaggcaccgtagcgtgtcgctgccactgccccactcccgaatgacagacataatcttctgtttgacaccaggagtcatggggaccttggtacttccaactcggatgtgggtgcacctatcgatgacaccttctggagccccctgagaatgtgagactcagattagcaactgccctgcccgtctccctggtaggaaagcctcagtctgcacagcacttgccttcacaaacatcttgctcatggatgtccggcttggcttgtttggggtacaatagacggacattgattttctatcccgtgaaaactccagagtgaactccttcttcatcagctgctttatgacctgtggggggatcagagaggagacattttatacctgctcagatacgcattagaccttcattaaatgatagagcctgcccctgtttagatatcttcatcacactggtctttttggcagcctcaacagcggtgaacaagatagcaagcacctacacaaaagtgttctctggtttggaagtagattagaatgtaaaactaagatatactgaaggccataggggacaaaaatttgtgcaggacaaccacggaaagctttaaacattggctattgagaactgatagcacagccgggcgcggtggcactcgggaggcagaggcaggcagatatctgagttcgaggccagcctggtctacagagtgagttccaggacagccagggctgcacagagaaaccctgtctcaaacaaaacaaaacaaaacaccaaaaagcaaaagaacccaaaaaacaaaaaaatctgtgtagagagctggtgtggtgctgcatgcgcataatcctagcactgggaggccaaagcaggaggatagataccaagttcaagagttgccccagctacatagtgaatttcttaaaggcagacatgtaacacatgtcatacagtgccagttagctgactactccaatggcacagggtgtgggtccagagtgcgttctccaaaaccttgtagtcacactgttctgtcagtgagggtcactaaatgtgttctgtgggtgcagcaagagaacagtcttccgtgttacagagagcttggctatgacccaccagactctgaaccgtcaaagtattcaaaggctgcatgggagtggctagacacaaaaatggccagagattgggaatgaccatctacttcctggtaggctaggggagatcagatacccaagagagatgccacgcctggggacacagaacttcaatgagggagcagaggagcaagtgtttttttcaagcactcagtggtctcccgctgactgacactccgactaccgtatcctgtctgtacatcatttcttacctacctgagcaggataaagcttgtgcatgtcaggcaaatacattaccattgagcaacttcctcacccttacggaaggttctaagccaagcagagtgacaggtagaatcgatctgtctatagagacaataactaggtggcaaatatctgtcagcagccacaaaactgttttattcaacttcagactggctaatctcatgaagctattgcaagctgaagaggaggaagagtgtggaaagatagctgtagtatgatggtctggaggtgcacagcagcggttcctggacaggcaggattgcccatgctgatgctagcttatggctatgctcaagactcaaggtgatttgccgggcatggtggcgcacacctttaatcccagcactcgggaggcagaggcaggcagatttccgagttcaaggccagcctggtctacaaagtgagttccaggacagccagggctatacagagaaacgctgtctagatccacccccacaaagtgtaggtgattcaatattcacagctacttcctgtatcccccaccactgccccactgaatgacctttgccattaggattatgcagatcattattagattattattttataatgctctaattaagcattaaaatatccttatgtcattgttgaaagttatgagatgacccatcaactttttaactttttagctgttaggtgactgatagattgtaactgcttgaggtgtgtgtgtgtgtgtgtgtgtttgtgtgtgtgtgtgctgtgcttccttaaacacatgctgagttataattgtaatcctatagtcattagttttcagtttttaacattctctcaactgaaaattgtagcattaatttctaactctatatcaactctgtgagatgactaaatagcccaggttaggttggccatgaacttaagagcctcccaacctggggttttaagtacctgagtgcctttcctggttggccatgaaatatcctgatagtggcaacataagaggagggagtttatctgttgcaagtcacagcctatctggcaagaacttgagagaattaaccacagtacacctgcagtcaagagcaaagagctagtgtatatacactagtccttagtagccccttctaccagggtagttcagaattcttcccatttcaattaactcaagggaatcccttaaaggccaatgtagacaactcttcactgacatttcctttccagtgatggcaggctgtgtcctggtaacaagcaatgctaaccacaggcctgctgctggccttgcccatccacaaaatacacactctaaaaacaaatccatagagaacttgatagttatcaacacacttcaatatcatcagggttagctggctgactttttaaaaacatagtctgcatgattaattgatgagccttgcttcatggaacagcagcattttctattttgagtcatctgtatgcatttgaaaatactaaaagaacccccagcctcaactaaaaaataggaaagaaaaagaaaaacgggtgggtgtggtggttagggttaggaggtagaagcaggcatatttcttgagttctagacagccaagtctacagagcaacttgcaggacagcctgggctacactgagaaataaggtcttggaagaacagaacaggaaaaacaaaacaaaacaaacaaaacaaaaaaacaaaaccaaactaacaaacaagttttggtgattgttgttcaaatgttgttttccatctcagtagtcattaggttgatttctgggatacatcagaaccctcattttctagctttctttttcatttctcaaaataattatttagtgctaattttttatgacctttggtgttttgcctgaatgcatgcatgtgtgaaaatgtcagatccctgggaaacgaaccttggctggtcctctgagagagcagtcagtacttttaaccactgagctgtctctccgagacacaccattttaatttggcatgcacacctgcacctcatgtatgcttggtgcatggaaggcaggagagggcaccctctgaccgtctgacaggagaaacagacagttcttaggtgccggggtggggtgaggagggagtcaaatccaggcccttaaaacttctaaccatggagccatctccaggtccaaaatccacaactgctgacttgtctattttgttacatttaacagttataaacaaattaaccactggattcagcacaaagttataagtgatccaaaagaggttttgatggactgataggtggaggcaagagcctgactggaatggatttgagaaaacagaaatgaaacaagctgggcatggtggcgcacgcctttaatcccagcacttgggaggcagaggcaggcggatttgtgagttcgaggccagccgggtctacaaagtgagttccaggacagccagaaaccctgtctggaaaaaccaaccaactaaccaaacaaaaagaaaaaagtgagaatgaacactcaacagtttttttcacccgagttaaacaaatggggtgtcaaatgacaattagggcaagggacagctctaatgttaaaagcatacaattattttctttatgctactggagaggcacagagaaagacactgagatgcaggcaggagggctgggtattctcaggactagggatagctcccttggtagagcccttatgatacacctatgtcaaggtactaatgattgctgggctatttttgttttgttttggtccgttttttaaaatgtgatttggtcgtctgtctaatgagttctgttctacaatttgtggcaattctcctggtatttgcatcgtgagctctagaaatataggcatgagagaccatcgtacctgactgtgaccatcaggaaactaatgccgaagaacaacagttaaaccaacagtgtaatgaagaagagcagcatactgtgctgagctcaatactgaccgagttgcaggcgtttgcacgctctattttagaaagccccttcagctcagtatcaaatacattcatcttctccaccaggcacgtgagagcagtctcggtagcttctccaactttctcatacacaccctttgcctgcattgtcaaaagaagtcaatgtcagcagaatagcttgtcctccccggttcatgtgagaaaagacggtgtaaccatgagacaccaaacccagatattaagatgtttattcatttaaagtccttgaccatttcaggtcactgtttattattctaatgacctttgaaaaagaaagcaaatcaataaccccactatttaacttgtaaaaggttctcttggttatcactcttcactacaccaccaaaacaaccctttcagctccagactgtgctcgaggatacatggcaattggtgtttaaaagtacagtcctggggctggagacatggctcagcggttaagagcactggctgctcttccaaaggttctgagttcaaatcccagcgaccacgtggtggctcacaaccatctgtaatgggaggatccgttgcccttttctggtgttgtctgaagagagtgacagtgtactcacatacataaataaatcttaaaaaaaaaaaaaaagtacagtcctcaccctcactctcagaaagacttgtagctggaactctggtcctttaaagggtgcatcagtggtcagaacatcatgacaactatgtatcttagtaaaacaagctgtagtgcccagctgcaggtctgtgaagggcacctggccttttttcagccaggccacgggactagaaatcagaaataaaattccactcaccctacccttgagccagcatcagaacattacaaggagtcttacctcattataatccaaagcagagtcattacacagagcacagatggtggctaactctacaagcccgtcatactgatggcacttcactggcttatcatccttttgcctataaaaagagaaaaacatttctagatcacagctttactcaactttagttttaaaacaaacaaacaaacaaacaaacaaacaaacagaacctaaacagaagctgtatgccacaatgcggcacatatgtacagaggaggtcagaggacaaattgtggaaggtcctcctctccttcaccactaagggtcgtgagatggactcccattgctgcacacacagagaaagtgctttttacactctacctcccatttgttgaaaactagaactcactttctattccagcatggccctgaacttccgtaggcatgtgacagccccctgtccccaaggatgaaaatggagtttgggaagaacaaattggaatagactcaaaaaaaatttgaatgaccagaaattttcatcaaaacccaacagtgtaccagtaagtgaagaacaaaacaaagccttcaccagcaagtctaggcttcaaaaggtattattaattaaaaaccactaacttgagccagtcagccatctagcaacagtttcttttgtgtgagtctaagagagagcacacaagagacagtttctctcggagtccaggctggctacgatcttgtgacctgccacagtgtcactatgcacatcctgctgtttgtttattcagagcttctggggatcacagcaaggcatatcttaggtccatcactaagtcagacctctgtcaacagcaacagtttctagacccatccctcatggtctaaccagaagtcaccatagtgacagagcttactcacacttctccaattggtgcatatgtggatccagttatgctgaactcattaagggaacaagtgtcaccttctactttgtccagaatgaacatctacaaggaaacacaaaacaaaagttttatgtaagatatacacaaaagaattccttgtctacagtgaaaaatcctgtcatttcagaaggtggtttgtgctaggtggtagtggtgcaggcctttaatcatatcattcaggcggcagaagcaggtagacctctgtgtgagtttgaggccagcctgatttacaaagttccaggacatctaaagctacacagagaaaccctgcctccaaaaaacaaaaaaggaagtctgaacaatgctcaaccaggttccccctcacagcaatgctctatcaacagctcagagagccttcaacctaactgtctaaacagtgatgtagtctaagataacccaagcaaaaatagggggattcttagtcagcaaatcaccaatgattgtttttaatgctcagaattctacatcaagtagcccagagattttcattctattgttttactttaaaaacaggcataagaagaagaaactcatagttcagagtcaaaacactcaagtaaagtaggcagagctgctgtagaatacctgggcccctcttcctaaccaggctccaatcagtgtctatcagtcctggagctgcttgcttgccatcgccctctacctccttttgggagtcaggatttcactgtgtagctggcctcaaactcagagatgatgtgtgcttcttcagcttgagttttgggattaaaagtatgtgccactacatgggtgtgcgtgctcattttatagaaaaatcataggaaaaataggttcactcaagattacacaaatcactaagttaaacagcaaagcctgagttagtagcctatcttttctgtgggaaaaaaaaaaacctaccttgacctttcattgaaaatgtgaccctcaccaccacttaaaagtctattgttccagcctcaaatatgccatatgcatatgcctgtaacaattagcttctcaattcttctgttttcttctttaaatccgatagataatgtctcattcaacctgggctagcctcaaactttctgtgtagtcaagaacaatcctgacgtctgatcttgctgcctcgcctgcaggactgtgactgatcacgtgtgggtcactgtgctcagtttcagttcttactgagcacattaaaaggtttcttattttacttcaaacgacattctaacaagagaagaaagcagaaaatgccaacttataagcaagtatctgctcatatgtgtcagagagaaaccgtgtttcatttagcgtgctatggaaatggcaactgacttcagcaggaggtttaactagttgcttcctctggacacacatgtagagaaagaggatgaaacctccagttacttctttaataaaaatctataagctttacagctattctgtatttcccaaggcagtgggggattattaatttttaccacgtatttgtgtgtgtcggaactacatgcagaggtcagaggataactttgaggagcattttctctcctccaccacgtgggatgaccacccacagactgcaggcaagaatcacagagaacgccccttactcaccctgcacacggacatctggtttgtggtaagtgtgcctgtcttatctgagcagataacagaagtacaaccaagggtctccacagaaggcagacttcgaacgatagcatttttctttgccatcctacgagttccaagagctaagcaggtggtgatgacagcaggcagaccctcagggattgcggcaacagccagggccacggcaatcttaaagtagtagatggcacccctgatccaggagccaccatgaactgggtcattgaaatgcccaatgttgatgatccagactgcaatgcaaatgagggagataactttggaaagctgctccccaaactcgtctagcttctgctgtaggggtgttctctcctgttctgttgccaccatttcatcccggatcttgccgatctcagtattaactccagttgccaccaccactcccatagctttcccagcagcaatgtttgtaccctagggagaagaggaaaatgggtcatgagggcaccagcacatcccaccttaaatcctgatgtggatactgcctggactccacagagcacctgctcactccctgggacaggacggctctccacacagggaacctgcctacagatctgctctgggctcggcagtactctcacttttgtaatttcaaattctatgcagctctcagcactatggattcttttatctttgtttctcactccacttttgtcacagctaagcgtggataatcagccttgtaggctgtttcagaatttctactccagtaccactactgaggtcagtgaagtcagatgtgaaacgtgagtattctcgccctattccaccttaactggatagggcagcaatcattctcactagagcgatctacttgctgctgtggttaagtgctcctactaaccagcaaagcccgcaccttgaaatatactaagctagattgtaaataatcaaaacacatagatttctatactacttgaaaaaatttcattttcaactgaaaaaataagcacacaggagctttcttcacctcggctcacatggtaaaccatgcttgctctttccaaacacagacttcttttaaatcacagccacatgcagcagcaatgcctgcaacctataaacagttacttctcaagtgttaccaatggggtttaaacatgtttgcactaatcatttcattagatggcaactgaaatgagcatcaagtcacacatgccactattttacagtctctagtttggttcatttgctttgttgccagtgccttcagcaaatcactcccccagctatgtttctttcttttttctttttttctgacagctgacacacataccaaagaataattatctttggaataactgattatttttttacgtctggccactgagagtggccagtaaaaagaaaagactcagaactttgggatgttggtggtttgaatgaaaacgcccccatatactcataaggagtggcattattgggaacaggtggggtcttgaggctcactctctcttcccacttcctcaagatctggatgtagaactttttccagctacctctccagcaccttgtctgcctgcataccaccaggcttcctgccatgataataacagactaaacctctgaactgtaagctacccttaattttcctttataaaacattttcctttataaaagttgccatggtgatggtgtctcttcacagcaatagaaaccctaattaagacagggactatctccaaataaaagtacactcttagctgaggcccttggttcaacccccaggaaaccttacccccaacatctgataaaagtactcacagaaaagagcatgttctttttgtcttgattaacagctcgggggtcagggacagggtcagtatgcttgatgacggagacagattcacctatgcaggttatgagacaggatggttaacgctatctgcggcatagccaatcccacagcaccccattcccactgttttatcactgccaatgtgagcagttgtggtaacatatacctataatcccaacacacaggaactgaggcaagtcaagttccaagttcacggccaccgtgtgctacacatccagtttgcgggatgagcaacacagtgagacccagtcataaacaagcaagaaagttcatagccatttccaacatgggagaaagaacaaagggctcaaccgatccaaaacaggcaaactaggaaaacttagtaatggagattaatgtcagagtaatggagagaatgtcaggactacaaaaagtgtaattttaaaaataaaaagtaatgttgaaataacatcctgaaatattcctggaagagccaaagatacagtgatttgtctgacctatgtttagtatagcattcagttgggctgggaatggagttcagctgacagagtgcttacttagcatgcaaagtctggggtcgatctccggcagtatatgaagccgagagtggcggcacatgcttttatgccaactgctggacaggacagacagtaaacagagcagctcaaggttattctgagctatatatcaaatggcctacaggataagacagcctggcctacaggatatcctgcttcaaaaagccaagaggaaaaacagggacccttcaagattctgatcccttttcagttttctctcctatttctaggcatacccgaggatttcaggtatacagtccaatcatttccctaacattttatggcctaaataacttgaagctgatgttgctaaagggaattttactagttaagcagttgtataaaacaagtgtttaaagcccagctgactggattggggctggagagatggctcagctgttaatgcgctgactgctcttccagaggtcctgagttcagcaagcacatagtagctcacaaccatctgtaatgggacttgatgtcttctggtgtctgaagacagcaacagtgtgcttttatatatatgaaatagataaataaatctttaaaaaaaaggggggcttcaggtggcatggacttaccgaattatgatcagttagttacttttaaaacggaacccaaataaatattgacagcctttaaagtttatatttacttgctattcaggttagcacttaaatttaaaaaaaaaaaaatgtatgtgggctggtgagatggctcagtgggttagagcacccgactgctcttccgaaggtccagagttcaaatcccagcaaccatatggtggctcacaaccatccataacaagatctgactccctcttctggagtgtctgaagacagctacagtgtacttacatataataaataaataaatcttttaaaaaaaatgtatgtatgggggtgggaagagaaagtgttatatgtatgttttgttttgttgagacagggtttctctgtgaagccctggctgtcctgaacttgttctgtagaataggctggccttgaactcacaagagatcttcctgcctgtctccaaagtgctagtattagaagtgtagctaccatgcctggcttatcatcaatgtactgtgtggttctcttttgttccgtgtgcattgggttttgcctgcgtgtctgtctgtgagggtgctggagttgtgattgcctggtggatgctggggatcgaacccaggtcttttggaagagtggttggtgctcttaccagtgagccatgtctccagcctgccagcacttctttaaacctgtcaaccctgccagcagatatcattccaccctggatcatgataactaagaaataaagtatcttagagaaggttagggtaggatcccataaaggggtacatatagctgagagataagaggcttcaaatttgagtgattttccaatatatatataatacttacctgtaagaattgactggtcgactcttagagttgtagacttgatggatgtcaatctaatatcagcaggaactttgtcaccaactaattaagagattaaaaggggggaggggtcagttaaagtgagcaacttttatggttacctaaagatgaatgattccatatcaaacatgctttttaaaaccaaataccttgcatacaacacaatgggtaaataggtctctatttctgagcagagtgaacagattaagggtagaatatggccaatgtacactgttagcattctgtctaagctccagcacagttacctggcaacagtcaggcctaacccactataaaaggggctgcttgcaccctccctccttgctctcttgctcctttctccccatgggatcatggccggcctctacttctctactctctctctctgcctctactattctcttgactcccctctccccatactatatggttacgtggctgtccctcagggggaagggatgtcttagcatgggcccactgaggcacccctcccccatacctgactacaccttcatagaacatatcccccccttcttgatctttttgtaaacacaacatacactacaatgtagtttgtatttaaagcaagctagatgggggctgggggggggtcaggtggtagacagggcatggtccctagaactgagtggctacctatggtacccacattgtaattccaaccagaagatcaagactgcaagctctccctcaatggtgcattgaatctgaggccgaacacatacacagacacagacacacacacagaatatttctgaaatacacaggaacatccatcagaaaagcaacagagacaacaaacaaatagttccatcagttatgtcacaaaacaaatacacagcagtagaaatgctattttaccttccaagtgtcaagaaataagaaaacagacctgagttgaagctatatggtaatatgactcttacttcacaacgtctaaacttctgccagcttccataggggtgagaaagaacaaacaaggctggggggatgggttgttaattatagcttgccatgcaagcatagaaatgagagttccatgggttcagttctcagaacccatggggggtggggggacttcacaaagtctcttcccacatctcacatctcacacacaataacacaataacacaaatcacacaataacataataacacaaatcgtaaaaattaagtaaaaagctagaggtaggaggtaggtcagtgagattgtgcagtgggtagtcacttgaaggctgatctgatccccacaatagagggagagagcagactgtctcaggttgtccccagacctccaaataatgtaaaaagcaagacaaatgcagaaattaatgaaaattctctcagtgctaaagaagaaccatgtatataaagagctcatccagtattccgtgtcacagagtatgactagctaattgattatcatactttacctgtgcttctagacacggaaatcaggatacaagggaaatgaaacatggacaggacttctgttgctgtctcaaagctgcaacattctttttttttttttaaagatttatttattaatatgagtacaccattgcactcttcagacacaccagaagagggcgtcagattccattacagatggttgtgagccaccatgtggttgctgggatttgaactcaggacttctggaagagcagtcagtactcttaactgctgagccatctctccaggccaacattatacttttataaagcttaattttatgactttgctcaaaatttttgtaagcagtgaaagctgtgaccactttacacactgtggtgaaaatttcctaaggtacctgtacatcacatgggaaatcacaggagagaaccacacacacagagctgatagtgctgtaatgtttaacaaatgagcaccactgggtttccaggccacagtggagagagacatttcaccctataacctttagtaccttttaaattatctaataaataaatctcttgcataacctgaagatctttcagtcaacaacctgtttcctgggtagagttcctgtaatagccccacagggctcctagctgagcacttggtaagtataaagcaaaatgctaaaatacaccgagtaagggacaaaacccaagctctatgtacccctgagaacagcacctctgcaagagaactaatgtgcccatttagtggaactttaaagaagatgggaactggctatgctcagaagacagcctgcttagcagtgcctgggactgcctccagcctcaaagtgcaaaacttccaagcaaagtggtctagaaaatgccaaagcagccatcctatcctagaagtatgccctgcacttgttaacccttctccaaggagaatatagcgaacttttaaaaaactttcctgctgtggcggctctcaaccttctcaatgcttaatccctttagtccagttcctcatgctgtgtgtggcacccctcgaccatattttgttgcttcttcataactgtaattttactagttaggaattgtaacataaatctctgatatgaggcgaatctgacatgcaacccctgctgttttagtgcatgaaacgaccctacgcctaggaaagcaaggcagcacacaaagctagtaggtaggtccaagatctccaggggttaagatcatccttgcatttgactacagggacacacacaggtgaaggtagaattcctgctggaaatgcttatgcaaccaagagcaacattccaactgaataaaacaaaccttccactttaatgtactttgttcacggtataccaaagggagtacatccaaatgattatgacattaaaacaaaacaacaacaacaaaaagtttaagaccaggcgtgacagttgcatgcttttaataccagtactctgcaggcaaaaatggatctctgaatttcaggcaagtcaggtctaagctgtgaaaccctgtctcaacaaaccaatcactaaattacaaaaaacctgtatgtgtgggacatcccagtgtgaaggtcagaggttatctatctttcagaagtcagttgtctgttatcatgtgggtcccacggattgactcaggtcatcagaaggcagcagacacctttactgctaatccatcttagcgactctggttttgtttctgattagagcttttcatacaatatgtttgatcatgttttctcctcccagactctccctagctccccacccaccaactttatgctctttcacaaaacaaaaataaaaataaatcaccccctctccgacaaaacaatcaaatcaaacaaaaaaactaagataaaagaaatacccaaacaagacaaaataaaaattaaaaacctcacaaaaatactagttagttttgtgttggccaacttctcctgggcatgtggctgtcctggaatgtatggttctgttttttaaactaggtattctttaagacagtctcttactagtgttgaacttgtggcaatcttcttgctcagccacagtacttagtggtatgccactaccactctactatacaaagtagtatactggtatgctatactactaccattgtttctgcacgtcacaaattaatctaattccctgggccttttaacatttaacatgaaatgagtacaaggtcaactggaagtattataactctaaatggaaaaatttcaaatgttcctttgatgtccgaggtgatttatgtaataatcctatgggagctacagacaagactttttttgtccaatgaggtacagaggtgctagcaatctacagctgatgtcattcatgactctgcactataactgatgggatagacagtaactgtatttacaaacttccacctaagagagctagagagagctctcagaggttaagagttctggctgctcgtttagagagcctaggtttgattcccaacattcacatagtggctcatagctgccttgaactccaatgccaagggatcccatgccctcttctggcttctttgggaatatggtgaatagacatgagtaggcgtaccacctatacagattattaaaagatcatctaatgctgacaaggtgctcatcaggtaaagctctcatagagcaagccgaggacctgagtttaatccttggatctcatgttggaaagagaagagaaccaacttccacactctgtagcacactgagacatctcacacacacacattatacatacatcacaataaaatagaaagggcaaaatatgatgctaaacctttaaccgtaacactcgggaggcagaggcaggtggatctctgtgagtttgaggtcaacctgtttctcacaatgactttcaggatattcaagacagccatagtgaaaccctatcatcacctgccccaagggggaagggaagtggggtgtatgtctatgctcttatatatgtgtgtgcatggaggtcaaggaagaggcatcagatcccttggagctcagagtgcagatggttggaagctacccaacataggtgccagctaggactctgactttggtcctctgttagagcaggtggtgcttctaactgacaaaccatccctctaacccaatggtgttgaagattaaaccaaggccattaaggcaaatccttgctttcttgaaacaaaatctctgttcagagtctcgtttgcctccagaatgctgagattataagcctgtgcctccacatccagcaataaatgcacaagatgaaagttctgaataacacaacattagagtaaggtaaaaccaatacctaaacatacatgctaaatgaagacatttatgatagcattataaagtcaatgactcttcccctaatatgaagactgttactcattgagaaaacaatgttgattgacaccttctacaatatatatacatctggtccttctctgtcacatctttctcttctcgaccagtcgtttcccccccccccctttgccctctctgtgcctcagggctgaattgaactgctgcctcattgatctttttcttttgcataaaaggtccaactaaaacctggagctctttcatccgagggagcatttcacccctgcccaagagaaaatggtggttctatgtggttactcagtttttaagaaaacaaatgaacaaacccaacccaaagtaatatgagtgtttatagtgcttacttcatacttaatatgtatattcatatagaaaacttaaaaaactctattgacagcaggtcatctgccctacagataaggttaaaagtaaatgtgtctatttcttagagtacagggcttctgctctaagtgttgtcttcattgatcacaggggaacaggctaaatgttatactccttaacaaaaggaggagatggacagggccatcccagctggctttataatgagaccataatcatacaaagcttcaagatgttatagaggatctggggtgacagactgggaaacctagagaaagggagagctccctgtgtggccatgtgaaagcccggctacatcctgggtaaagactttccagtgtggctttatgtcacctgcacccctgttagtaacttctccaccaccaccaccccccccccccccccccgttagtaacttcttgacaattctaaataagcctaagaaactcacttgtttcccagggtgatagacactgctttagtcacccccccccccaggagaaatcctcaaaaacagagacatcagtaattctattttctcatgttgttaaaaaaggacatcagtaaacaaaatatttaaaagactgtattttaataaagaaattttaatgagaggaaaaaaatctatattgatggatgttttcagaatagaaaagtagaaatctcatgcaagttagttttgagtaatttaaggtacataaaggataaagttgagatgatatgtataatatccaagtgtctaaggtcaaagatcaacaattacaagaacttttatttaaaagtgtctggctttagtcctagacaggagtaactgaccttctgggtgtccaatacccccggaaggtctttctactgtggccagagggatgaaaaggacgactctcatccttgctccccaaagccagctaagtacagggtgtgtccagggagacctcctgtggtgagtgctaatcaaggtccacactacaaagagagccttaacaaacaggaaacttcctacttacttcctagtgcaacagttgtcaaacaaggcctttgatttatcctcacatagttggaataaccaataaaagaaagattaatggagctaaaagttactctcatgcccaaatgatccctgaggaccagatctttaaactggtcttggacagttaaaaaaaaaaaaaaaaaggtaataattttacccacctccatggtctcaaggaatgaggctgttagggtgtttaatgtgtagtccccagacactatcaggtattattactcaaccatcaggtattatttttacgacttttctcagtatgattatcttcttgagtagaagaaaagtaagttgcctataatatatagaaaatgactttggctcaatttaacactgaagttaactacctagagccaaaacaaaataacagggctggtgagttggctcagtggttaagagcaaagtgctctttcgaaggtcctgagtccaattcccagcaaccatatggtggctcacaaccatccttaatgagatctgacgccctcttctggtgtgtctgaagtcagctacagtgtacttacatattttaataaataaattttggggctggaacaagtagaggtcctgagttcaattcccatcaaccacatgatggctcacaaccatctgtacagctacagtatactcatatacataaaataaataaataaatcttaaaaaaaaaaaaagagcaaagtaacaaagccaaccctatcttcttactttctatacgttaacaattcacactccaaggaggcgaccagattacctctcaaactcccaggtttggatgcctgtgggacattactagacaatcatataaaaaggatccaatgggattttgattaaattgtcaattagatgctgacataaacagattcctcttaaaaaagtttccaggtacattttctttaaaaaaaaaaaaaaagatttattttatatatgtgagtacactgttgccactgttttgagacacaccagaagagagcatcagatccgataacagatggttgtgacccaccatgtagttgctgggaattgaactcaggacctctggaaaggcagtcagtaatcttaaccatctttccagccctagaggtgtatttttttctctctctctctcctctgagacagggtctgtctatgtagccctggctggcatcgaacctagagatccaccttcctttcctgtctgccaactgctggaatgaaaggtgtgcttgaccactataaggattggattctttctagaattccatgggtggtagatttttctgaagccatgggcctattttatagtcccgtttattgggtgagtaatttcctgtattttaaaatccttcatatattaagaatatggggtgctgttttctgtgtcactacttcttcaagcattgttgtttctgagccaaggtctccatgggccatagctgtccaaagatttggcggactctacatttgcatgttaaaactaagcgtgggccatactttctcctgcacggaaaggagtattgtttgtaattcaacttgtgctggatcatggtgacatacaaagaacttcagttaacagtttaaaagacaaaataaaaacatatatcagactcatgaataaagaggcaacacctgatgccaggtaaggtagcacaagcttttaaccccagctcttgggaggcaggtagatctccatggtgttcaaagacagtctaggctggtttacatagtgaatttcaggcagacagggctgaactgaatctatccattcattttcctctgctgacttacttcttacatcacttttcagccttttagctaagatcaagtgtaaaaatttaatacaaggcaggctaccaaggtgattcagcagctaaaatcgactgccaccaagcctgacaactggaagtctaatccctaggacccatactgtataagacagtgaactcctaacttgttctcttatcattcttgtacatatatacccccacacacacacacacatacacacatgaacatggacacagacacagaaatacaattaaaaaaacaatatggggagaatactcataaccacaggttcagattctgaaaagaactttttggaacagtctctattacattttcttgcataccagaaatactagctcccacaagatcgtctctgtggaaagacatgaaggaagtatgcccgaattagtttttataacccactatgtgctagcattctctcggctagaaagcctttgcatcatcttggccaacccatgaccttgttttaccaaggccaggaagtagagagttttacttcaggaagctcaattaatgaaagacttcctctagcttgttatgactgcttcacatcttttgctaagggtctatttggttgcacatcaggacagatctattaaggagctttaaaaaataaatctatgaaagtaaagatctgtctaatatttttcaaaggaaaaataacaattgtctttacgccacaggctcctgtgagtttcagacagggctctgcctgggaagcaggcaaggaaacactgctgatcacatccagtgatgttccctaatgggcgagtgagcgcctgagggcacgtggtagtggaaagttcttattcttgccaagggagtgctctgcaattttttcctccacattttttttcctctctttgggctgaggcaggaagaatgagagcatgtgttataaacctccttccatttgcttaacacctgacactgctcacgtgtagttcttggctctgtaagttcttagctctttcctttccataacaatactgattttcactctgaagaaaaatacaatttaaaggttagtctaccaagaatacagttaagagtcagtttttaaaagttatttttgcgataatttataaatgaatggaagttttctttaccttacaaggagatttaagtaagaatacttaaacatcttttttacttaaggtaaacataaataataatatatgcaaggaaaacagtttacgtatacatgtatgtgggtgaataaaaagtattttattttagctgggtgcagtggtgcatgcctttaatcccaagcacttggggttggggtgggctggacatgtacctcaacaggtggagttcagaaagccctgaaactgaacgttgagctatgaacatctttcacttctggaggtcaaattaatacatggaagcaggaattacaccattctatcctcacatcccagccacctccccaaatcctctacatgttctaacacaagaaaagcttaaacactgtatttttccaagtcacaatatcttagcaaaagtgacccctttcctgtggttgttgttggttttgttttttttttttttctttttaaagctgtttttttccccaaaagtcttaacctccatggcaagaatggaaagactgacactgactattagtcatgaagcgggaggagtgattacaggaaatcaggaaatgccagccccgtgtaatcaggtcaagcttcaagatcaactggtctgtcatggtctgagggtgtgtggaggtggggaacctcccatagtccttcacctctcagtgtcttatgacctgtcctcacagtgttaaagggtcttgacctcaaagcactctgcttaatatatctacactcatttttcaaaagtactttgtactttcaaaagagattcacatttatgtatacggtggtcttttgcctgtattcacgtgtacctcatgtgtgtctgttgtctgtctgcaaaggccaagaggtgtcagatcacctggaactggagttatatctgagccatcatgcgctgacagctttgtggagctgaagttacaggcagctgtgaggtgccccagctgggagcgaggttttatcctgggtcttttcaagggtagtaactactgtaactgctgggctcatctccagtccttgcttttcttaacatacaagttaacatgaggaatttaggacttgatttttaggaacaatcaatattatttctagtgttacctgaatctagataccccatccctcactatgaaacaactttacagacatgctcaatgctttccttggttgtttctctggcttttcccccccctttagtataagtttgacttttaaaaaaatttaggggacaggacatatatgtgtgtggaagcctgaggttcacatcagatgtcacccattccccactttatttactgagcatgaatcccatgctgaacccagagctcaccttaactagtgtagctagccaacctggcatagggattactttttcttacctgctgacaaaggagaggccatacattcccatgttttatgtgggtagtggtcacttaactcctatcctcatgcttgtatagcaattgctttatgcactgcaccatctctcttgttcagcacactggtttccttgttcagagatcctgagttcaaatcccagcacccacatggtggatcagaaggccctcttggggtgtggagatgtatgtgaaagtgtgtgtgtgtatacatatatatgtatagatacatatataaaaaacataactaaatctcaacttctgtaaagaaaaaactagtatctcattaaattgcttaactgtaaactgcttaaacaggataattactgcttaaaccacacttaaaattttaatgtggtctgcatgctagaacacacgtttacacttttgaagagatagataatctgagttccaggccaaccaggccaaaatagtgaatcttatcttcgaaaactaatttttcttgtatcttttatttgtgtttctttgtgtatgttcacatatatgcctgtctgaacttatatgcactatgtacatgcaggtatctatccacagaggccagttgtgaactgaactctgatattctacaaaagttgtagtcattcttaactgccatctctctagctccccacaggatcctgggacagacttttaggaacttttagaaatgtagaaactacccagctccatttgagactttaataatcaacctgcccataaagttaggttttgctctaaacaaaaccaaccaaaagtgtttggttttgtacttaaaaacagggctgtaaagatgcataactgtctcggaagtgaaagaatactatcttctcttccataggacccaggttcaatccctagtacccacatagaggctcacaaccatctgttattccagtctcaagggatctaatgtagtcttctggcttctgcaggttcctacatgcagacaaaacacccataatgcaaaataaacaacaggtgggacatggtggtgtacgcctttaatcctagcacttgggggcagaggcacctgtgagttcacaggccagcctcatcaacatagtttccagacagccaagtctatgcagagaccccttgtctggaaaaaccaataaacaaacaaacaaaaatttacctcccctccctttaaactagtggtcagctaagtgcttagattacagagatgagatgttattttaagtgattgctttagccgggcagtgacggtgcacgtctttaatcccagcactcgggaggcagaggcaggtggatttctgagtttgaggccagcctggtctacagagtgagttccaggacagccagggctatgcaaagaaaccctgtctcgaaaaaaaaaaaaccaaacaaacaaacaaacaaacaaaaacaaaaccaaccaatcaaacaaaaagtgattgctttaaaaaagggaaaaaaaaggtgttgctgtgaaacaaagctcaaaataccaaatggatttataccaaccccccaaaagtccaaaagcctgccaatttggcacagtcacacatacatgtaattctagtatataggaggctggggcaggcagaagatcttgagttcaaacctggcctggtctatacagtaaggacggacaccaacataaagaccaaagcttaatcccatgtaatgccttacttactctctgctctcatggctggtgagctcataagattagatgtttgttaaatatacaaagctaggctggctcaactatgacagcttcctaaaagaaatttaaaaaacaaaaccaaccaaacaaaaaaacgtaacaatcaagcctcatgatcacaactatccaatttatatgtatgttagattcaccaagttccttagaatctatcagagacaggaatagcagtatatacctgtatttcaggaccctgcgctcatggcttgacttgggtaattcatgaactcatgactagccagtgctataggaaactatctcaaagaaattcgtcttaactgcccaattctgtagagctgaattttctctgtcccatgtgaagcagaggaagacaatgctggttttcttaaatgagttgggttatctattacataaccttgctttgtattcaactgcctagcaaagtcacatataggtatgtgtgcatgtgtgcgtgcgtgcgtgcgtgtgtctgtgtgtgtgagagagagagacagagtctcactatgtagctctgtctgtcctagaatgcagtatgtagaccaggaagtcctcaagagatccctcatgcctctgcctcccaagggctggaacaaaaggtgtgccacctcatgtgaagataactttatattactaaatcttattactattctttaaatagtcaggtttatgaatgattcctcattattactgaattattggaaaatgctgtccctgttactgagcaattagttttcattttaggaaatataaaatattttttacagaaggcttaaggcaattttttgttgactgtgtcatttttatcacttgtataatagagctcattccagaggattcttcaggacaggagcaatttaagctctgtgctatcgtcagccctgttaccaaaacagtgttgagaacagtgcccttggggttagcaagatggctcagcaggtaagagtactgagtttaaatcccagcacccacatggtggctcacaaccatctgtaatgagatctgacgccctcttctggtgcgtctgaagacagcagtgtacttacatataataataaataaatctttgggtcagagcaagcagaggtactgagttcaattcccagaaaccacaagatggctcacaaccatctgtacagctacagtgtactcattcatatacataaaataaataaataaatcttttttttcccccgagacagggtttctccgtgtagctctggctgtcctggaactcactctgtagaccgggctggcctcgaactaagaaatccgcctgcctctgcctcccgagtgctgggattaaaggcctatgccaccacacccggctcaataaataaatccttgaataaataagcccctaggacatacatcaaagccactgccaaatcctaaattcagagactattttgctattatagcttaattcacatttgtaaaattaacagattaattcagaaaatttaataccactgatgttcccttaatgtaagattaagtatagctttactactttttgtttccattcatcagaactaatttcctggtattaaaagtaatgtagagagccgggcgtggtggtgcacgcctttaatcccagcactccggaggcagagacaggcgcatttctgagttggaggacagcctggtctacagagtgagttcctggatagccagggctacacagagaaaccctgtctcaaaataccaaaaaaaaaaaaaaaaaaaagaatgtagaaataatacatgatagtagttgttctcttactttttgcctagtcagttttatgactccatgtgttctcgatagttcaaaggtttacataagccacttgtaatatccatacaaactcttaagttattagctcataattaaaatttaattctttttttaaacttatttttacttttacacatacgtgtatctggctctcaaagcactattattgtgtctaacatcttagaataagtaaaccccggaaagtcaagcaagctgttgttagggcacagtgaaagacaaggaacagttgctagaaaagataactttctgcgaatggatcaatgtctggaattagcgatggctacagaactctgtgaacaggtcaggactttgtatgtggaagagaaggttgtatggcatgtcaaccatgtcagctaagatgctaaaaagactgacctgagccaccaacaaattgaaatgtgacttatgtacataccatatacatgtttatcatgtatatactttagaaactacagcaagtaattttcctcaactagaaaagttgaataggacatatttagagcagctggtggcttttaaccaaaattttgtatgattgtaaaatatcctctcacttaagtgcctattcctgaactcatttactatctgttctgcagagcaaatcttatgataaagatgagatttcatgttttggtcagcattacagaatactaggacatgtctagaaagaaaggagtacaagaggcttaaaaatatatctatgtaaaatctagttctctctgttctgcacctcttagaacgatcaaaatccaagcgagcacatgggcactaggccaaagctctgcccaagcttcccacgaccgatgtgcagaagtggctaactggccatgaaggattcagaaataggtcaaacgaacttagttgtgaatgtagggaatgacgactaactatattcaaattataaagttcatcttttttacttttttaatagttaacttagttttttgagtatttaacttgcctattttttaaatatttaaaaatgactttaattggggctggtgagatggctcagcggttaagagcaatgactgctcttccaaaggtctcgagttcaaatcccagcaaccacatggcgactcacaaccatccataaggagatctgatgccttcttcatgtgtctgaagacaactacagtgtacttacatataataaatgaatggataaataaataaataaatctaaaaaaaaatgactttaatctcaacacccaggaggcagacgcaggtgaatctctgagttcaaggccagcctgtctaccgagacaccctatctctaaaaacaaatgaaacaaacagcagcagcaaaacaaaaacaaaaaaaccccaacaatatatatacatatataaaaagaaaatgaaggtggctagagagatggctcagtcgttaagggcatttgttgctcttttaaaaccagggctcaattcccagcacctacatggcagctcacatctgtaactaaagtttcagtggctccaattcttcacacagacacaaacacgcagaccaagcacaggaaaaaccaacaagcaataaaattaaaaggcggaagggggaggaagggaaggaggaatacagagtggaaaggtagaagggacaaaatagagacccacttgtcacaaaattttatttttaaatatatgaaaagtgtattttaaaatatacattaaaaaaaacaaacaaacaaaacaaaacaaaaccagggctagagaaatggctcagtggataagagcactgactgatcttcaggtagaccaaagttcaaatcccagagctcacatgtcagtttactccagttccaaggaatccaatgccctcttttggattctgcaggcaccaggcatatgcacagtgcacagacagtcctgagcaggcaaataactcataggcataaaattgaaaaacaaaaaaatatctaaacacaaagagttaaatataatctgaaccttgagaaaagaacgttaaatacataatctaggaataaataaaactgaattcaactcaccagcaatttccactatatcaccaggaactatgtctttagctttaattcgttgcacactctttctgtcctgtcgatacactttgcccatttcaggctcatattccttaagagcttctattgcattttcagcatttctttcctgtataaagaaaagccaagtatggtaaactaggctgtctggtttaaatatttctagattagaaattaaaacttataatcttaatattaaaaagcatgttaagcctggcgtggtggtgcacacctttaatcccagcacttgggaggcaaaggcaggtggatttctgagtttgagaccagcctggtttacagagtgagttccaggacagccagggctacacagagaaaccctgtctcgaagaaaaaaaaattatttatttacttatttgtttattttatatatgaatgctctgtctttacagataccaggagaggtcaccagattccattacagatggttgtaagtcacccacatgggtgctgggaattgaactcaggacctctagaagagcagcaagtgctcttaaccactgagatatctctcagcccaacaattggtattttaatacaaacatttacaaacttatttatacagtaaaaagctaggctaaacaaggtgatatataccttaaatttaacccagtataggaggcagaggcaatcggtcctctgtgagtccaggcctgccagaattacctagtaaaaccctgtctcaaaaataaaataaatatgatggggcaatgcatacctgtaatccctgaagtgtgaaatttaaggcaggagaatggcgagttggaggccaccctgagctacattatgagctactgcctcaaaaacaaaacacaacacattagaatttgaggcagtgtggtctacagagtgagtttcaggacagccaagactacacagagaaaccctgtattgaagaaccaaaaaaaaaaaaaaaaaaagtatgcctggtcaccatcctgcttcaaaatttagaacatgggaagacaaggggtggggagtattatatagcaaaggccaacaaactgctctttctgcctgcacctcctaagagctggagttacagacaggtcacccaggccaggcctgtttgtaaggtatgctggatagtaatctgtgtggcccagcgatcccctgtaatcccaaagacctggaaggctcacgaagaatagtcttgagtttgcagttaacctgggctaaaatgctattaccaaaaatacataaatattttttaaaaattgaccaaagaatgtcaagcattctacttcagttttaaaagtaaggacaccagccgggcagtggtggcgcacgcctttagtcccagcacttgggaggcagaggcaggtggatttctgagttcgaggccagcctggtctacagagtgagttccaggacagccagggctacacagaggaaccctgtctcgaaaaaccaaaaaaaaaaaaccaaaaaaaaaaagtaagaagtaaggacaccaaaaacctgaagggggcgggaaaccaacttgaaaatgaatttgaaatattagtctaggtgtcttgtcaaactctaaacaaaaggcaaaacatattgacatttttgaggtagatcctatagatcaattttgaaggatgcaatttctgttctctagtaaataagctttcagcctgtgtgcaggcaaagtctgtgtaatggagaaaattaaaaacaatttgggttaagaattcttatagcttcctccgtactccacaatctgaggaaattaaaagacattttcatgaagtttttcttcaaaatcatcatgaaatataaaggttgattatatttctcacattctttggttttctgaagctttccattatcaactttctttttttgttgcccagtatagtctaaaaagatcctgcctcaaactcgtcagtgctatgcaagggacgatctatcatacccagcttctcacccacattcattctgttttctttctcattcagcttcctacttcccttatcccccccaacccccttgagacagtgtagccctggctgttctagacgttgttctgtagaccaggctggcctcaagctcagagatcaccagcctctgcttctcaagtactgggtgggattaaaggcctgcagcaccacctttgtctatgtagtttcaggacagccacggtcgtgtaaatagaccttgtcttaaaaacaaaaacaaaaacaaacaaacaatgggctggagagatggcccagtggttaagagcactgctcttcctgaggtcctgagttcaattcccagcaaccacatggtggctcacaacgatccgtaatgagatctgacgccctcttctggagtgtctaaagacagcaacagtgtacttacatgaaataaatctttaaaaaagaaaagaagactgtgtcggctgcaggagtgttctgcttacctgccacacacccacgattgcattggctaccaagataagcagaattacaaacggctctacaaaggctgtaatcgtttcttccccttcctcgaaccaagccaaaacctaaaaggaaaaattgcacatgttggacttgcttatgtgcttttacacttagctactttcataataaaaggataaaacattatgtaagttattatagaaaaaaaatcccttgtccttacatcctaaatataagacaaaatataataacagaagcaattggtttatatccttttcttaccttagttaagattactcaacaactcttattaagagttaggtttttttttttccctttacgtttgtttgttttggtggaaagaaagaatctcattcacttcataggtaacatttcaaataaatgaaacttaaaattcccgattttattatagtaaaaggtgaccaggtaaacacctatacccacactgatttagttaatgttcacaccagggcctggagagatgactcaggttaagaaccctggctgctcatccagaggaccaggtttcatccccagcagttgtctgtaactcaggtagtagagggtagagagggggagtaggtatggtcttaaagaccccttctggcctccaaagctctgaacacatgtggtatacaaataaacatgtaggcaaacacccaattaataaaaaaattcttaaaaatttacatcaattcacagacatacatggcatgaatttacagtttaaaagacaaacaaaaaagtagccaggcgtgatggtgcacacctttaatcccagcacttgggaggcagaggccagcctggtctgcaaactgaaaaaccccatctcaaaaaacaaaacaaaacaaaacaaaaaacacccaaacaagcaaacatttggagaaaaaaaattgaccatttattcaaattcaaagtagaacctaatttctaccttctcagggttagtgagggtcacatcagaatcacaagcttgttctgagacgagaaatgtattttttaaagcaatttaccacagcacctagtattgcaatacagcacttcagaaattatataaattaccctccaaataaataaaataaactgggctggggaagcggcatattatgtaaaagtgtctgctgcctagactatcagtctagaaattcaatcacacggtaacaggcaaactattccaaaaaggtatatgaatgctacacacacaccactttttttttttaaacaaaactccaatcttcctagtgccgtgaccctttaatatagttcctcatgtggtgaccaccaaccataagattattgtcattgctacttcatgactgtaattttgctttgttatgaattgtaatgtaaatacctgtgttttctggtgatcttaatgacccctgaaaaaggatcattaaacgcccccaaaggtgccatgagcataggttggacttgctgatctgaattcaaagctaactaggagggcaagtgccatggatgagtgggtaaaggcacttgctatccaagtctgatgatctgggttcaagtttcacactcacaatgcaaggatctgataaccgacttctcaaagttgtcctctgacctccatacagcaatgcccatgtcacatatgcacataagctccctcccactttccagggccaagtcctgataaatgtcagtggcaattttatcaaaaacctgccaacctgaatgactaaatctgggaggtggaccttgctttacatgggggggggggcacgtgagacgagaggctatatggcttaaaatgaaaacattttcataataaagaccttttctttttaaaaaagatttatttattatatgtaagtacactgtagctgtcttcagacactactatctgaagagggtgtcagatctcattacaaatggttgtgagccaccatgtgattgctgggatggatttgaactcaggacctttggaagagcagtcagtgctcttaaccgctgagccatctcaccaaccaagaccttttctttaaaagattacctaggagctagcaagatgactgatcaggtaaaggcacttactctacaagcttggcaagctttgattcaatccctggaacccacataaaagtgggaggaaagaaccaatcccattgagttatttgacctttgtatataccacccctccccaccacccccaaaagccatttactcctggatcttaggaggcaatggccagtggatccgagttcgaagccagcctggtctataaggtgagttccaggacataataaagagaccctgtctccaaacaaacgtgtgtgtaaacacacacacacacacacacacacacacacacacacacacacaccgtgttataagtaaaatgtgtgtgtaaacacacacacacacatcccatgttataagtaaaataaaggtaaaataatgagcccacatagcatttattctctaaggttttttaaaaaacaaaacaaaaaacccacaaataacaagttaccaaaaggtaattaaaactctaaggaggaataacattgaactagcaaagaatcctatcaaagaaaaagtatacaggctctgacacatgtcaattaccattgacaagtagggcaagaggaaaccagaatgaatgtaataaacacgactgcaagctttcaacagggcattcctagtattaaggccaggatctccgccaaaatgaaaacttctttaggaagttataaattttgataggtgcaggatcacagctgctgatacagcccttccaaacatttgccaaggagaacaaatcagagtaagaaatttaattagctcttaaagaagaaaaattgctcaacttcatgagtgacagggccttttccaaaaggtcagtgaggcattagtgactctaagataagcttcacaccttgttaaagtgggtatgaatttccttcttggcagccaatcctgaggacaacttaggccaccgtcccttaccagctggagtgaaggaatagggtgagcagtgtcagaattactagaggaacacaaacctttagcagtcaagagatgtacattgttctcatgcctaatagttatcaaatgcaagaatcctaatttaaccagtacagtaaccttgccttccatgtgtcctgttgaatagaaaacacaggctacccacactcaaaggctctacagatatactaattattgctgggtgagaaactagtggccaaatctgctctaagaatggcattcaaacctatttaaagtttaaggagcatccattcagagctgctaagatagtgcagtacctagagacagagaccttgcttaacatatgccaggccctgagtcagtctccagtacaagaggtgacaggggtttccacagcagtttcttgaatactttattaaaacaaaaacaaaactgaggttgaagagacagctcagtgactaagagccccttgctgttcttccagggctccagctcagcttgtaattccagcttcaagggaccaggagtcctcttcctgctcccagaggtccacacacatgtgacatatagtcacacaaacatgcacagagatgcaaataacgtaaaaggttcttaaagatagtctattgtaaaataataaatagcccagaaactcaaatcctacatctcaaattgaagatcaatcacattttactgacaaaagcaaatatatgctcagattgtgttttttggtgtctcatggtttgctctattgataaaaaaaatcctatcaggttataaagatgggaaaacagtcctgacagatgactgatgggagaaggtgtaaggagaactacacagatgctctcttagggtttggtcagtttagttataactatgggttttcctaagttaaacaaaatagatttacacaaaaggggaaatatatctagaaaaaaattctttgagactacattgaacatcagggattctctttatactgccttcgtttatagctgcatccctaggggctcagaagatgctctggtgaaccgacgatgctcagtgtgtaatacctcagtgtgtaataccgacaagtgggagacaatgaaacaagtgctcacagagctaagtaaaaagccccaagccagagtctgtgagtaaagaaggcaaccaacgctccaccaataactgaaggaaaggaacaaagtgtagttctaggaaaagacagggttccctcttctctctcaactctgtattgttacagtaacagtgcctttcccctgaattcaaaggttcaaacttgccagctccactctaagccatcccattttaagctgagcagtgtaggatggagatctttctactgacattcatttatagggcaatctctgcattagtgtataacttagtggtagaacactttcctaaaatgtgtaaaggtcttgggttctatccaaacacgcaagaaatggcactatggcactaataatgcccataatttttttaagtttgtgtgtgtgccggagaatatgtatatgcacatcacgtgtgccagtgtctacagaatccaaaaaggtgtcaaaccaccccagaattggtgttacagatggcttgagccgcctgataaaggttctgggaactaaatccacatcttctacaagtacagcaagtgcagccactaagccgtctctccagccctctctagcctgttgttgctggacaggctgacctccaacttgaatcttcctacattagctttttcaagactggtattacaagtgtctgtcaccacacttaacctggcactactgacttctaacaggaatactgaataaagcaaattttgttctaacacaaaaagggccgtgttctgctagacatgggagagagacacatcacagtatgacaggattgtggttatccccatagtagggaaagtgaggaaaaacattaatgcttcatcttcaaaccaccttttaaattgtatttttaaaaaattaaaaaatttcaaccaccataaatgcactatcaattgcttcctgaagatcattgaaaccagcaaagtaaaactagatagcatattttatcaatgtctcaaaatcctagaagcaaattcattcctatatttaaggtactgaagatacatacgacccagtagtggcaagaggatctcttacgttcaaggccaacatagtctatatagtcctggtctccaggatagccaaaactacaaagacagtccctgtctcaaaaacacaacaaaaaagtattttaaaatcaacctgagtagtgtaaagaaacctgtacagactctcatcatcagtaccccactactttctagaccgatgagctaatgccaacatggccctactgattctcaccactccttcagatctttcctcaaaggtcatcttgtgaggttacacaaccagccattaaaagcctgcacgctcctattccctacagccaattcctctatcacagcccattcgctttactctctcaaaagtaccattccaggcaacagaccctgttccctgatatccccagtgtgtgtgtcaggtgttcaactgggggagaggaggaggaggagggagcaggcattccagttaggcagaatacttaaagttactaatctaagagaaggaaacccagtgaaacaaaacaaaaacagtgaatggtgtcaaactaacccacgtgcagagggagatgcattttgcagagatagtcttatgtactgcaggctaacctcaaactcattgtatactcaaggatggccttgaactcctaactcacctacttagctatcaaacactaattacaattatagcatgcactaccatatttgaattgacctttttaaaagaaacaattttggtggatactaaaaattaaactgtccccatgggccaccagtgtaaaacattaatgcaggtttttttttttttttttttttggccagagcaaaacattaactgtagttaacagtttactaatctgatatttgaaataaatcattaatatctttctaacctgaggagaatctgatgatttatgagaactgcctgttcacttctacaaagaacctgcgtatacaaccgtgatattcctgttatgccagtaagaatacactgactaccacaacaaataagtcagtgttcttatttggaagctataaaaataaataagctgaagttcgtggcacaagcctgcaatcctggcgtctaaaaggctaagtaaggcaagagaaacaagtaagactgggctgtacatagtgagcttgagactagtctaagatacagtaagatgctggtggtgcatgtctttaatcccagcacttgggaagcagaggaagtcagtctggtctacagagtgagttcaaggacaaccaagactacacagagaaaccctgtctcaaaaaacaaacacaaaatcaaaacaaaacaaaagggactgaaagatggctaggcaggcagtatttactatatgtttaagcccccgagtttaaacctcaggtacttgcataaaggccagcaagccatggcagtctggctgtaattgcagcattcaggaggcagaggcaagctggctacctaaactagctgaatcagcgagctctgggtttaatccagcaaccctgcctcagtattttagatgagaattattaagcaaggcacctgatgtcaacttctggcctctgcacacacattcacacacaagtacaccacatacctgaacaagtacacccatacattgcacatacatattatataggcagtaacagaaataaaaagaaaataaggaaagaacagacaagtaccatatagcactaccaaccctccatgaagaccatcaggaaaacccatcttttagagcacaatttttctcttttccatctttgtagcttttaagagcagtcttattccagcccaggctgcacgggtgcctcgccttcctgaactacttcttttgaagttaagcaaccttggagtttatctttaaaggttttaatacagatttaagcatggacgctagaagtcaggggtggtataggcttcagagcaacctctcaagagtctcttaatctacccacaatcttgatcaaataaaccaaagcaaatgaaatgaattctagaaaaagcacttcctaaacacttattcttttccatttaacaactcatatcataaaaatgtagcagttcatttcctgaacaagaattccaagtagttattgaaaatgaacttatatttcaactaccaacaggcaatgtcttctctatcacaaaaactgttaagcacttcaaatttgaaaattagaataaattcctaattactccaaagtaaaatttatctataatcattaattctgcttgataaaaagtcaaactgtccacaaacaatttgaaaccttctgaaatccaatagaaaataacttggcacatatttcacttgttcacttcacatgttcacttggcacatttctaaaactgcttcaaataatatgaaagggaccagtaagaatgcattttgcctacagcttgtatatatcatctagttaatttctaattctaagtccttgatggccttagtgaatggcaccatttaatgcgaaagcagagacttccagaatgatgtagcctgcataaatacaaaccttaaacaacccccacatatataacttattttagcacatggcaacacgctcaaactataatcaactccatttatcttgtttacaaatgaaacaaccacctattggacaaaatttttaaaaattaatcacaaaaagatattatatataagaagtacagagtaaataactcagcagtatgctgaatggtctcctatgggaatctaataaattttattcagtgaaaaccacaggtgaaattcttacgaaatgagctagcgagtaaggggtacacaacacgtagatgacaaaccaaagtttcaggagaaaattcatgtatacaactgctcctaaaagtcccctttgctgccaattaactattattttaaaaatagctaaaaaattaatctttcctttacctgaattcagtaagttctctaaacaatcctctaagctaatgttttcatagaggccatgaccacagaacccctgggtcagacttaaacgtgtgaatacataattgaaaccatacagttatcagttttgtgaaacctaagacaagtactgtatgatttttcacttcctatcacagtataagaatacaatgttctaagaataaaaattggcgtgtgttatgaagattaagaacatctgcataccattatcaccatttaaaagaaactataaggtccactgcccaggaaaaaaaaatcctggagtaaaatgttaataacctagaactacccttgccgtccccattagcttttcttaggcaggtctctctctgcatttctctagtttcttagcaaccacactggctcaagcacatacagaacaagaaagaaagaaagaaaaaaaaacaaacaaaaaccccaccttcacctttattccctctttaatatttagaaccaagaatactgaactttgctctcttactctaggaatcactcaagacaggggtccaggttagatgccaccctagaggtcagtgaccaaatttggtcaacagtggtgccatcactgccgtcatcattcttgtcactgtcaggaacaactgtcaccttgccaccaccaggaaggcaaagcaactggaatattccttttgtacgatctatttacagagtgcccaacatcatcgtagtgtgatcttacaacatgataacaaatggaagaaccccaacagaaaaggacttagagtgaggaactttctgatactaaaaactggtgagacacaagaattccagagaccctgcgcagtcaggggtcacctctcactgcactgtaacctaagcaaaacagcttctatcattttcccccctctaattcttgagttattttgtttgtttgtttttaaacacggaaactcaatggtaattatttattttctggtgtcccaacgaaattctttcaacttttatggggagacaaaataattttttaaatacttacgaaagatatacatgctgccagcagtaaaattctaactagtaagtcttcaaactgctcaatcacaagttccagcaaggtttttcctgttagaaaaggaaaggaaaaaaaaaaaaaaaaaaaacaaaccatttgtttcaattgtccacatcaatcagcctgcacacatcatctctccaaaataacatgttaatattatttaccttcttcagccggcaattctagaaggccgaaattcgacagcaacgtgtcaggaggaaagcagaaagaaaaatgaagatattgtattagcgcttttattaaaaactgctaaattcaccaccatcgttgtctgaatggcggatataggtgtatgaacgtacaacaatctgtctccactttgataccccgagaaaattattcagccctggtaatcagtggcctcggaactgcccgtaagccctctccggcctccaggaccatgcagtcatttcagctgggtcatcacttctgccagatgtgcaactttggggagcacaagaaacggtccgagggtttctcaacaacatcgacgcctcataaatccgcgggggactcagcccagccgcaggaacctcctccctccttcccactccctctcccccccccccaatccgactcgctgagcgccggccgggaaggtcaccggctcgagacccctagaggtcggcgatggcccagacccgcgcgtggaccgcccggcctctcgcagccgtcgggcgccgcgccgagccaagccccacgaggtggagccgggtcagccatcttccttggcgctcgggcccgcgccgcgccgctgcagccccggcgccccgcacctaccgttggagccccatctctccttgagcttcttgacctgctccaagctcagccccgtgctctcgttgaccccgaagtggcccagcacctcctccacggtctttgtgtgagcgttctccatggctgcgggggccccggccggcctcgcctcgcgtccccgcggcctcctcgcctaccgcctcgcactccggccgcgggctcgtgccaccgcgggcgcccgggcgcggacagctgtcccctcctttttcttctcctcctcctcctccgcggcggcggcggccgcttccgcctgaccggggcgctgaatcacccgagccccctcccccagaaaccgccgcacgcggcccggcctcgccgagcccgcccgagggactgcgagcctcccgccccgccgcgagtgtgggtcgcttcagcagctgccagccggccgcgggcagcgcaggccccgggcgctgcgccgaggagacggggcgcagatgaggagcggcgccgggccgagccctcggcgccgggaaccgcgaggcaggcgacgggagaggagctgcgcggcgcgccggcccgagcccctcagctctgcacccccgacagcggcggcggagggaactgcggcggaggagacgggaggtggcggcgtcggggacggctccgcggaggctgctctaatagcatttatccgccgctgcctcccctctcgccgccgccgcggcatgtggacgccgctcattggccgagagagcccccagcgcggcgcgggcggcgcggccccgccccctcctccggcgccctcccgcgcgcgcgcaccgcgcgcccacgccgccagcaggccccgcctcctcccgcgcgccgccccccaggaacccggatcgaggccgcgcgcggcgcctgtgcgcgcgcacggggccagggccacctctgcgtccacgctgtgctcgatgcgctgcggccaccggcgcgggcggagggtgagcctgacttttccggggccacggcttttcccgtatcgaccgcgcgcggggatagagcgcggagttcacgggtgggcgctctgtgctggttgccctgccgctgaggttggggactggctgggaccgcgcattggcagggaggctcgggaacgcaggggggccgaggcgcgctcgcactggtgtccttggcttgcctccgcgtcctgggcagcgcgagccgtgctctgcatcctaatgtctccttcagagcccccctcagcaaccaaggggaggaattccgcagttcccttcccacacagccaaaagcgctcatctgtcgcctcgggaacaccgcatcccacacccccagccgaaagcctcatctccatcgcacgccaacaccagcccttccttcccctgcgggttctgtgccccgacagggaatcccactcttgggggaggaaggaggaagttttatttcgtttttagtagctcacacagcctttgacacacgtctgcatagaagtcacaggttatgctgtagcagctatgctaggtggcttggctttggcttccaaatgatggctgctatataagacttccacttcccccaatgcgagagaaggagccttcaatcccaaatctattcttaaaccacagatcatctgttgtttctgtgaggtctgtacagagcctagcatgcaaggtaattttgccaatataaagaggctatacggagcccgcctgtgatcccacgaacagaagtggaagccacgggatcaagagttcaaggtcatggacagacactgaaggagtttaggagcagtcttccacgttggaccttgtctaaaacatacaaaataaatttaaaaagcagaggaatgtgggaagccatacttaacagggaggaggccctttgcattgaatttgcaaatatcttcacaaaatgcggcttcatgaagggcatagattgcaaaataaagcatttcatcttcttgagtgtttagcaacgccaccccccccccccaatcacttgagacgtcccacaaggctccgcctcaagacttaagatagattccttcagcagatgcaaatcatggtgctttacccgactgaaaaaaaaaatcaagtacgtcacttcatttaattatttccaaggagtggaggctggcacgcagttctgattgatacttggaacaggaccaacagaaccctacacgaaacaaacaaacaaaaattctagtgtatagcaatgcactccctagaagcaaggtggaaactggttaggtcacagcctcttctggaggatcaggtgactgcctgcgaggtggggggtgagagggtgggagggatggagagctggtgggtctccctcctagctggattccagttctgtcgtacctacagcaaggggcactgagagtaggaaggtcatgacctctcttagtttgtctgtgatgctcactgggtttggcttttgttctgtagtcccctccttcaggggctggaggtgcaccctacaacacgggttcccagtttttccctcaggccatcttcctccttgtccggtcccctcctgaaagatgtttggtggttttttttgttttgtttttccagagctgaggaccgaacccagggccttgagcttgctaggcaagctctctaccactgagctaaatccccgagtcccccccaccccccggaaagatgctttattatctaaagcagctcccctccccaggatgcctactatcacattattcaagggtctctgctgccctagcacttttctatggaaaatacactgtagattttgtttagctgctcggtgcctgcctcctagcatcttgtaagggcatccagacttgagaatgaagcttgtctgtctggtccatactcagtacaaagcacagtccccaacatctgctcatcatttattgagtgcctacagtttaaatgcatgaaaccaatgagagccccaccctcctcaacccatcagttacttgggaagggctctgccagcactaaggcctcagcaaacgtctgctcagctccagtgtactaatttttccattcatcaataagctggatttattttggcctctggaccacttacctatgagaagaatggctgtgaagcttaggtttaaaccaaaaagaagggctggagagatggctcagcggttaagagcactgactgctcctctgaaggtcctgagttcaagtcccaggaaccacatggtggctcacaaccacgcgtaatgagatctgacaccctcttctggtgcatctgaagacagctacggtgtacttacatataataataaataaataaatcttaaacaaaacaaaaagaaggcaaaactgccctcccagaaaagacaatgcctatagtctcagagatcctgggactatattccattgcccttctggaatgttctctgcaaagcattttctactgaaggttggactgctctctgaaacattaatatgctttctagctgggcacctctttgcttagaggttggcaaaactgatcatgaacccaagactcccagaagcagaatccatggtcccttttatgtagaaataaagttgggagaaacaaagggttggtctcactttaaaagaaggaggaggaagaggaggaagaggagaaggagaagaagaagaagaagaagaagaagaagaggaagaggaagaggaagaggaagaggaagaggaagaggaagaagaagaagaagaagaagacaacgacgacgatgacgacggcgtcatgatgtagtcatgcacacctgtaaccccatcgctcaggaggcagaggcaggtgaggatgagctttaggctaacctggtctacatagtgaattccaggccagcttagtgagaacctgccttaaaaaaaaaaaaaaaaaaagcaaactggggctcagtctgttttctgtgcaatgctctactctgctccttgtttgcaaggctttaataagaaaggttaccgtcttccagcaaggctcataaccacatacttaatcacttgaggacaggaagagaagggaaagacacagcatgcaatgcagaaagatgaagtgtgatcaaagaccttcagaggcacggataaaagaggacattagctaacaaaaagcaggttagtttaaaaagctattccgatagaaaagccaggaggtgacttgcaaaagaggccttggccaggtctcagccctctgcaggcctcctgggaggtgatgggggccacaagaggcagcctgctccatatttggacagctccaatcattaaagcagccccattttgggctatgtccaccttttcctagctacatccgttcttatttaactctccgaaaccaccttgaacaaacttaaatccctctttgtgtgattccttttgagtatttccagatctttatcccactaacgtgtcctttcttcactaaaaagagcagctgggcactgagctgttctcctatagcccgagtctcagtccctcgacctctctggacacgcccagtactgagcatacaagtctgagcctgctgggcagtggtggcgcatgcctttaatcccaggactcaggaggcagaggcaggcggatttctgagtttgaggccagcctggtctacagagtgagttccaggacagccagggctacacagagaaactctgtccttccatttacacagtactagcagtgaactcaaatcaagtcctttgcgtactaatcatagccccgttaaagctatttatggtatacttagcttgttgatttttctgtcccaggcactgagccctgctataattgaatgttttttgtgcttattataatcttatcatcaagcagtctttttaaaaagattttttttaatgggaatgaatgttctgctcacatatatgcctaggtaccactgtggaggccagaaggcagcatcagatcctttagaactggagttacagatgattgtgagcagccatgcgggtgctgagactagaacctgggtcctttggaaaagcagccagtgttcttaaccactgaagcatctttccagccccaagatttatttagttttaactctgtgtttgtgttgtgtatctgtttgggagtatgtgcacatgagtgcaggtacctaaagaggccaggagagggcgctagatccccctgaactggagttacagcttgtgaatcatccaacatggggactggaagaagaactaaagtcctctgcaagacattgtttctctctctcgtttaaaaaaatttttagacttgtgctcactctggcagcacatataccaaagggacacagagaaaattagcatggcccccatgcaagggggatatgcaaatttgtgaagcattccactttgaaaatgatagtttcaggttatattttattttcttatgtttggttgctatttcttagaagcctgttcttttctaacaagagacagaaagggagtggatctggagggcaggagaattgcaactggaaggggtggtgggagagaaaactataattaggatataatgtatgaaaaaaaaatctattctcaataaaaggaaaaacgaaaaaaaagatttattttatgtgtatgagtatcttgtcttttatatgtgtttttagggttttactgctatgaagagacaacatgaccaaagcaactctttttttttttttttcttgttttttggtttttttgtttttttttttttttttttttttttggtttttcgagacagggtttttctgtgtagccctggctgtcctggaactcactttgtagaccaggctggcctcgaactcagaatccgcctgcctctgcctcccaagtgctgggattaaaggcgtgcgccaccactgctcggctcaaagcaactcttagaaaggacaacatttacttggggatggcttacagtttcagagattatcatcatggtgggaagcatggcaacatgcaggtagacatgtgctggagaaggggctgagagttctgtatcttgatcctcaagcaacagaaaggggactgtgtgtcacactgggtatagcttgagcataagagacctcaaggcccaccccctcttcctccagcaaagccacacctactccagcaaggccacacctccagataatgccactccctacaggccaagtattcaaacaagtgagtctatggggccatacctagacaaatcaccacactacatatgtacattatatatatgtatatatatatgtgtgtgtgtgtataatatatatgtgtgtgtgtgtgtataatatatatatttgtgtgtgtgtatatatatataatatattatatgcctagtgcccacagagggcaaaacatgctcctaactgttcagtgacctctccaaccctaaacagtgttctagagatgcatctcagatttgatttacacacaatttaacaaacagaatgactatatcactatccaacaggttttttagctactcattccagattaaaaataactaacgaggggctggaaagatggctcagtggctaagaatactaagtgctcttccagagatcccgagttcaaacccccagtaccgtgggcagctcacaactaagaacagacaccatgaccaaggcaactcttataaaggacaatatttaattggggctggctcacagtttcagaggttcagtctattatcatcatggcgggaagcatggcaccatacaggtagacatggtgctggagaaggagctgagagttttacatcttgatccaaaggcagccaggaagagacgaggaaaaagaggaggaggaggaggaggaggaggaggaggaggaggaggaggaggaggaggaggaggaggttctcttccgaaaatgggcagagcttgagcactaggagccttcaagctccacctacacagtgacacacatactccaacaaggccacacctcctaatagtgccacttccaatattcaaacctccatagcatataaaagttaaattaagagctggacagtcgtggcgcacgcctttaatcccagcacttgggaggcagaggcaggtggatttctgagttcgaggccagcctggtctacagagtgagttccaggacagccagggctacaaagagaaactctgtcttgaacccccccacccccacaaaaaagttaaattaaaaaaaaaaaaaagctaatcaactgaatgaatcttgaccagaagttccaaagtcaagaaagtaaggatctttaagggtgttcctgcctctttattccctgatagtctgtcagatattgtggatcgtctgtcgcccttccttggttgatgtaacttgaaggtcatgtactatgagaaatgcccatttaagtgccaggaccaaacttggcatcatgaaatgcttacactgagaggccagaaggagccaagacctctgacaggatcccatctgccacctctcgcttctcgggctgtgtgcttgttgagtgatacgatggctggggtgggggtgggggggcacagtattgagatactggctggatgcaaagcccaggtccttctgccccaggcctcctgagtgctaggtttgacagtgtgcactgccattctccgctgtccatgagaatttaacgggagagctgtgctcaccagtccttgtccacaacgggctccagaccgccactctgtcaggctttgtgtggagacacgttcactcaagcatgccacatatgacatgtgccactgatcacacactagtcctttgtgaccaccgttgccgactcccactcctccccgagtgcccctcttcccgtgtataactaagtgtctttttcatggacgagtgttggaaaccccagctcttagctgatgcttatgaacgtgagacttcctgggagtccagactgacaatggctgacccaggcaaagtcacctccacctcccggctgtcccaggtggtggcagatgcggtttctagagactcctagtctgtaactcactagtttagcaaagtgatctatttatttactcacttatttttgagacgggatctcccaaggtagccctagctatcctggaactcactgtgtagactgggctagcctcagctcacagagcttcaccctcatagtagtaggtactcaatgccaacacactaactaagcctcattttcaagcctctctccctccttgactctgaatcaaggcccaggactggccattcttccccatcttcaaccctttcgacattgctttaactccacccacggacacatgacacacacatttccacgtccagactgacaagctcagctgccagcctgcgtctccacccatccaagccacgggcccccgtgtgagggtgacaagggtgagtgagaggtcatgtcctttagaagagggagccataaataatacagaatatccagagccaagaagttcagtctcctcgtggcagaaggaataataaataggcatagtcacatgtgaataataatatggcaatgtcacccacccactgtcacctctcttctgacgacaaattataaggcccaggagaccaggggtctgcaggtaataacaagtggccagattaaacgggtgataactgttgtctctgagaccctttaaccctctcctgttggtgtccccagcagccagcacagcgcccagcgggccacaggtaccagcacatatccaactaattaattaataaaaccctctttgcagctgctgctggggggggggtggtggtgtgtgtggggtgtgcagggtggaccaaagcattgccatcttcacgaagaaagaaaaaaagaaaagagacagaaagccatagagcagtgcaaaagcaaagaattatgggatggctttcaaagctgtggctcccaacggggcaaaacgcactttaaatatagcaacaattcctgcctccattggcttgctctttgatttttgtgttaacatttctgaagtttctttcctctgtcctccttgcacaacccccccccccccaggtatcccaaggtgcttagatcttaaatgtttcaattctttaagtgcagagaggattcagtctcctagcccaacagaaaataaggaacacactctcgctggtgaatgacggcgaggctctccgaggtaggctggaggctccaggggccctgctaattgccaaggtcccgctccccagcggggatagcaatagtgaacaggtagagtttcaggctggcaggaacccaaggacagatagagcaagcgacagatagggttgccgtggacagtttcctagaacaggatctttgttcccaaggttgaccagctggttcccttgacgtcccacaatagctgaaagggtgactggtagagtcgtgagcacgtttaggtgtctattgtgatccccgttctggtcacccgatagctctccgcaaatcccaggggtctggccgctggcccgagtcaccttgtgattcctccttttggcgagggggaaggaaggggaacgctgtgtatcccgagagaagtgtgtctgacatgcctgagccgttccatctgggtgcctgcatcataggctccatctggctcaggcagacctcatgagctgaggcacggcagatcccagcaaaccagcagcctcaacccttccctaacctgcttcttctacttcatctcccctggacaggaagacccttgcagactcctccaccccccacccccacccccgggccctgccttcttttctaccatacccttcacctgtgggtctgggtatccactttggggtctgggattctctggtctaggatcccttctgcagaggggcaggcctctagagaaagcgtagggtaatttgggattttgggttatgatataggtacttcgccaactgagctgcctcaaaagcctacttcctgcccgtgaccttctcgtacgacccagtctggggcctgatttgtagacagatacccctataggaggccctctcctgtgcctcacatgctggagccccgagacatacaacggtcccatttccttggctgctttccagcacaggcgaaggcagaacctctcaccctttccccctgaggtcctctcaggtgggtcctgggagccctggtgggggctgcacacagccccagcaagctctcccgagggttggccccgggatgtttgcaaagattggaagtctctctcccatgactcatcagaggagagcagaaccctccttcttcctggaaggcagcaaacgcaaggccaacccccacccccacctccaaaaagtaatcagccttcacttgaagctttctcttcaaatctcagctacccgcaaagatcagctatggcaacttgtgggaggggacgtttttgaggccaaagaacatcctggaagaggcttctctgacccaaggaaaggcaagctggggctggaggtacagcctgacattcacatacgtgcacccacatgaggaatgtccagaaaatacctgcccccttatcttctctagccttattttatttacatatttctttatttttgcttttttttttttttttggagacaagatctcatgtatcccaggctggggatgacctttaaactctgactctcctgcatctatctcctgcgtgctgggattacaatacagagctgggaaccgaaccaaggggctcgtgcatgctgggcaagcctttcaccagctgaactgtgtccccgccccatctcatccttctttcttaatagaaaacctgagctggaaacctttggaacattccagcaaggacttcagtgggtcataacataattctagaaaacagtcaaatacacacacggaatcaggctaattaagaccaaaagggaaaagaaactgggaaggcagatgttatccttggcaaactctccacttgtgcagtacgctcaggagtcacgtgttatttccttccatccttaggttcaggtgtcaggtgtcactgtcatttctattaaccccccccccccacacacacacacacacgcacaagattctgataattggttctcaggttgtcacttgttgaagtcacacacttacaaaccagagctaggtatgatacacacgtgtggtctgtatagcattcaagaagatgaggcaggatgactgtagtgtctgaggccagcctaagctacccattgagttctgagccatcctgggctataaagcaagaccctgtcttgaaacagagaggagggttggtcctggagagacagatggctcagtggttaagcgcactttactgttcttgtggaggactggggttctatccggtgacttacacccaacttaaactacagtgccaggagatcccatgtcctctcctggtctctgctggcaccaagggagtgtgtggtatacagacatacatacattcaagcatataaatcatacacataaaataaaaataagtgtttttttttaaagggagaaaaatatctttataatattctctgttcacttcctccattgctggggactcaggatgcttatttgaatggaatttgtacggatcaattttttcttttctttcttttttttttttttcttcgagacagggtttctctgtatagccctggctgtcctggaactcactttgtagaccaggctggcctcgaactcagaaatctgcctgcctctgcctcccgagtgctgggattaaaggcatgtgtcaccacgcccagatccggatcaatttttttaaaagatttatttattatatgtatgtgaatacactgtagctgtacaaatggttgtgagcctccatgtggttgctgggaactgaatttttaggacctctgatcgtcagtccctgtttgctcccacgcaaagatttatttattattatacataagtacactgtagctgacttcagacgaaccagaagagggcgtcagatctcattacgggtggttgtgagccaccatgtgggtgctggaaattgaactcaggaccttcggaagagcagtcagtgctcttacccgctgaaccatctcgccagcccgggtcaattcttcatatcataaaatatactaaatctcgtagaggaaagagagttaagcattaggggaagcaatcagaggacaccacaacagcaagctccacggagataaactcggaggtactttagatacaaaaaacgtttaaatctgcctaaaacgaagggaggggctctacgcaggagttctgggaagacattagcgattcctgaaagtcgttttcacgacagaagccagtgattctgtggtgtgtgaaagtgttcagacacagatcacccctgctgcaaacagcagttgaattcctgacccttgtcttgtcctgacctaggtcttgtccctcctcccagacctagccaagggagagaaggcccctttgagtcctgcagaaatgcagcctcttcatgggtggggcatggacagctgttgcagtcacagtgagggggtggggcgggggcggggcgcctcccccccaccccccacccccgcagcgatctgcaggaggccaacgactgcgaactgcgtggacctgagctggcatttggccaggacaatgggattaacttcccaagcgctggccaaaaagggccctgggatttttatttttattcgttttccattacaactgcacagcaacgcaaacaaagccccaaacaaggtgagccaccatggagtcccttcccttcgcggggtggcatctcagtg

SEQ ID NO: 5 - DNA, 67 bp, Homo sapiens
gtgctgggccacttcggcgtcaacgagagtacggggctgagcctggaacaggtcaagaagcttaagg

SEQ ID NO: 6 - DNA, 50 bp, Homo sapiens
tggaacttgtgattgagcagtttgaagacttgctagttaggattttatta

SEQ ID NO: 7 - DNA, 50 bp, Homo sapiens
gcatgagatgccttttattcttgaattacgttattcttacaaaaaccacg

SEQ ID NO: 8 - DNA, 78 bp, Homo sapiens
agtgaataaaacagacagagacccttacctggaggataatactgctgagaaaaataaagcaagggggtttggatatca

SEQ ID NO: 9 - DNA, 63 bp, Homo sapiens
agcattgaacttgtttgataatgtatgtcccagaagacaggtattattgtatttagcacaaag

SEQ ID NO: 10 - DNA, 47 bp, Homo sapiens
agagctaattaaagtttcttgtttctgatatgctctccttggcaaat

SEQ ID NO: 11 - DNA, 45 bp, Homo sapiens
ttttactcatattagtagccaatgcaattgtgggtgtatggcagg

SEQ ID NO: 12 - DNA, 46 bp, Homo sapiens
cttaaggaatatgagcctgaaatgggcaaagtgtatcgacaggaca

SEQ ID NO: 13 - DNA, 46 bp, Homo sapiens
gtattaatttccattactaagttttcccagcttacctcctttgaat

SEQ ID NO: 14 - DNA, 47 bp, Homo sapiens
aaagctatgggagtggtggtagcaactggagttaacaccgaaattgg

SEQ ID NO: 15 - DNA, 46 bp, Homo sapiens
tggggaacagctttccaaagtcatctcccttatttgcattgcagtc

SEQ ID NO: 16 - DNA, 85 bp, Homo sapiens
cccgtctgtggaaacccttggttgtacttctgttatctgctcagacaagactggtacacttacaacaaaccagatgtcagtctgc

SEQ ID NO: 17 - DNA, 46 bp, Homo sapiens
taaagatgataaaccagtgaattgtcaccagtatgatggtctggta

SEQ ID NO: 18 - DNA, 45 bp, Homo sapiens
aaaaagttggagaagctacagagactgctctcacttgcctagtag

SEQ ID NO: 19 - DNA, 42 bp, Homo sapiens
ggtgcacccacattcgagttggaagtactaaggttcctatga

SEQ ID NO: 20 - DNA, 46 bp, Homo sapiens
aagaaatgcaccttgaggactctgccaactttattaaatatgaggt

SEQ ID NO: 21 - DNA, 31 bp, Homo sapiens
aggcatccgggtcatcatgatcactggggac

SEQ ID NO: 22 - DNA, 70 bp, Homo sapiens
actcaacccctccgcccagcgagacgcctgcctgaacgcccgctgttttgctcgagttgaaccctcccac

SEQ ID NO: 23 - DNA, 48 bp, Homo sapiens
tggcggatgacaacttctccaccattgtggctgccgttgaggaggggc

SEQ ID NO: 24 - DNA, 66 bp, Homo sapiens
gcagtttgctctccagattgcagcagctttggtctttgtgcctgagttggaagaggggagtgggca

SEQ ID NO: 25 - DNA, 109 bp, Homo sapiens
atttcccgaggctttgattcctgttcagctgctctgggtcaatctggtgacagatggcctgcctgccactgcactggggttcaaccctcctgatctggacatcatgaat

SEQ ID NO: 26 - DNA, 66 bp, Homo sapiens
aaacctccccggaacccaaaggaaccattgatcagcgggtggctctttttccgttacttggctatt

SEQ ID NO: 27 - DNA, 47 bp, Homo sapiens
tcattgctgctgacggtggtccaagagtgtccttctaccagctggta

SEQ ID NO: 28 - DNA, 71 bp, Homo sapiens
tcctacagtgtaaagaggacaacccggactttgaaggcgtggattgtgcaatctttgaatccccatacccg

SEQ ID NO: 29 - DNA, 55 bp, Homo sapiens
atgacaatggcgctctctgttctagtaactatagaaatgtgtaacgccctcaaca

SEQ ID NO: 30 - DNA, 700 bp, Homo sapiens
ctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccct

SEQ ID NO: 31 - DNA, 42 bp, Homo sapiens
agcttgtccgaaaaccagtccttgctgaggatgcccccctgg

SEQ ID NO: 32 - DNA, 29 bp, Homo sapiens
ctccttgcccgtgattctcatggatgaga

SEQ ID NO: 33 - DNA, 52 bp, Homo sapiens
tacacataattaaagtgtccattgacatgtacagagaactaacactatttta

SEQ ID NO: 34 - DNA, 46 bp, Homo sapiens
tagttgagccagcagacattgtcagcaaattaattggcagcagatt

SEQ ID NO: 35 - DNA, 49 bp, Homo sapiens
ggtttgctacttccctcacccactttggcctccgttcaccccaccccac

SEQ ID NO: 36 - DNA, 50 bp, Homo sapiens
gagaggtatgcctgtactcgcttgtgcagaaaacattgttccagattcaa

SEQ ID NO: 37 - DNA, 50 bp, Homo sapiens
atgtacagtattcaattgtaatgcatgccttcggttgtaagtagccagat

SEQ ID NO: 38 - DNA, 4067 bp, Homo sapiens
tcacgtgcccctcttgaagcggctctgatcctgtgacctaaccagtttccacctggcttctctcagtgcgttgccatatagtataattttttgtttgtttgtttcgtgtagggttttgttggttcttttccaagtatcaatcaaaactacatgccaacgtccactccttggaaataattaaatgacatgacgtgcctgattttttcagctggtgatgcactgtaatttgcatctgctgaaggaatttatcttaagtcctgaagcccagccacttgagacaactgaggtgatttttctgctctgcttttgctcatgcggatggtgcgttattgttaaacacaaaagtggactaattgcttcattctgcaacctactccgtgaagaaagctgctcttctttgtgaagagaatatgttcatgttttgttcatgaattccatgcaatttcccatccccttgttaagtaatgtagcttctttatattggcaaaattccctttatcttgctgtgacctgcgctttgtcctcccgagcagagcaaatcatctgtggtttaagagcagctttggattcaagtccccttttctcctgtcgagggaagtgagtctatgaaatggccttcatctgaaagccacagcgaagcacctcctagcccaagtctagctgctgtgtggcagctccagcggcgtgaactgtgactgccctgcagacacctatcaagcgctgcgtcagctattaataataaaatcaactcttctccctcccccccgcgaggggggttccctcgtcagggcccagaacccgctggggaagaatcggggctggcgtgcgaaggagctggcggcagggggtgtaggatgcggtgttcccgaggcgacagatgaaggatttgggttgtgtgggaagtgaactgcggaattcctccccttggtttctgaggggggctctgaaggagccagattaggatgcagagcgcagcccgggcgaccgagggcgaggaggcgagccaaggacatcagcccgagggcgcctcgagacgccccgcgtggaccgcgctcccagctcctcggcctcgccttccaaccatccgcccaccggccccagagcagcgtgcccactgtgagcgccccaccctgcgtctgcaggtgggtgggtcagagaaccgcaggcacagaagagggtacccagcttcccctccgccagccccgcgaccgcggcgcgcgcggcctcgatccgggttcctaggggcggcgcgcgggagggggcggggcctgcgcggcagcgtgggcgccaggcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttccattgttatcgtgttgtaagatcatactaagatgatgttggactctttgtagtctgtaaatagaacttacaaaaggaatattccagttgctttcccttcctggtaatggcaaggtgacagttgttcctgacggtgacaagaatgatgacggctgtgatggcacccttgttgaccaaatttggtcactgacctttagggtggtatatttatctaaattggacccctgtcttaagtgattcttaggttgaaagaacaaggtttagtacagttggttctagatcttaaaggaaaaaaaccagcatggtgttttttcttgttctgtgtgtgcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagt

SEQ ID NO: 39 - DNA, 4050 bp, Homo sapiens
gtgaactgcggaattcctccccttggtttctgaggggggctctgaaggagccagattaggatgcagagcgcagcccgggcgaccgagggcgaggaggcgagccaaggacatcagcccgagggcgcctcgagacgccccgcgtggaccgcgctcccagctcctcggcctcgccttccaaccatccgcccaccggccccagagcagcgtgcccactgtgagcgccccaccctgcgtctgcaggtgggtgggtcagagaaccgcaggcacagaagagggtacccagcttcccctccgccagccccgcgaccgcggcgcgcgcggcctcgatccgggttcctaggggcggcgcgcgggagggggcggggcctgcgcggcagcgtgggcgccaggcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttccattgttatcgtgttgtaagatcatactaagatgatgttggactctttgtagtctgtaaatagaacttacaaaaggaatattccagttgctttcccttcctggtaatggcaaggtgacagttgttcctgacggtgacaagaatgatgacggctgtgatggcacccttgttgaccaaatttggtcactgacctttagggtggtatatttatctaaattggacccctgtcttaagtgattcttaggttgaaagaacaaggtttagtacagttggttctagatcttaaaggaaaaaaaccagcatggtgttttttcttgttctgtgtgtgcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttactattggggttgcactgggtctgttttttgagtggccagtttgagtgactttatattagcattttaaattaatgatgtgtgtgggttttgtttgttcattttttactttgaagtaattagaggcttatagtttgtaagcatttcaagcaggtttttaaataaatgctttaattttttttataagataggaccttggctttgtggagcattatagagctatattttggagttgaaatttgagctcctttttggtaactgtggagttactgctcaggaaatgaactgtgttacatttt

SEQ ID NO: 40 - DNA, 4050 bp, Homo sapiens
aggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttccattgttatcgtgttgtaagatcatactaagatgatgttggactctttgtagtctgtaaatagaacttacaaaaggaatattccagttgctttcccttcctggtaatggcaaggtgacagttgttcctgacggtgacaagaatgatgacggctgtgatggcacccttgttgaccaaatttggtcactgacctttagggtggtatatttatctaaattggacccctgtcttaagtgattcttaggttgaaagaacaaggtttagtacagttggttctagatcttaaaggaaaaaaaccagcatggtgttttttcttgttctgtgtgtgcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttactattggggttgcactgggtctgttttttgagtggccagtttgagtgactttatattagcattttaaattaatgatgtgtgtgggttttgtttgttcattttttactttgaagtaattagaggcttatagtttgtaagcatttcaagcaggtttttaaataaatgctttaattttttttataagataggaccttggctttgtggagcattatagagctatattttggagttgaaatttgagctcctttttggtaactgtggagttactgctcaggaaatgaactgtgttacatttttattttatgagttggtaaatagcaaaagaataagtgtttagggagtacttctatagaattaatttgctttggtttgtttgatcaaggaattgcagatataagacctgttgtgttgattttcttcatgtggggttgggtactgctgctgcattgtctttagtgtttcattcctcctgtctgtatcttttaaaagaaagagcactgactctctttttgtgtcagtttattcctattgatgtaacagaaaaaacatggtagaatattcaggtttttttggagaagtgactaggcgattcttatatacatcatgcgtcatcaagtcatgcttaaattaaaaagaatattagtgacttacttcaaatatcaaactaagtagtaaactgttaactatagttaatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccccctctatcattcactttatcttttcattctcttcttgattaccaactttgttctaaatgtaacacatcgtatggttgcttaactgatgcctgccctttcttctcttttcctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcata

SEQ ID NO: 41 - DNA, 4078 bp, Homo sapiens
aaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttactattggggttgcactgggtctgttttttgagtggccagtttgagtgactttatattagcattttaaattaatgatgtgtgtgggttttgtttgttcattttttactttgaagtaattagaggcttatagtttgtaagcatttcaagcaggtttttaaataaatgctttaattttttttataagataggaccttggctttgtggagcattatagagctatattttggagttgaaatttgagctcctttttggtaactgtggagttactgctcaggaaatgaactgtgttacatttttattttatgagttggtaaatagcaaaagaataagtgtttagggagtacttctatagaattaatttgctttggtttgtttgatcaaggaattgcagatataagacctgttgtgttgattttcttcatgtggggttgggtactgctgctgcattgtctttagtgtttcattcctcctgtctgtatcttttaaaagaaagagcactgactctctttttgtgtcagtttattcctattgatgtaacagaaaaaacatggtagaatattcaggtttttttggagaagtgactaggcgattcttatatacatcatgcgtcatcaagtcatgcttaaattaaaaagaatattagtgacttacttcaaatatcaaactaagtagtaaactgttaactatagttaatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccccctctatcattcactttatcttttcattctcttcttgattaccaactttgttctaaatgtaacacatcgtatggttgcttaactgatgcctgccctttcttctcttttcctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcataaagtcataattaatatggtaataatttgcataggtttctctaccttccaccgtcgtttcccatgtcagctacttagattgaccctaaaatgctaataaaactttctagactgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcggctcactgcaacctccacctcctgggttcaagtgattctcctgcctcagcctcctgagtagctgggattacagatgtccaccaccacgcccggctaatttttgtatttttagtagagatggggtttacctttgttggccaggctggtctcgaactcctgacctcaggttatcacctgcctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttatttaaaaaaaaaaaaaaacttgatgtaaatttcttcatttattgagcaattgtttgagggcccaaaggcacagtgcaagtttctgagaatactaggagcaaaatgtgcttatgatctttttaagcacttttttctttcgttttctttttatgatactaagagctcttcctattatcacagtgtatagatatctgagtcacaatatcatgactgtctcccagtttacagcagaacgtgctttttaccttggattaaaatttgctttatttggccgggtgcagtgagtggctcatgcctgtaatcccagcactttgagaggccgaggtgggtggatcatttgaggtcaggagttcgagaccagcctggccaacatggtgaaaccccacctgtactaaaaatacaaaaattagccaggcgtggtggtgggtccctgtaatcccagctactcaggaggctgaggcaggagaatcgcttgaacccgggaggcggatgttgcagtgagccgagattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcacatttgaagcattgaacttgtttgataatgtatgtcccagaagacaggtattattgtatttagcacaaagcaaagggaagaagaaacactgtttatgtccaaaactatggggcagtggtcttctcttttacttttctt

SEQ ID NO: 42 - DNA, 4063 bp, Homo sapiens
ctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcataaagtcataattaatatggtaataatttgcataggtttctctaccttccaccgtcgtttcccatgtcagctacttagattgaccctaaaatgctaataaaactttctagactgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcggctcactgcaacctccacctcctgggttcaagtgattctcctgcctcagcctcctgagtagctgggattacagatgtccaccaccacgcccggctaatttttgtatttttagtagagatggggtttacctttgttggccaggctggtctcgaactcctgacctcaggttatcacctgcctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttatttaaaaaaaaaaaaaaacttgatgtaaatttcttcatttattgagcaattgtttgagggcccaaaggcacagtgcaagtttctgagaatactaggagcaaaatgtgcttatgatctttttaagcacttttttctttcgttttctttttatgatactaagagctcttcctattatcacagtgtatagatatctgagtcacaatatcatgactgtctcccagtttacagcagaacgtgctttttaccttggattaaaatttgctttatttggccgggtgcagtgagtggctcatgcctgtaatcccagcactttgagaggccgaggtgggtggatcatttgaggtcaggagttcgagaccagcctggccaacatggtgaaaccccacctgtactaaaaatacaaaaattagccaggcgtggtggtgggtccctgtaatcccagctactcaggaggctgaggcaggagaatcgcttgaacccgggaggcggatgttgcagtgagccgagattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcacatttgaagcattgaacttgtttgataatgtatgtcccagaagacaggtattattgtatttagcacaaagcaaagggaagaagaaacactgtttatgtccaaaactatggggcagtggtcttctcttttacttttctttgctgctgttcatgaagcttgttaccttttcgctgtcttttttttgagacggagtcctgctctgtcgcccagattggagtgcagtggtgcgatcttggctcactgcaacctccacctcccagcttcaagtgattctcctgcctcagcctcccgagtagctgggattacaggcatgcaccaccacgcccgggtaattttttgtatttttagtagagacggggtttctccatgttgaccaggctggtctccagctcctggccttaggtgatccgcctgcctcagcttcccaaagtgctgggattacagacatgagccacctcacccagcccagataatccttttacacactgtttaaaattttcaattttcctggagatagggtctcctgtcgcccagcgggtaaatgcagtggtgcgattatagctcactgcagcctcagacacctgggctgaagcctgattcttgagcctcccaagtagctgggactataggtgtgagccatcatgctttgcccttttttttttttttttttttttttgaggcagagtctcactctgtcacctaggctggaatgtagtagtggcacgatcatagctcattataacctcaaactcctggtttcaagcaatcttcccgagtagtcaggactacaggcatgccctgccatgcccaactaattaaaaaaaaatttttttttatacacatagggtctcactatgttactcaagctagtctccaattcctggccttaagagattttcccaaagcattaggattataggcatgagccacctcacccagctgaaacagataattctttttttttttttccttgagatggagttttgctcttgtcagccaggctggagtgcaatggcgcgatctcggctcgctgtaacctctgcctcccggggtcaagcgattctcctgtctcagcttccccagtagctgggattacaggcgtccaccaccacactcggctaattttttgtattttagtagagatgggttttcgccatgttggtcaggctggtcttgaactcctgacctcaggtgatctgcccacctcagcctcccaaagtgctgtgattacaggtgtgagccactgctcctggcttgaaacagataattctttatattcaacctgttgtcaaaatttttagaaacattttcccagttccttgtataagtatactttgtataacttctggcaaaccataattatgaactcacattactatagtactataatactgcagtaagggatcttgcgtttcagtaatgtcactcatccagttttcctcccctttctcttaccccatctccctcccagtctcatggtttctgttgtcaatcctctttctccttacacaaggcaagaggttttcttaccaatagatcagaactgtgaaggactgcccgacatgatctgatatggttgttcttcattttgggctgtagtattttaaagtagaggtttgctctgatggtcccatcactgcttgccattgtctttccctttgctctagctatcaggggatgttgctttaagtttgttccccaggctttactgccaagagggaaattcatacccactttaacaaggtgtgaagcttatcttacagttgctaatgcctcactgaccttttggaaaggtcatagttactcttcaagttgagcgatttttctcccccaagagctaattaaagtttcttgtttctgatatgctctccttggcaaatgtttgaaagtctagtatcagagcagctgtgatcctgcatctatcaaaatttataacttcctagagaagttttcattctggcattattcctggccttaacactagaatgccctgttgaaagcatacagtaacatttattatactcattctggttgtctgtttgccctagctcactggacgttggtggtgat

SEQ ID NO: 43 - DNA, 4047 bp, Homo sapiens
cttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcacatttgaagcattgaacttgtttgataatgtatgtcccagaagacaggtattattgtatttagcacaaagcaaagggaagaagaaacactgtttatgtccaaaactatggggcagtggtcttctcttttacttttctttgctgctgttcatgaagcttgttaccttttcgctgtcttttttttgagacggagtcctgctctgtcgcccagattggagtgcagtggtgcgatcttggctcactgcaacctccacctcccagcttcaagtgattctcctgcctcagcctcccgagtagctgggattacaggcatgcaccaccacgcccgggtaattttttgtatttttagtagagacggggtttctccatgttgaccaggctggtctccagctcctggccttaggtgatccgcctgcctcagcttcccaaagtgctgggattacagacatgagccacctcacccagcccagataatccttttacacactgtttaaaattttcaattttcctggagatagggtctcctgtcgcccagcgggtaaatgcagtggtgcgattatagctcactgcagcctcagacacctgggctgaagcctgattcttgagcctcccaagtagctgggactataggtgtgagccatcatgctttgcccttttttttttttttttttttttttgaggcagagtctcactctgtcacctaggctggaatgtagtagtggcacgatcatagctcattataacctcaaactcctggtttcaagcaatcttcccgagtagtcaggactacaggcatgccctgccatgcccaactaattaaaaaaaaatttttttttatacacatagggtctcactatgttactcaagctagtctccaattcctggccttaagagattttcccaaagcattaggattataggcatgagccacctcacccagctgaaacagataattctttttttttttttccttgagatggagttttgctcttgtcagccaggctggagtgcaatggcgcgatctcggctcgctgtaacctctgcctcccggggtcaagcgattctcctgtctcagcttccccagtagctgggattacaggcgtccaccaccacactcggctaattttttgtattttagtagagatgggttttcgccatgttggtcaggctggtcttgaactcctgacctcaggtgatctgcccacctcagcctcccaaagtgctgtgattacaggtgtgagccactgctcctggcttgaaacagataattctttatattcaacctgttgtcaaaatttttagaaacattttcccagttccttgtataagtatactttgtataacttctggcaaaccataattatgaactcacattactatagtactataatactgcagtaagggatcttgcgtttcagtaatgtcactcatccagttttcctcccctttctcttaccccatctccctcccagtctcatggtttctgttgtcaatcctctttctccttacacaaggcaagaggttttcttaccaatagatcagaactgtgaaggactgcccgacatgatctgatatggttgttcttcattttgggctgtagtattttaaagtagaggtttgctctgatggtcccatcactgcttgccattgtctttccctttgctctagctatcaggggatgttgctttaagtttgttccccaggctttactgccaagagggaaattcatacccactttaacaaggtgtgaagcttatcttacagttgctaatgcctcactgaccttttggaaaggtcatagttactcttcaagttgagcgatttttctcccccaagagctaattaaagtttcttgtttctgatatgctctccttggcaaatgtttgaaagtctagtatcagagcagctgtgatcctgcatctatcaaaatttataacttcctagagaagttttcattctggcattattcctggccttaacactagaatgccctgttgaaagcatacagtaacatttattatactcattctggttgtctgtttgccctagctcactggacgttggtggtgattggcatctgtcaggacttggtggtcctggtgcctcctgtttttatttttctttttgtcctgctcaaacagatatttcttattcatgccgtcttctaatgagtcatttggattcattattgccataaatcatttggaggagtgttttcatgatttactaagtagatcttttaaagaagattttattatgaaatatgcaaacattttaagcaattttttaattaaaaaaaattcgacctccaagattaaatcattagatgtggttaacactgtttctggattggtaagtttccacaaaaagaggtttttaaatttttaaccacatagaccactctttaccatattcattattcttagtattcattgtggtgagttctctctttttaccacgtttatagttgttggattgggaagtgcagtgtgactcttactttgtagtttttaaatcttaacaagtttatagttgtatgagctaaaagtttaaacctctgccccattttcttggggcagtgttctgtgaccagttacatttttggacttaggttatctctgaagtgctgtgttgctgtataaatgtcatatggaggataacctacaaaatacacttcggatctcccaacagctttgcggttctgaaacagccttcagtagtaccactgaaaagaaacggggaattaactggttttttgtttcttttatagagatgagggtctcgctatgttgcccaggctggtctcaagctcctggcatgaaatgatcctcctgccttggcctcccaaagtgccgggattataggcatgagccactgttcccggcctagaattaaacagtttatatatgctctaaaatttaagtcagtgatcaagttgtttatactgtggatttatgtcacatggatattacttgatatgaataataactaaatgaacatgactgttagatgatcaccttttactttaatcaagaattgaagttttattttttctaaatagatacatataaaatgaatggaatttattccctctccccagattttatttggattctaaaatggaattattacatcaaaagataaggtatttttaagaagtatagttgtttttttgagactgagtcttgctctaacgcccaggctggtgtgcagtggtgcgatctcagctcactgcaacctttgcctcccaggttcaagcgattctcctgcctcagcttcccaactagctaggactgcaggtgtgcgccaccacacctggctaattttttgtgtttctagtagaggtggtttcaccttgttggccagggtggtctcgaattcctgacctcaggcgatctacctgtctcggcctcccaaagtgctgggattacagacttgaaccaccacacccagccatgaagtatagttttttgtttgttttttgagttttgcttttgttgcccaggctggagtgcaatggtgcgatcttggctcaccgcaacctctgcctcccgggttcaagcgattctcctgcctcagcctcctgagtagctgggattacaggcatgcaccaccacacactgctaattttgtaattttagtagagatagggtttcttcgtgttggtcaggctggtctcgagctccagacctcaggtgatccccccgccttggcctcccaaagtgctggaattacaggcgtgagccatcgcacccggcttttttttttgttttgagaccgagtcttgctctgttgcccaggctggagtgcagtggcacgatctcggctcactgccacctccgcctcctaggtacaagtgattctcttgcctcagcctcccc

SEQ ID NO: 44 - DNA, 4045 bp, Homo sapiens
tgctgtataaatgtcatatggaggataacctacaaaatacacttcggatctcccaacagctttgcggttctgaaacagccttcagtagtaccactgaaaagaaacggggaattaactggttttttgtttcttttatagagatgagggtctcgctatgttgcccaggctggtctcaagctcctggcatgaaatgatcctcctgccttggcctcccaaagtgccgggattataggcatgagccactgttcccggcctagaattaaacagtttatatatgctctaaaatttaagtcagtgatcaagttgtttatactgtggatttatgtcacatggatattacttgatatgaataataactaaatgaacatgactgttagatgatcaccttttactttaatcaagaattgaagttttattttttctaaatagatacatataaaatgaatggaatttattccctctccccagattttatttggattctaaaatggaattattacatcaaaagataaggtatttttaagaagtatagttgtttttttgagactgagtcttgctctaacgcccaggctggtgtgcagtggtgcgatctcagctcactgcaacctttgcctcccaggttcaagcgattctcctgcctcagcttcccaactagctaggactgcaggtgtgcgccaccacacctggctaattttttgtgtttctagtagaggtggtttcaccttgttggccagggtggtctcgaattcctgacctcaggcgatctacctgtctcggcctcccaaagtgctgggattacagacttgaaccaccacacccagccatgaagtatagttttttgtttgttttttgagttttgcttttgttgcccaggctggagtgcaatggtgcgatcttggctcaccgcaacctctgcctcccgggttcaagcgattctcctgcctcagcctcctgagtagctgggattacaggcatgcaccaccacacactgctaattttgtaattttagtagagatagggtttcttcgtgttggtcaggctggtctcgagctccagacctcaggtgatccccccgccttggcctcccaaagtgctggaattacaggcgtgagccatcgcacccggcttttttttttgttttgagaccgagtcttgctctgttgcccaggctggagtgcagtggcacgatctcggctcactgccacctccgcctcctaggtacaagtgattctcttgcctcagcctccccagtaggtgggattactgacacacatcaccatgcccaggtaatttttttgtatttttagtagagacggggtttcgccatgtcggccaggctggtctggaactcctgacctcaggtgatctgcccgcctcagcctcccaaagtgttgggattacaggtgtgagccactgtgcccagctgaagtatagttttgactttcaagaattcttatgaacaagacatagccagttgtttatataattgcattttctaccgtttatttctagagaaagaaaatagattttgtctatcataatccctttagtgctagccacttttttttttttttttttttgagttttcgctcttgctgcccaggctggagtgcaatggcatgcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctcggccagtgctagccactttttaaaaaagtgacattaagcctaaaaagacacattctaacgtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactctgttgcccaggctggagtgcaatggtgttgtctcggctcactgcaacctcttcctcccaggttcaagtggttctcgtgcctcagcctcccaagtagctgggactacaggcacgcaccaccacgcccagctcatttttgtattttttggtaagagacagggtttcaccatgttggccaggctggtcttgagctcctgacctcaagtgatccgccctcctcagcctcccaaagtgctgggattacagacgtgagccaccatgcccggcctattaatttaattaattgcaaatttttgaccttaatgcatataaactttgcagttaagattgctcattcttcgccaagtgtggtggcaccagcctgtagtctcagctactcaggaggctgaggtgggagggttgcttgaacccaggaggtcaagactgtagtgagccatgatcgtaacactgcactccagtctgggcaaaggagcaacactgtctcagaaaaacattgttcattctttacggtagcaaggaattaaaatgggtgagagaagctgcttaaggaaatgagaatgtgagaaccattatctttatgtctcctagttgcttcctgtgacaaactttaaaagctacatgtcatttttattctccttgggtttttttggtaggtttagctataaaaattgtttccccttcagtgcttactacagactctgagacttaaaattcatgttaagtgttgatcttttaggtatttgacggatataatcacccctttgaggactgaagtagaccttttttttgtttttgttttgagaccgactctctgtcgcccaggcaggagtgcagtggcacgatctcggctcactgcaacctccgcctcccaggttcaagcagttctgcctcagcctccttgagtagctgggattacaggcacctgacaccacacccagctaatttttgtatttttagtagagacggggtttcaccatcaggctggtctcaaacccctgacctcgtgatccacccacctcggcctcccaaagtgctgggattacaggtgtgagccaccactcccggcctttttttttttttttttttttgtttgtttgtttgtttgtttgttttgaccgactttcactcttgttgcccaggctggagtgcaatggtgcagtcttggctcactgcaacctccacttcccgggatcaagcaattctcctgtctcaccctcccgggtagctgggattacaggcacgtgccaccatgcccagctaacttacttacttttaatagagatggggtttcattttgttggtcaggctggtctcaaactcctgacctcagatgattccccctgccttggcctcccaaagtgctaggattacatgcgtgagccaccacgcccgacacatcttataaacatacttagtcctgttgaaattgtaaacttctaatctttaccaataaatgttaacgatctttatgtggtaggttcatagaaagatggcctacttagagatttgtaattgtgccatatatatgtgtgtgtgtgtgtgtgtgtgtgtgtgtgtgtgtgtgtatatatttttttttttttttttttttttttagatggagtcttgctctgttgcccaggctggagtgcagtggtgtgattttggctcactgcaacctccgtcttgtgggtttgaacaattctcctgcctcagcttcccgagtagctgggattataggtgactgtcaccatgcctggctgttgttttttttgtttttttgagacagagtctcactctgtcacccaggctggagtgcagtggcatgatcttggctcactgcaag

SEQ ID NO: 45 - DNA, 4046 bp, Homo sapiens
acagagctagacttcgtctcagaaaaaaaagattcgagtttttaaaaaaagaacattcttaagtctttagtatactgaatggtatgagcagcaatagagggttgtggccttctgaaagtaaggaaaattataatgacagtataaggtagtatgaggggcatagtcttttatttctgaccagtgtcatcaaggagggctttattttttttaagacggagtctcgctctgtcaaccaggctggagtgcagtggcacgatcttggcccactgcagcctccacctcccggactcaagagattctcccacctcagtctcccaagtagctgggattacaggcgtgcaccaccacgcctggttaattttttgtatttttagtagagacagtttcaccatgttggccaggctggtctcgcactcccaacctcaggcgatccgcccacctcagcctcccaaagtgccgggattacaggtgtgagccaccatgcccagccttttcattgattgtaattgtcatctttgttctcagggtcagagataatttatcttttttttcccccaagacagcttcactcttgcccaggctggagtgcagtgtcataatcacagctcactccaatctctgcctcgcaggcttagtgatcctcccacctcagcctcctgagcagctgagactgcaggtgtatggcaccatgtcaggataatttttgcatttttcgtagagacactgtctcgttatgttcagcccaggttggtctggaactcttgggctcaagcagtcctcttacctcagcctcccaaaagtgctgggattacaggcatgagctactgtgctcagctgataatttaagcacatgcaaaatacagtgctcatgggatatttgtttaaccttgagcagtccagttaaattccacccaacatgatcttgaagggtaagaatgtctgatatgagattgaaattaactttatcatgaatttcccaattaaggtttttttatactttttctggggtatatacatcaaaactgaggtacacgtgttaccagctttcatctttgtgtcatttgattctctttaggctggtttgattctacaacttccattctgaaatcgggaagaaaattactgtgacttctaacggttgatagttcatatatgatgtcatgagaaatatatagcttgggactggcagtgctatgatgagagtccagccattcattggtctttacaactggagggatagttcttagaatttgtgagagatactcatcactcatagcatttactgtgtgcccaaacacaatctaagcatgttacatatgacttcttatcctcacaaaccttgaggtaggaactgttagtgttgtcattttatagacagtaaacttgtgtgttgtgtaacctctctacagtgacatagctgttaagagcctgtattgaacctgggcagcttagcccagagttgggttgggttggggttttttttgttttgttttgttttgtttttttgacatagtctctttctgttgcccaggctggagtgcagtggcaggatctcgtctcactgcagcctccgcctctcgggttcaagcgattcttctgcctcagcctcctgagcccagactattaagctgtactgcctctcatgagacagaattgattttaaatggcagggggatttggctaaaggtgaaagctgtgttttacagtcttagggacagcagagtctgtaattgcttttcctcattgttttatccccttagcttaattgagggtacttaacgtttcgtttttaatacaaattaataaatgtccttgtgtctgttgccttagatgtgaattgtttagtacaaatgttactggtgggcttcctttctttttaaagattagacctctaacattttattccttgggttagaaataattgcagtgtcaggcaggtctttactactcttctgttttcttttatacaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgagttgagtttgtcatttttcttttattctagatagtatttctgaatgtagtccttttctcaaggctcataattatatttaaaataattgttttcatgtatcaattaacacattttattgccattcatacaaatcctacattctctaaaattattttgaaatgttttagcacctcccttcctgtcattgataaggcttttggtttttgtttttaaacaaggtattttgaattctacttgtttaaatacattgtagaacacaagtgctagagaggtaaaacctaatgttgatttgacagttagttatagtgaacaatttgttagaatactggctaatgacgacacagtttttcctgttttgtttcttggcaccaaagttcatggtcaagggtaatttcttgactctgaaagctatgcttggccaggcttggtagctcacgcctgtaatcccagcactttgggatgccgaggcaggcagatcacgaggtcaagagattgagaccaccctggccaacatgaaacctcatctctactaaaaatgcaaaaattagccgggcatgatggtgtgtgcctgtagtcccagccacttgtgaggctgcagcaggaagaatcgcttgaacctgggaggcggaggttgcagtgagctgagatcgcaccactgcactccatcttgatgacagagtgagacttcatctcaaaaaaaaaaaaaaaaaacagtatgcttaaaaatacttatgtgttacactgagccaggagtctctgcctgaattccagagatagcttcaaagagtccatgaatccactgtgagtccagaatgctccacagacctccaagggtcagtatcctcactgctgtagattagtgctgtttttttgttttgttttgttttgttttttgagatgggagtctcactctgttacccgggctggagtgcagtggcatgatctcagctcactgcaacctccacctcccaagctcaagcgatcctcccactttgccccccaaatagctggtaccacagatgcatgccactacactcgcctaatttttatattttttgtagagagggagttttgccatgttgctcaggctagtctcaaactcctgagctcaagtgatcctgccttagcgtcccaaagtgctgggattacaggtgtgcccagcagccatatttctgacagtccaaaatcacaacacccctgggaccaaccaggatagtctaggtgggttgtttgttttggctatttcacttagagagtcattgcatactgttattcagattatctggcttttcatacccttctgagttaagtatactatttactttgttgctatttgtgaattatctcatagtaatatgcttttatattgacttgggaagggtgtgctttgtctttattgtcttactcattttaatgaattgaaagagctgcattccttaacccatgctctacaactttggcctctgaaaggaaattgccttgtcctattctctcatccagaaatttttgttgttcctccagaaaaaaaggatagtgttacatatatgccagtaagccaattatttgggactgtgtagtgtttgtgtgtaaatggtgtgtgtaaatgatttaacagcttccttaagtatagtgttaagaagagtacaactcagaatgaaatgtcttggctattggattttttaaaacttcctgttttggccaggcgtggtggctcatgcctgtaatcccagcactttgggaggctgaggtgggcagatcatgaggtcaagagatcgaaactatcctggccaaaatggtgaaaccctgtctctactgaaaatacagaaatcagctgggcatggtggctcccacctgtagtccgagctcctcgggaggctgaggcaggagaatctcttaaacccaggaggcagaggttgcagtgagccgaggtcgt

SEQ ID NO: 46 - DNA, 4046 bp, Homo sapiens
ttttgaaaagcagctaatgtcatggagacagttatatgagtaacctggctctattttttttggtattgtttctttataaatagcttacttattaaaattctcattagcaacaacaagctggaggccaattaagccataaaatgttggagaaatggttgggttatatgtgtgaaattctcatagtgtgccctaaagacgtagttgccatttaaaaaaaatttttttttttttgaggcggagtctcgctctgttgcccaggctatagtgtagtgctgtgatctcagctcactgcaacctctgcctcctggattcaagctgttctcctgcctcagccacctgagtgtctgggattataggcgtgcgccaccatgcccagcttatttttgtatttttagtagagacggggtttcactgtgttggtcaggctggtctcgaactcctgatctcatgatccgcctgccttggcctcccaaagtgctgggattacaggcatttaaaaactttttaggctggtcacggtggctcatgcctgtaatttcaggactttgggaggctgcggcagtaggatcacttgtggccaagagtttgagagagcagttatagtctctataatgaaaatctttttttttttttttttaaagacagagttgcactctgtggcccagtggcgcgatctcagctcagtgcagcctctgcttccggggttcaagtaattctcatgcctcagcctccctagtagctgaaattacaggcatgcaccaccacacctggctaattgtatttttagtagagatagggttttgccatgttgtccaggctggtcttgacctcctgacctgaagtgatcgcccgcctcaaacccccaaagtgctgggattacagacataagtcatcacacccagcctataataaaaaactttaaaagtttaaaaaaaaatttaaacttcatagaggttctcgaatattatctttctttcattaagaaatcataatgtagtttttggctaacttgtggaaccaatttttttggtcaaatattgagagtgaagtttgctacctgtaacttaaagtaacatttagagacatattttactcagattgaccctaattatatatctatgacatgatttttaaattgaaatcagctgggcatggtgtctcatgcctgtaatcccagcactttgggaggccgaggtggggggatcacctcaggtcaggagtttgagaccagccttggccaacatagcaaaacctgtctctactaaaaatacaaaaattagctgggcatggtggcacatgcctgtaatcccagctacttgggaggctgaggctggaaaattgcccgggaggcagaggtttcagtaagccaagattgtgccactggactccagcctgggcaacaaagcaagactccgtctcaaaaaaaaaaaaaaagtagttctttatttaccatgcgatctttccagtacacttgctaattgctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagtgaagccatgtccttctcttataacactaggaattaaagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagag

SEQ ID NO: 47 - DNA, 4047 bp, Homo sapiens
gccaagattgtgccactggactccagcctgggcaacaaagcaagactccgtctcaaaaaaaaaaaaaaagtagttctttatttaccatgcgatctttccagtacacttgctaattgctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagtgaagccatgtccttctcttataacactaggaattaaagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaaccctgtctctaccgaaaagacaaaaattagctgagtggtggcgtgcacctgtagtcccagctactcgagaggctgagacaggagaattgcttgaacctgggcagcggaggttgcagtgagccaagatcacaccactgctctcaattctgggcgacaagcaagactccatctcaaagaaaagaaaagaaaaaagacaaggtctcattctgttgcccaggctagtgtgcagtgacacagctgtggctcacttacagcctcaacctcccaggctcaagtcctcccaccccagcctcacaagtagctgcaaccacaagtgcatgccaccatgccccactagtttttttatttttttttgtagaggcaggttctcactatgtcaccaggctggtcttgaattcctgggctcaagtgatcctcctgccttggcctcccaaagagctgggattataagcatgaaccaccacactcagcctcctttctaattttcctgatcctctgtctctaggtgtatgttaatagacaagttctagagaaagctgctagttaacctccctacctgaagtcctaattggtttttctatcacatgttgaatgaagcgtgctttttctcaaaaagtagatagtcatctctctgtattcattagagattggttccaggacctccctcagataccaaactctgcagatgctcaagtctctgaaatgaaatggttcagtacttgcatataaccttgttcatcctccagtatacttgaaaacatctccagattacttacagtacctaacgtaatattataaatgatatgtaaatagttaaactgtgttgtttagggatagttaacctgtgttgtttagggaataatgacaagaaaaaaatgtacatgttcagtacagatgcagttattttttccatctgctgtttagttgaccgtggatgtggaacccacaggtacagagggctgactaaaattgcttttaacttgctttattctgtgtattcatcatatatatttttgtttgtttgtttgttcttgttttgagatggagtttcactcttgttgcccaggctgtagtgcaatggcccgatctcagctcactacaacctccgccttctgggttcaagcaattctcctgcttcagcctcccaagtagctgggattacaggcatgcgcccccacgcccggctaattttttgtatttttagtagagatagggtttctccatg

SEQ ID NO: 48 - DNA, 4046 bp, Homo sapiens
ctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagtgaagccatgtccttctcttataacactaggaattaaagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaaccctgtctctaccgaaaagacaaaaattagctgagtggtggcgtgcacctgtagtcccagctactcgagaggctgagacaggagaattgcttgaacctgggcagcggaggttgcagtgagccaagatcacaccactgctctcaattctgggcgacaagcaagactccatctcaaagaaaagaaaagaaaaaagacaaggtctcattctgttgcccaggctagtgtgcagtgacacagctgtggctcacttacagcctcaacctcccaggctcaagtcctcccaccccagcctcacaagtagctgcaaccacaagtgcatgccaccatgccccactagtttttttatttttttttgtagaggcaggttctcactatgtcaccaggctggtcttgaattcctgggctcaagtgatcctcctgccttggcctcccaaagagctgggattataagcatgaaccaccacactcagcctcctttctaattttcctgatcctctgtctctaggtgtatgttaatagacaagttctagagaaagctgctagttaacctccctacctgaagtcctaattggtttttctatcacatgttgaatgaagcgtgctttttctcaaaaagtagatagtcatctctctgtattcattagagattggttccaggacctccctcagataccaaactctgcagatgctcaagtctctgaaatgaaatggttcagtacttgcatataaccttgttcatcctccagtatacttgaaaacatctccagattacttacagtacctaacgtaatattataaatgatatgtaaatagttaaactgtgttgtttagggatagttaacctgtgttgtttagggaataatgacaagaaaaaaatgtacatgttcagtacagatgcagttattttttccatctgctgtttagttgaccgtggatgtggaacccacaggtacagagggctgactaaaattgcttttaacttgctttattctgtgtattcatcatatatatttttgtttgtttgtttgttcttgttttgagatggagtttcactcttgttgcccaggctgtagtgcaatggcccgatctcagctcactacaacctccgccttctgggttcaagcaattctcctgcttcagcctcccaagtagctgggattacaggcatgcgcccccacgcccggctaattttttgtatttttagtagagatagggtttctccatgttggtcaggctggtctcgaactcgcgacctcaagtgatccacccgcttttgaaagcctcccaaagtgctgggattataggcgtgagcccccgcgcccggccatcctatatttttt

SEQ ID NO: 49 - DNA, 4085 bp, Homo sapiens
gtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagtgaagccatgtccttctcttataacactaggaattaaagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaaccctgtctctaccgaaaagacaaaaattagctgagtggtggcgtgcacctgtagtcccagctactcgagaggctgagacaggagaattgcttgaacctgggcagcggaggttgcagtgagccaagatcacaccactgctctcaattctgggcgacaagcaagactccatctcaaagaaaagaaaagaaaaaagacaaggtctcattctgttgcccaggctagtgtgcagtgacacagctgtggctcacttacagcctcaacctcccaggctcaagtcctcccaccccagcctcacaagtagctgcaaccacaagtgcatgccaccatgccccactagtttttttatttttttttgtagaggcaggttctcactatgtcaccaggctggtcttgaattcctgggctcaagtgatcctcctgccttggcctcccaaagagctgggattataagcatgaaccaccacactcagcctcctttctaattttcctgatcctctgtctctaggtgtatgttaatagacaagttctagagaaagctgctagttaacctccctacctgaagtcctaattggtttttctatcacatgttgaatgaagcgtgctttttctcaaaaagtagatagtcatctctctgtattcattagagattggttccaggacctccctcagataccaaactctgcagatgctcaagtctctgaaatgaaatggttcagtacttgcatataaccttgttcatcctccagtatacttgaaaacatctccagattacttacagtacctaacgtaatattataaatgatatgtaaatagttaaactgtgttgtttagggatagttaacctgtgttgtttagggaataatgacaagaaaaaaatgtacatgttcagtacagatgcagttattttttccatctgctgtttagttgaccgtggatgtggaacccacaggtacagagggctgactaaaattgcttttaacttgctttattctgtgtattcatcatatatatttttgtttgtttgtttgttcttgttttgagatggagtttcactcttgttgcccaggctgtagtgcaatggcccgatctcagctcactacaacctccgccttctgggttcaagcaattctcctgcttcagcctcccaagtagctgggattacaggcatgcgcccccacgcccggctaattttttgtatttttagtagagatagggtttctccatgttggtcaggctggtctcgaactcgcgacctcaagtgatccacccgcttttgaaagcctcccaaagtgctgggattataggcgtgagcccccgcgcccggccatcctatattttttgaccatcatttgataaaataaataatttaaacctgctgttagaaaagtaacaactgaataaataatgcaataattatacagctggattattttgtataattcactttccttaggttttgcttaaacaacttggtacaagtctattccaaaaggtacacatgactcatacagagtagacatttgtcacatattttattcggctcattaattagcaagggaatctgtatttgaggaagtgttcaatattagaatattagaatagggattgctaggttagat

SEQ ID NO: 50 - DNA, 4046 bp, Homo sapiens
agccgagtcgtgccattgcagtccacccagcctaggcgacagagtgaaactccacctcaaaaaaaaaaaaaagttattttaaaataaagattaactaatttccttattgaatgtgagatgaattgctctgaaaagatgtgtttttaaaacacaacatagctttgttgttgctgttattacggagttttgctctgtcgcccaggctagagtgcagtggcgcaatctcagcccactgcaacctctgcctcccgggttcaagcacttctctccctcaacctcctgagtagctgggattacaggtgcccaccaccacgcccggctaatttgttatatttttagtagagacgggtttcaccatctttgccaggctgatcttgagctcctgtcctcatgatctactcaccttggcctctcagtgctgggattataggcgtgagccaccgtgcccagctcaacgtggcctgtttaacttgagttttacattttttaaattccccttagagaatgatttgatcagattattaattgctcatatttcagagaaagcacgagaaaatatagttttgacatcactttctgtaattttttctttttagaggaggttttacaagttttcatttgcaatgaaaacacaagcctaaatcttacttttccaaactgggcttctgaattataatttgtgaatgcaaatcaagcagtggaaaaattatctttaagaaaatagcttatgtcgctttaaaaaataaaattaatcctttcctaagcatgcttccatctgtattgtctagggaacatcaattcattcagctctgcgggctccttactgtatacatatagttatgcagcttcatagaacatgagctattgccacaataaaaataagtgggaaggagcagagaagcagtttgtcttattttactcgggaaatgtttatgcaactctgaaatgtgagtttattcttcccaagcttttgtgcttagctctaaggcaggactacctaataccactctcacagccagccatttgaaatttgggattctgagcaatctaaagagtaacttgtctctggaactgaccttttgctgaccgggagtcctcataacttggattttgtgtgggttgttgtgtctttggtgccactgctgctcattcattcagcacctcagtgatgctgtttttcatactgttcgattggtcgggggtgtgatgggcgaagcagtctaatataattaagctagttagggtaagggacagtactgctgatgctgagtgagcctcagtgagttttattaaagttgttttcgtaaatgaaagaggttgtttgcctttgtcctaagctaacaaaggtagtttatttgtgtagcattttttaaaaatcccttttaaatactctgatgcgctctccccctacagatgttcattctggacagagtggaaggtgatacttgttcccttaatgagtttaccataactggatcaacttatgcacctattggagaagtgtgagtaaccctcctcctcatttaaaggatctggtgtggcagtttagtatttgtattgatttgcagcatgtctacaaagttaagacagctttctgaatgtggctcaagtcaacacttattactaaagtagtaaatgtttttaaaacaaaaactttgaaagatgaaccaaaggttataatccagtcatctttttgcatcttctgggctccaaactttcaagagggatttgtgtttgttattcactgtagccagtggtggaagaattgaattaagaatttctggtctttttactgattgatttctgataccagagatgcattctctcttttgtttttgtctaatattggctctggcatcaaattgtttggaattttttccagtatgttgtcccagaaattctgttttcattattaaacaattgcgggggggcagggggcgggaggaatcaatagtggcgaccataccctgctctaagagtgttttctctttgggcaggcataaagatgataaaccagtgaattgtcaccagtatgatggtctggtagaattagcaacaatttgtgctctttgtaatgactctgctttggattacaatgaggtaagtctcttcataaattagaaggaatggctgttcctagttcaagggtggggtgggtggaatgaaagtctagcctgccttcctcccttttgaaagtcaagggtgcctgattttgtttcccccttccattcagaacctgatggtggggccagcatgacctcaccaaagaaagctgagagcctttcacatatcctctgtgactgagcattgcagttagttaacttaaagttgtagtatatgtgatgttctttctgttgatagcatacttactataaatgaataaaacccaggatagaaaatgctttcctgaaagcaaaggatatagtttctgtctcaaaggtaagctagtccctgtcagagacagaatgtgaactcttcagaatgataagcagtgacatggaattacattattatgtgaaggcactctttgaattaatagtgtgatcagtggcttcttatatttgggtgaaataataaatactgtgtttgatgtcatcttatatttaagggaaatgaaaaacctacttattagaataagatcacatgcacacctgtactttgagtatgtttttaattatctgggtcacctgtttcagaggaggataaaaatggccttacagtgttgtaatagaggacagattgtgcttttgtggaaaaaaaatattaaagataaatttatctgtgtacttctcccttttttctactttctgtgcctttaaccaatacaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtgagtatttgaacctggtttattgttcatgctgcttatcagtcgtactatatatacttagtgtctgcactgtcctactctcttagaaaactaattataccttatctcctcaaacttacagtatttccttccccatattcactctcaggtaagatgctcttcctgtgtatttgaccaggaaaataaaagcaatcaatagctaatttccttgagcgaccctctgggcccacaggggctgccttctcccatagtgctgtgaacagtgttcttgctcctagcagaagccacctcctcccaacatctttgctgcattattgatttccatctctactagatgttcttcagcatagggggaaataatagtgtctttctatcttgaaactttcctttgaccttatttcccctgtcagctaccacactttcttttcctgttcaattaaaccttttttttttttttttttttgagacagagtttctctctgtcaccagattggagtgccatggcgcgatcttggctcactgcaacctccacctcccaggttcaagcgattctcctgccttagcctccctagtagctgggattacaggcacacgccaccacgcctggctaattttttgtatttttcgtagaaaggggtttcaccatgctagccaggctggtctcgaactcctgacctcaggtgatccgcccacctcggcctcccaaagtgctgggattacaggcatgagccaccgcgcctgggcatcaaacatttcttaactcatttgatgagaccagcataaccaaataccaaaggtcaatgtggtgatggtggtggcagtggcagtggcagtggcagagggcacccacattgttcatgtatacactgaacaaataagtggcctctgagcctttttctgcctgtcagagtctttgagacagggctcattcgaccagcatcactatgacaagggccagtagcaaggatggggagtctccacagtgagttggacctgagtgaggttcctctcaaagagctgctgctccctcctgccaagaccaccatactggacctgtcctgcagtactgcccttagatttctgtgg

SEQ ID NO: 51 - DNA, 4045 bp, Homo sapiens
gcttcatagaacatgagctattgccacaataaaaataagtgggaaggagcagagaagcagtttgtcttattttactcgggaaatgtttatgcaactctgaaatgtgagtttattcttcccaagcttttgtgcttagctctaaggcaggactacctaataccactctcacagccagccatttgaaatttgggattctgagcaatctaaagagtaacttgtctctggaactgaccttttgctgaccgggagtcctcataacttggattttgtgtgggttgttgtgtctttggtgccactgctgctcattcattcagcacctcagtgatgctgtttttcatactgttcgattggtcgggggtgtgatgggcgaagcagtctaatataattaagctagttagggtaagggacagtactgctgatgctgagtgagcctcagtgagttttattaaagttgttttcgtaaatgaaagaggttgtttgcctttgtcctaagctaacaaaggtagtttatttgtgtagcattttttaaaaatcccttttaaatactctgatgcgctctccccctacagatgttcattctggacagagtggaaggtgatacttgttcccttaatgagtttaccataactggatcaacttatgcacctattggagaagtgtgagtaaccctcctcctcatttaaaggatctggtgtggcagtttagtatttgtattgatttgcagcatgtctacaaagttaagacagctttctgaatgtggctcaagtcaacacttattactaaagtagtaaatgtttttaaaacaaaaactttgaaagatgaaccaaaggttataatccagtcatctttttgcatcttctgggctccaaactttcaagagggatttgtgtttgttattcactgtagccagtggtggaagaattgaattaagaatttctggtctttttactgattgatttctgataccagagatgcattctctcttttgtttttgtctaatattggctctggcatcaaattgtttggaattttttccagtatgttgtcccagaaattctgttttcattattaaacaattgcgggggggcagggggcgggaggaatcaatagtggcgaccataccctgctctaagagtgttttctctttgggcaggcataaagatgataaaccagtgaattgtcaccagtatgatggtctggtagaattagcaacaatttgtgctctttgtaatgactctgctttggattacaatgaggtaagtctcttcataaattagaaggaatggctgttcctagttcaagggtggggtgggtggaatgaaagtctagcctgccttcctcccttttgaaagtcaagggtgcctgattttgtttcccccttccattcagaacctgatggtggggccagcatgacctcaccaaagaaagctgagagcctttcacatatcctctgtgactgagcattgcagttagttaacttaaagttgtagtatatgtgatgttctttctgttgatagcatacttactataaatgaataaaacccaggatagaaaatgctttcctgaaagcaaaggatatagtttctgtctcaaaggtaagctagtccctgtcagagacagaatgtgaactcttcagaatgataagcagtgacatggaattacattattatgtgaaggcactctttgaattaatagtgtgatcagtggcttcttatatttgggtgaaataataaatactgtgtttgatgtcatcttatatttaagggaaatgaaaaacctacttattagaataagatcacatgcacacctgtactttgagtatgtttttaattatctgggtcacctgtttcagaggaggataaaaatggccttacagtgttgtaatagaggacagattgtgcttttgtggaaaaaaaatattaaagataaatttatctgtgtacttctcccttttttctactttctgtgcctttaaccaatacaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtgagtatttgaacctggtttattgttcatgctgcttatcagtcgtactatatatacttagtgtctgcactgtcctactctcttagaaaactaattataccttatctcctcaaacttacagtatttccttccccatattcactctcaggtaagatgctcttcctgtgtatttgaccaggaaaataaaagcaatcaatagctaatttccttgagcgaccctctgggcccacaggggctgccttctcccatagtgctgtgaacagtgttcttgctcctagcagaagccacctcctcccaacatctttgctgcattattgatttccatctctactagatgttcttcagcatagggggaaataatagtgtctttctatcttgaaactttcctttgaccttatttcccctgtcagctaccacactttcttttcctgttcaattaaaccttttttttttttttttttttgagacagagtttctctctgtcaccagattggagtgccatggcgcgatcttggctcactgcaacctccacctcccaggttcaagcgattctcctgccttagcctccctagtagctgggattacaggcacacgccaccacgcctggctaattttttgtatttttcgtagaaaggggtttcaccatgctagccaggctggtctcgaactcctgacctcaggtgatccgcccacctcggcctcccaaagtgctgggattacaggcatgagccaccgcgcctgggcatcaaacatttcttaactcatttgatgagaccagcataaccaaataccaaaggtcaatgtggtgatggtggtggcagtggcagtggcagtggcagagggcacccacattgttcatgtatacactgaacaaataagtggcctctgagcctttttctgcctgtcagagtctttgagacagggctcattcgaccagcatcactatgacaagggccagtagcaaggatggggagtctccacagtgagttggacctgagtgaggttcctctcaaagagctgctgctccctcctgccaagaccaccatactggacctgtcctgcagtactgcccttagatttctgtggcctcacaagcccggggagcctagacctcagtagaaacactttgcaacggctgctggtgaagaatggccatccattgagtctctagcacctgggtctcctcaaaagactggtccccctgcctgtcacttggctcagcttaagaacttgaagtggaccaggcgcagtggctcacacctgtaatcccaacactttgggaagctgaggcgggagagtcacttgaggcctagagtttaggttgcagcatcactgcacttgagcctgggcaacagagtcagaccccatctcaaaaaaaaattaaggcctgaagtggctaaacttgaaggataactccctttatcttatcctggccaaagtggtagatgattgcttggatgagaagtgatatgcagataagatgttgcaatacacaaagtctgtgtgggtcagtcggtcacgtgggtgccaaggacaggtgggagagaagaagcaagctacagaagcagctcaagaatgggaactgcggaagctgattgtattggaggaaggagtgtgatgctctcagagcagccagggaggagcagaaggagcttagggacgtaagtcaggctctcaaagtctatgtctggttcctgcccccacaaaccaccacccaggaaacatcattcctgagctgtgtggcagcagcagcagctgctccttttatatggcagacagggtgattgcttgttgggcaagagccctcctacactatcttagagtgaataccctctatctgcagtccagggtctgcacagccacatggtcctctaataggtccaccagaccatttgcctgcaaacagcctcatcctcagtgcccactgtc

SEQ ID NO: 52 - DNA, 4042 bp, Homo sapiens
cctgagacggttcagtggctggcaggccagcaggatcgctgcagggccctgagccccatctagtcagttcatcagccttcagtcctcccgtagcttcctaggttagatgctgatgttcttggggatttctatgatgatttttaaatgtgtgtcagtgggagcaaatataattaactcaccacattaaccaaattaaggtggaaaaaacaataaggtcacctcagtaggtgcatatgatgaaacgcatcttatcacaccaaactaagactataaaagtgtgtctttaacgctgacagtgtgtttacacagagaccatgctaacataacagaattctcaccatttctatgcagtattatactggcattcctggtctgtgtaataggcaagaaaagtacaaaaactggaagagaaggggtatctttagttgtaggtaacgatataaagccaaaggtttattctcagtcttcgtcttcctattttgttggtgctgtcactcgctccctctttgaagcacctcttcacttggcttccacgatcccatacttgctctccctccctggcctctcattcgaggtctttgtagctgggtctttcacaaggcaccaggaggtgaaggctccatagtcctcagccatttctgtctatagttactcccatgatctcttctggtctcattactataatcagtagccactagctatctaaaactacttagaatacctaaaaacacttccttagatgccctagccatattcacttaaagtgcttatccatcacgtgtgacagccacatgaacagtggccacagagcattgccatctttcacagagttctggtggacagctctgcttggggccatctcttcacctccaacgttccctagtttaagtcagtgtcattatactgaatggtattccttgtctcccttcagccaatgcttttgttttttgagatggagtttgctctttcgtccagggtggagtgaagtggcgcaatctcatctcactggaatctctgcccccctggctttaagcagttctcctgcctcggcctcctgagtagctgggattacaggtgcctgccaccacacctagctaatttttgtagacagggtttcaccatgttggccaggctggtcatgaactgctgacctcaggtgatccactgcacccgaccaccttcagccaattcttgacaactggagcttgagaccctccgttgtcttctgttttacttgtcttaaaagccaaatgccccataatgacttttgaggtcttaatgacctgcttctaccatcctctgccattacctgcctcaccttttgctcatgtaaactctattccagccacgttggcactcctttaccattccaggacttgccaggttgcacttccgttctctgcctggtgggtcttcaccaccacccactgggttcacacacatcttttcaggccccatggggccatctttattcaaatgtcaccgccttctggccactttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgca

SEQ ID NO: 53 - DNA, 4046 bp, Homo sapiens
gtcagtgggagcaaatataattaactcaccacattaaccaaattaaggtggaaaaaacaataaggtcacctcagtaggtgcatatgatgaaacgcatcttatcacaccaaactaagactataaaagtgtgtctttaacgctgacagtgtgtttacacagagaccatgctaacataacagaattctcaccatttctatgcagtattatactggcattcctggtctgtgtaataggcaagaaaagtacaaaaactggaagagaaggggtatctttagttgtaggtaacgatataaagccaaaggtttattctcagtcttcgtcttcctattttgttggtgctgtcactcgctccctctttgaagcacctcttcacttggcttccacgatcccatacttgctctccctccctggcctctcattcgaggtctttgtagctgggtctttcacaaggcaccaggaggtgaaggctccatagtcctcagccatttctgtctatagttactcccatgatctcttctggtctcattactataatcagtagccactagctatctaaaactacttagaatacctaaaaacacttccttagatgccctagccatattcacttaaagtgcttatccatcacgtgtgacagccacatgaacagtggccacagagcattgccatctttcacagagttctggtggacagctctgcttggggccatctcttcacctccaacgttccctagtttaagtcagtgtcattatactgaatggtattccttgtctcccttcagccaatgcttttgttttttgagatggagtttgctctttcgtccagggtggagtgaagtggcgcaatctcatctcactggaatctctgcccccctggctttaagcagttctcctgcctcggcctcctgagtagctgggattacaggtgcctgccaccacacctagctaatttttgtagacagggtttcaccatgttggccaggctggtcatgaactgctgacctcaggtgatccactgcacccgaccaccttcagccaattcttgacaactggagcttgagaccctccgttgtcttctgttttacttgtcttaaaagccaaatgccccataatgacttttgaggtcttaatgacctgcttctaccatcctctgccattacctgcctcaccttttgctcatgtaaactctattccagccacgttggcactcctttaccattccaggacttgccaggttgcacttccgttctctgcctggtgggtcttcaccaccacccactgggttcacacacatcttttcaggccccatggggccatctttattcaaatgtcaccgccttctggccactttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaa

SEQ ID NO: 54 - DNA, 4031 bp, Homo sapiens
gttgtcttctgttttacttgtcttaaaagccaaatgccccataatgacttttgaggtcttaatgacctgcttctaccatcctctgccattacctgcctcaccttttgctcatgtaaactctattccagccacgttggcactcctttaccattccaggacttgccaggttgcacttccgttctctgcctggtgggtcttcaccaccacccactgggttcacacacatcttttcaggccccatggggccatctttattcaaatgtcaccgccttctggccactttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttt

SEQ ID NO: 55 - DNA, 4070 bp, Homo sapiens
cacgttggcactcctttaccattccaggacttgccaggttgcacttccgttctctgcctggtgggtcttcaccaccacccactgggttcacacacatcttttcaggccccatggggccatctttattcaaatgtcaccgccttctggccactttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgtt

SEQ ID NO: 56 - DNA, 4048 bp, Homo sapiens
gggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgaggg

SEQ ID NO: 57 - DNA, 4066 bp, Homo sapiens
caacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactaccca

SEQ ID NO: 58 - DNA, 4109 bp, Homo sapiens
tgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaat

SEQ ID NO: 59 - DNA, 4066 bp, Homo sapiens
tccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagg

SEQ ID NO: 60 - DNA, 4047 bp, Homo sapiens
gaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagta

SEQ ID NO: 61 - DNA, 4071 bp, Homo sapiens
atttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataa

SEQ ID NO: 62 - DNA, 4055 bp, Homo sapiens
cactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaac

SEQ ID NO: 63 - DNA, 4700 bp, Homo sapiens
accctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggccc

SEQ ID NO: 64 - DNA, 4042 bp, Homo sapiens
caatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaa

SEQ ID NO: 65 - DNA, 4029 bp, Homo sapiens
cacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtct

SEQ ID NO: 66 - DNA, 4052 bp, Homo sapiens
ttctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgt

SEQ ID NO: 67 - DNA, 4046 bp, Homo sapiens
catcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgc

SEQ ID NO: 68 - DNA, 4049 bp, Homo sapiens
acctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagc

SEQ ID NO: 69 - DNA, 4050 bp, Homo sapiens
tctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcac

SEQ ID NO: 70 - DNA, 4050 bp, Homo sapiens
ccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaattctcagtgtggtggtgactgttctgtgggagggggactgatgggcaccaagggcctccactccgcacccgggcctgcccctctacagggaagcaggggaggctcagtctgggcagggtggccatgtgactagaggggacaggaacctcttggactcgacttcacagtagacaggctgactggcagcaggtccgcccatgtgaagcccaccctggctccctaccctttaaggatgggggaagctgagtgtgtgttaccagtggggtcttaaacacacaaggcctcactcgtcagtgtggtgaagaaagccaagactccgcgctctccattgttagcagcctggaaagatctggagactagcaatggagagatgtttcttaggctgttcagatccaaaacttccacattccccgttgttgataggtatgggatggagaggtgaacagaactgaagcagctgttggaattcatttgctggttactttagtgcttatttggcagtgatgggtttgggattgggtttttggttttgcacattccctaagatgattctttatcactttaaaaaataccaggatacaaggatagctggatgattctataaatctaatttttaaaactatcagttctgggtaggcacggtggctcacgcctgcaatcccagcactttgggaggccgaggcaggcagatcacaaggtaggagatcgagaccatcctggctaacacgatgaaaccccgtctctactaaaaaaaattgccgggtgcggtggctcacgcctgtaatcccagcactttgggaggccgaggcgggcgaatcatgaggtcaggagattgagaccatcctggctaacatggtgaaaccccgtctccactaaaaattcaaaaaattagccgggcgtggtggtgggtgcctatagtcccagctactcaggaggctgaggcaggagaacggcatgaacccgggaggcggagcttgcagtgagccgagatcgcaccattgcactccagcctgggtgacagagcaagactccgtctcaaaaaaaaaaaaaaaaaacaacaacgaaaatacaaaaaattagctgggcatggtggcagttgcctgtagtcccagctactcaggaggctgaggcaagagaatgaatggcgtgaacgtgccactgcattccagcctgggcgacacagcgagactctactgatcagttctgctgatggagaaaaaaaatttgataaaatttaacatccattttctaaaaattattcctatgtaccatttattattagaaaccaaaagtgttaacgctttagagttgcattccaagtccactcttgcccactaccaaacactgttctagaggtgctagtcagtacaatcgggcacgagaaggaaaaaatgccttggaatgaacaaaaagcgatcaggggtcatactgggtcaatgttcctagacaggaactattttgttcctagttagaaatgtttaatgattcagggaaaattgacagctgaatgggagtgacatataattcatactgatatatgagaataccaatggtggccttaggccaatcctaacaaacatcaggcagacaaaaaccaaggaagcacaccaaacct

SEQ ID NO: 71 - DNA, 45 bp, Homo sapiens
ttacagaaaacagcatgttctttttatcttggttgacagctcgtg

SEQ ID NO: 72 - DNA, 41 bp, Homo sapiens
ccttcaattcggtatcaaatacattcatcttctctactagg

SEQ ID NO: 73 - DNA, 46 bp, Homo sapiens
cttccaactcgaatgtgggtgcacctgtcaatgacaccttcaggag

SEQ ID NO: 74 - DNA, 45 bp, Homo sapiens
gacgtcacgtcctcatcctgcccgaagatgccgatgcggcgacag

SEQ ID NO: 75 - DNA, 46 bp, Homo sapiens
cggggaggtttattcatgatgtccagatcaggagggttgaacccca

SEQ ID NO: 76 - DNA, 49 bp, Homo sapiens
agttactagaacagagagcgccattgtcatcgggtatggggattcaaag

SEQ ID NO: 77 - DNA, 45 bp, Homo sapiens
agttactagaacagagagcgccattgtcatcgggtatggggattc

SEQ ID NO: 78 - DNA, 42 bp, Homo sapiens
attttcagcaccatcagccactgggtcacgttcagcggtgtg

SEQ ID NO: 79 - DNA, 42 bp, Homo sapiens
ccatcggtgcatgccgagaacgagcaggatttggtggcaggc

SEQ ID NO: 80 - DNA, 4045 bp, Homo sapiens
ctcctgtctcagcctctcgagtagctgggactacaggtgcacgccaccactcagctaatttttgtcttttcggtagagacagggtttcaccattttggtcaggttggtctcaaacttcggacctcaggtgatccacccgcctcggcctctcaaagtgctgggattacaggcgtgagccactgcgcccaggctttttttttttttaattaaaggaaaatataatttctctaattctcttacatctaatacaagtatatcagccatacagatatcctgtattttgtgaaagttttaggaattaaatgattagatcctctcaaatattagaaattaagctcaggctatacatacagcccacagaaatgtatgaaattacaaatcaaaagttttgatggcatgaaggcatattggtaggatgaacaaagaaccacgacacggaatattctaaattactcctcttaccctgcagactgacatctggtttgttgtaagtgtaccagtcttgtctgagcagataacagaagtacaaccaagggtttccacagacgggaggcttcgaacaatggcatttttctttgccattctgcgagttccaagagccaggcaggtggtgatgactgcaggcagaccttcaggaatggctgctacagccagggccactgcaattttaaagtagtaaatagcacctctgatccaggaccctccatgaaccgggtcattgaagtgcccaatatttatgatccagactgcaatgcaaataagggagatgactttggaaagctgttccccaaattcatctagtttttgctgaaggggtgttctctcctgttctgttgccaccatttcatcccggatcttgccaatttcggtgttaactccagttgctaccaccactcccatagctttcccagcagcaatgtttgtaccctaggacagaagtagagaactggtcacaagatgaataccacatcccaacttaaataccgacgctggtttttgactagggcacccagattctctacacattctactaggtcttccactggctactgttcaagcaaccagccatacaactgtgacaacaagcaatgctccatgtgctacttacttatgtcaggcagctctgtactgacccacctagatttctatttgagcccggcttgcagaccatcttcaagcagtgctcttaacccctctgtgttcccaatttttcaaactcatatagttcaactctaagcattctccacttctggctccaacaactcaaggcccctacttttctcactgtaatagaaacggcaactagccccatgggctatcttgacaacccctactcatgtgacagggtccaaaaaccaaagaaatcaaatgtgagcagtctctcccatgccactttaattcctagtgttataagagaaggacatggcttcactattttcagggtacctctatttacttactatgggtagtagtcaggttctcatacaaacccacaaatgtccccaacttaaaatcatttcctcactattcaaagaatttttcacatcaatagaaaaagtgaaatagtaaaatgaacattcatatactttgcacctagactcaccattattaatggtttgccatgtttgctttctctctctctctaaacacgcacctttttattgtgaaccacatacaaatagcagctgtcatctacatcattttgaaaataccctttattggctaaggcttttccaaacaaatctacttttcaactatgtttgcaggtaagagtttgaagatgtataagctagtcattattttttggtcccccaaaacttgccaattaaaagacatctaagtcacacgttatgttactgccatattctgacacctaagactgaccatgaaaagtgtgattatcctttagaatgatagccagtgatggttggcagtgaaaaacataacatttgattaggctttggaaatgtctgtaaataaaaacacatttcataaagtacttacagaaaacagcatgttctttttatcttggttgacagctcgtgggtcagggacgggatcagtgtgcttgatgacagagacagattcacctaagcgggttgtgagacagaaaaaacagatctctgcgacccacaccaagaacctagaacctctcattcatgcccacccattaccactcttgggatactgttagtgtgagaaaaggttggcaaaaggcccaattcattcaaaggaggtaagctgggaaaacttagtaatggaaattaataccagaacaaagggtgtcaggataaaaatcaacacaattccaaaataaaaaagtgaattttcaagtagaatccccattgattattttctggagtaactattcaaattaatttatttttcagtaatcattttatactctgatactgtgactgtattatttacatatatttgttgtatactttaataaatactttaacatatatactgatactttttttttttttcgagacagaggtcttgctctatcacccgggctggtgcaatggcaccatcacaactcactacagcctcaacttcctgggctcaagcaatcttcccaacttggcttcctgaatagctgggattacaggcacccaataccacgccgggttaatttttttggtatttttttgtagagatgaggttttaccatgttgcccagggtggtctccaactcgtggactcaaacaatttgctcatcttgtcctcctcaaagtgctggaattacaggtgtgggccacatctggctatgctctggagtagcaattagcaagtgtactggaaagatcgcatggtaaataaagaactactttttttttttttttgagacggagtcttgctttgttgcccaggctggagtccagtggcacaatcttggcttactgaaacctctgcctcccgggcaattttccagcctcagcctcccaagtagctgggattacaggcatgtgccaccatgcccagctaatttttgtatttttagtagagacaggttttgctatgttggccaaggctggtctcaaactcctgacctgaggtgatccccccacctcggcctcccaaagtgctgggattacaggcatgagacaccatgcccagctgatttcaatttaaaaatcatgtcatagatatataattagggtcaatctgagtaaaatatgtctctaaatgttactttaagttacaggtagcaaacttcactctcaatatttgaccaaaaaaattggttccacaagttagccaaaaactacattatgatttcttaatgaaagaaagataatattcgagaacctctatgaagtttaaatttttttttaaacttttaaagttttttattataggctgggtgtgatgacttatgtctgtaatcccagcactttgggggtttgaggcgggcgatcacttcaggtcaggaggtcaagaccagcctggacaacatggcaaaaccctatctctactaaaaatacaattagccaggtgtggtggtgcatgcctgtaatttcagctactagggaggctgaggcatgagaattacttgaaccccggaagcagaggctgcactgagctgagatcgcgccactgggccacagagtgcaactctgtctttaaaaaaaaaaaaaaaaagattttcattatagagactataactgctctctcaaactcttggccacaagtgatcctactgccgcagcctcccaaagtcctgaaattacaggcatgagccaccgtgaccagcctaaaaagtttttaaatgcctgtaatcccagcactttgggaggccaaggcaggcggatcatgagatcaggagttcgagaccagcctgaccaacacagtgaaaccccgtctctactaaaaatacaaaaataagctgggcatggtggcgcacgcctataatcccagacactcaggtggctgaggcaggagaacagcttgaatccaggaggcagaggttgcagtgagctgagatcacagcactacactatagcctgggcaacagagcgagactccgcctcaaaaa

SEQ ID NO: 81 - DNA, 4041 bp, Homo sapiens
aattccataggaatccaagctccacagctaggagacagtgggcactgaggatgaggctgtttgcaggcaaatggtctggtggacctattagaggaccatgtggctgtgcagaccctggactgcagatagagggtattcactctaagatagtgtaggagggctcttgcccaacaagcaatcaccctgtctgccatataaaaggagcagctgctgctgctgccacacagctcaggaatgatgtttcctgggtggtggtttgtgggggcaggaaccagacatagactttgagagcctgacttacgtccctaagctccttctgctcctccctggctgctctgagagcatcacactccttcctccaatacaatcagcttccgcagttcccattcttgagctgcttctgtagcttgcttcttctctcccacctgtccttggcacccacgtgaccgactgacccacacagactttgtgtattgcaacatcttatctgcatatcacttctcatccaagcaatcatctaccactttggccaggataagataaagggagttatccttcaagtttagccacttcaggccttaatttttttttgagatggggtctgactctgttgcccaggctcaagtgcagtgatgctgcaacctaaactctaggcctcaagtgactctcccgcctcagcttcccaaagtgttgggattacaggtgtgagccactgcgcctggtccacttcaagttcttaagctgagccaagtgacaggcagggggaccagtcttttgaggagacccaggtgctagagactcaatggatggccattcttcaccagcagccgttgcaaagtgtttctactgaggtctaggctccccgggcttgtgaggccacagaaatctaagggcagtactgcaggacaggtccagtatggtggtcttggcaggagggagcagcagctctttgagaggaacctcactcaggtccaactcactgtggagactccccatccttgctactggcccttgtcatagtgatgctggtcgaatgagccctgtctcaaagactctgacaggcagaaaaaggctcagaggccacttatttgttcagtgtatacatgaacaatgtgggtgccctctgccactgccactgccactgccaccaccatcaccacattgacctttggtatttggttatgctggtctcatcaaatgagttaagaaatgtttgatgcccaggcgcggtggctcatgcctgtaatcccagcactttgggaggccgaggtgggcggatcacctgaggtcaggagttcgagaccagcctggctagcatggtgaaacccctttctacgaaaaatacaaaaaattagccaggcgtggtggcgtgtgcctgtaatcccagctactagggaggctaaggcaggagaatcgcttgaacctgggaggtggaggttgcagtgagccaagatcgcgccatggcactccaatctggtgacagagagaaactctgtctcaaaaaaaaaaaaaaaaaaaaggtttaattgaacaggaaaagaaagtgtggtagctgacaggggaaataaggtcaaaggaaagtttcaagatagaaagacactattatttccccctatgctgaagaacatctagtagagatggaaatcaataatgcagcaaagatgttgggaggaggtggcttctgctaggagcaagaacactgttcacagcactatgggagaaggcagcccctgtgggcccagagggtcgctcaaggaaattagctattgattgcttttattttcctggtcaaatacacaggaagagcatcttacctgagagtgaatatggggaaggaaatactgtaagtttgaggagataaggtataattagttttctaagagagtaggacagtgcagacactaagtatatatagtacgactgataagcagcatgaacaataaaccaggttcaaatactcactgagttgcaggcatttgcacgttctattttagaaagacccttcaattcggtatcaaatacattcatcttctctactaggcaagtgagagcagtctctgtagcttctccaactttttcatacacaccctttgcctgtattggttaaaggcacagaaagtagaaaaaagggagaagtacacagataaatttatctttaatattttttttccacaaaagcacaatctgtcctctattacaacactgtaaggccatttttatcctcctctgaaacaggtgacccagataattaaaaacatactcaaagtacaggtgtgcatgtgatcttattctaataagtaggtttttcatttcccttaaatataagatgacatcaaacacagtatttattatttcacccaaatataagaagccactgatcacactattaattcaaagagtgccttcacataataatgtaattccatgtcactgcttatcattctgaagagttcacattctgtctctgacagggactagcttacctttgagacagaaactatatcctttgctttcaggaaagcattttctatcctgggttttattcatttatagtaagtatgctatcaacagaaagaacatcacatatactacaactttaagttaactaactgcaatgctcagtcacagaggatatgtgaaaggctctcagctttctttggtgaggtcatgctggccccaccatcaggttctgaatggaagggggaaacaaaatcaggcacccttgactttcaaaagggaggaaggcaggctagactttcattccacccaccccacccttgaactaggaacagccattccttctaatttatgaagagacttacctcattgtaatccaaagcagagtcattacaaagagcacaaattgttgctaattctaccagaccatcatactggtgacaattcactggtttatcatctttatgcctgcccaaagagaaaacactcttagagcagggtatggtcgccactattgattcctcccgccccctgcccccccgcaattgtttaataatgaaaacagaatttctgggacaacatactggaaaaaattccaaacaatttgatgccagagccaatattagacaaaaacaaaagagagaatgcatctctggtatcagaaatcaatcagtaaaaagaccagaaattcttaattcaattcttccaccactggctacagtgaataacaaacacaaatccctcttgaaagtttggagcccagaagatgcaaaaagatgactggattataacctttggttcatctttcaaagtttttgttttaaaaacatttactactttagtaataagtgttgacttgagccacattcagaaagctgtcttaactttgtagacatgctgcaaatcaatacaaatactaaactgccacaccagatcctttaaatgaggaggagggttactcacacttctccaataggtgcataagttgatccagttatggtaaactcattaagggaacaagtatcaccttccactctgtccagaatgaacatctgtagggggagagcgcatcagagtatttaaaagggatttttaaaaaatgctacacaaataaactacctttgttagcttaggacaaaggcaaacaacctctttcatttacgaaaacaactttaataaaactcactgaggctcactcagcatcagcagtactgtcccttaccctaactagcttaattatattagactgcttcgcccatcacacccccgaccaatcgaacagtatgaaaaacagcatcactgaggtgctgaatgaatgagcagcagtggcaccaaagacacaacaacccacacaaaatccaagttatgaggactcccggtcagcaaaaggtcagttccagagacaagttactctttagattgctcagaatcccaaatttcaaatggctggctgtgagagtggtattaggtagtcctgccttagagctaagcacaaaagcttgggaagaataaactcacatttcagagttgcataaacatttcccgagtaaaataagacaaactgcttctctgctccttcccact

SEQ ID NO: 82 - DNA, 4046 bp, Homo sapiens
ctacagacacaaaaacagcactcccatgtttttaatatttttgctaaattccaacttcagttacctctgggggagaggagagtacacttatagtatgtttcaaaactaagatttttttttaaaagagaagaaagtaaatttaacataatgtatctgggtgaaaatcaggtgaggggaagaatactggaaatgcttcatcaatagccagctcttaaagaacttaaaagcagggtgatccaaacaactgactgattacatcctcaattttcagaaaacttacaataaaaacacgtctcatttaaaaaagagactagatcaccagattgttcctctgggactgatctggaaggcccttctgggttttaaacgactctaggatcttccctgcaagtagcacacaacatgctaaccactgattcaccgaattctagagaaaagacccaaatcatgacaaattccaaattagggagctatgacaaaaaaattcagtggtcaaaattagaggctactatgtgcttgtgtagcctgagtcacctgtacatgttcaaacatgctcaccatagctgtaatctcatcaaaagactgaagaaattctacgattttagacttgtgggagggttcaactcgagcaaaacagcgggcgttcaggcaggcgtctcgctgggcggaggggttgagttcatcaaactcccggcctgtgaaagcttttgacgtcacgtcctcatcctgcccgaagatgccgatgcggcgacagatggccacagcagtgcccttgttgtccccagtgatcatgatgacccggatgcctgcttgccggcacagcttcacggaggaggccacctcgattctcggaggatccagcatgcccacgcagccaacgaaggtcagattggtctaaaataagagcatcactttaaataaaagtggcaagttctagtttttgtcccctagtttgaaaaatgcccagttaaacattgagacaggtttctgcattttttttctttttttttttttgaggcggagtttcgctcttgttgcccaggctggagtgccatggcgcaatctcagctcactgcgacctccgcctcccaggttcaagagactcttctgcctcagcctccagggtagctgggactacaggtatgcgccaccacacctggctaattttgtatttttagtagagatgtggtttctccatgttggtcaggctggtctcaaacccccaaccccaggtgatctgccagcctcggcctcccaaagtgctgagattacaggcatttgagccaccgtgcctggcggtttttgcattttcttatgagaaaaaaaaataccactacacccgttatcaaaccattctttaactcttgtgctattctgagcccacagtaccaaagcttcttcattttgttcatagctttaggatgtcacatccttgatataaaagaattctactctgagtagaaaagtggaagtaatctccaacttggatcttttgaccttcagtaactaatgaatattctagaaatgtcaccaatttaaaaaaaatcatgatttagatgagaggcaaaatggggtttacaagcttaagctcatcttgattattctactttgaaaatattctactttgaaaataacacttttatgaaattattaactatgtatgtttgaagcagcaaattttaagggtgacacagctggcaggcagaaaaacaaataaccacacctctttcttggcaaaagtgagaactgtttgaccttttgcttgaaggagtactgtttaaacacaatgaatcgtgcagggtgtggacaaagaaacttttcattagctaacctcatatttaataaagttggcagagtcctcaaggtgcatttcttctcttctcagtgggttgtcatgagtggccagggccaggcatcgcagtgtgtcgctgccactaccccactctcgaatgacagacatgatcttctgtttgactccagaggtcataggaaccttagtacttccaactcgaatgtgggtgcacctgtcaatgacaccttcaggagcaccctggaaatgttacagatttagataaacaattttgttttattggttcaccgggatcttaaccctggcaagaacatctcaattgcaatctgccatacttgccttcacaaacatcttgctcattgatgtcctgcttggtttatttggtgtacagtaaaccgacattgactttctgtcacgtgaaaactctagagtgaattcctttttcatcagctgtttaatgacctacaaagggaacaaatatggatactactgggtggcaatttctgaacttttttacctaacaagcagtaagcacacctattacatgacagatgctaggaatatagcaataaacaaaacagacaggtttttgccctcatgaaacttgtcccctattttgggagagacagactaagatgcaaaagtaacacaagtgctatagagaaaaagggaagggggatagaaaatttgcatacatacatatgaactgttacataaagtggccagaaggcggtgacatttgaataaagatggccccatggggcctgaaaagatgtgtgtgaacccagtgggtggtggtgaagacccaccaggcagagaacggaagtgcaacctggcaagtcctggaatggtaaaggagtgccaacgtggctggaatagagtttacatgagcaaaaggtgaggcaggtaatggcagaggatggtagaagcaggtcattaagacctcaaaagtcattatggggcatttggcttttaagacaagtaaaacagaagacaacggagggtctcaagctccagttgtcaagaattggctgaaggtggtcgggtgcagtggatcacctgaggtcagcagttcatgaccagcctggccaacatggtgaaaccctgtctacaaaaattagctaggtgtggtggcaggcacctgtaatcccagctactcaggaggccgaggcaggagaactgcttaaagccaggggggcagagattccagtgagatgagattgcgccacttcactccaccctggacgaaagagcaaactccatctcaaaaaacaaaagcattggctgaagggagacaaggaataccattcagtataatgacactgacttaaactagggaacgttggaggtgaagagatggccccaagcagagctgtccaccagaactctgtgaaagatggcaatgctctgtggccactgttcatgtggctgtcacacgtgatggataagcactttaagtgaatatggctagggcatctaaggaagtgtttttaggtattctaagtagttttagatagctagtggctactgattatagtaatgagaccagaagagatcatgggagtaactatagacagaaatggctgaggactatggagccttcacctcctggtgccttgtgaaagacccagctacaaagacctcgaatgagaggccagggagggagagcaagtatgggatcgtggaagccaagtgaagaggtgcttcaaagagggagcgagtgacagcaccaacaaaataggaagacgaagactgagaataaacctttggctttatatcgttacctacaactaaagataccccttctcttccagtttttgtacttttcttgcctattacacagaccaggaatgccagtataatactgcatagaaatggtgagaattctgttatgttagcatggtctctgtgtaaacacactgtcagcgttaaagacacacttttatagtcttagtttggtgtgataagatgcgtttcatcatatgcacctactgaggtgaccttattgttttttccaccttaatttggttaatgtggtgagttaattatatttgctcccactgacacacatttaaaaatcatcatagaaatccccaagaacatcagcatctaacctaggaagctacgggaggactgaaggctgatgaactgactagatggggctcagggccctgcagcgatcctgctggcctgccagccactgaaccgtctcaggcagcaaaggaatgggtatgag

SEQ ID NO: 83 - DNA, 4045 bp, Homo sapiens
gtggaggggacagtgagctgagatcgtgccactgcccgaagcctgggcgacagcgagactgtctcaaaaaaataaataaaaataaaaaaattattaagctgactgagataaagccaacttttggagggcaagaatttcatgtgactacctggttaatgttagctcagtctcacgttaaagaggattctttgcacattggggcagctgcagacaaccctcccgagggccaaagcaccactgcttccataaggcatttctgtcttgcccactcccctcttccaactcaggcacaaagaccaaagctgctgcaatctggagagcaaactgcgagaactgggctccatgacccatttagataaaggcgtacagtaagtgatgctgtcacagagacctaccagacaacttccccgacgttggacgagatgaggtagcggatgaactgtttcatgttgttgtagattgcccgcccctcctcaacggcagccacaatggtggagaagttgtcatccgccaggaccatctcagaggcggttttagccaccgcagtgccagagcccatagcaatgccaatctcggctttcttcagagcaggagcatcgttcacgccatcgccagtctgaaagggaaagcaatggttgggtcagccaactggcatgccacattcatacccctaggcaaaagcccactgaatgggaagcaggaggaaaatgaatagagccgtaggtctcttggcaaagagttttagaatttttgtttcataagttggtgtcacaaaacacattttacctaggaaatgtaaaattaccaaataagtttaccgaagtgggacaaaggggacttcaaatttatctgtattatcttactaaaaacaaaaacacaacctatgtggcagtcaagaggaagcacttgtatccacatggataaatttcaagtagaaagatgcagattgcaaaaatatgcaaatttttatttttctgagatggagtcccgctctgtcgcccaggctgtagtgcagtggcgcagtctcggctcactgcacgcctcctgggttcaagcgattctcctgcctcaatctcccgagtagctgggattacaggcgcccaccaccacacccagcaattttttgtatttttagtacagacggggtttcaccatgttggccaggctggtcttgaactcctgaccccaagtgattcacctgcctcggcctcccaagtgttggggttacaggcatgagccactgcactcggccaaaaaatatgccttcaaaagcatgcaaaaataatactgtctacagacacaaaaacagcactcccatgtttttaatatttttgctaaattccaacttcagttacctctgggggagaggagagtacacttatagtatgtttcaaaactaagatttttttttaaaagagaagaaagtaaatttaacataatgtatctgggtgaaaatcaggtgaggggaagaatactggaaatgcttcatcaatagccagctcttaaagaacttaaaagcagggtgatccaaacaactgactgattacatcctcaattttcagaaaacttacaataaaaacacgtctcatttaaaaaagagactagatcaccagattgttcctctgggactgatctggaaggcccttctgggttttaaacgactctaggatcttccctgcaagtagcacacaacatgctaaccactgattcaccgaattctagagaaaagacccaaatcatgacaaattccaaattagggagctatgacaaaaaaattcagtggtcaaaattagaggctactatgtgcttgtgtagcctgagtcacctgtacatgttcaaacatgctcaccatagctgtaatctcatcaaaagactgaagaaattctacgattttagacttgtgggagggttcaactcgagcaaaacagcgggcgttcaggcaggcgtctcgctgggcggaggggttgagttcatcaaactcccggcctgtgaaagcttttgacgtcacgtcctcatcctgcccgaagatgccgatgcggcgacagatggccacagcagtgcccttgttgtccccagtgatcatgatgacccggatgcctgcttgccggcacagcttcacggaggaggccacctcgattctcggaggatccagcatgcccacgcagccaacgaaggtcagattggtctaaaataagagcatcactttaaataaaagtggcaagttctagtttttgtcccctagtttgaaaaatgcccagttaaacattgagacaggtttctgcattttttttctttttttttttttgaggcggagtttcgctcttgttgcccaggctggagtgccatggcgcaatctcagctcactgcgacctccgcctcccaggttcaagagactcttctgcctcagcctccagggtagctgggactacaggtatgcgccaccacacctggctaattttgtatttttagtagagatgtggtttctccatgttggtcaggctggtctcaaacccccaaccccaggtgatctgccagcctcggcctcccaaagtgctgagattacaggcatttgagccaccgtgcctggcggtttttgcattttcttatgagaaaaaaaaataccactacacccgttatcaaaccattctttaactcttgtgctattctgagcccacagtaccaaagcttcttcattttgttcatagctttaggatgtcacatccttgatataaaagaattctactctgagtagaaaagtggaagtaatctccaacttggatcttttgaccttcagtaactaatgaatattctagaaatgtcaccaatttaaaaaaaatcatgatttagatgagaggcaaaatggggtttacaagcttaagctcatcttgattattctactttgaaaatattctactttgaaaataacacttttatgaaattattaactatgtatgtttgaagcagcaaattttaagggtgacacagctggcaggcagaaaaacaaataaccacacctctttcttggcaaaagtgagaactgtttgaccttttgcttgaaggagtactgtttaaacacaatgaatcgtgcagggtgtggacaaagaaacttttcattagctaacctcatatttaataaagttggcagagtcctcaaggtgcatttcttctcttctcagtgggttgtcatgagtggccagggccaggcatcgcagtgtgtcgctgccactaccccactctcgaatgacagacatgatcttctgtttgactccagaggtcataggaaccttagtacttccaactcgaatgtgggtgcacctgtcaatgacaccttcaggagcaccctggaaatgttacagatttagataaacaattttgttttattggttcaccgggatcttaaccctggcaagaacatctcaattgcaatctgccatacttgccttcacaaacatcttgctcattgatgtcctgcttggtttatttggtgtacagtaaaccgacattgactttctgtcacgtgaaaactctagagtgaattcctttttcatcagctgtttaatgacctacaaagggaacaaatatggatactactgggtggcaatttctgaacttttttacctaacaagcagtaagcacacctattacatgacagatgctaggaatatagcaataaacaaaacagacaggtttttgccctcatgaaacttgtcccctattttgggagagacagactaagatgcaaaagtaacacaagtgctatagagaaaaagggaagggggatagaaaatttgcatacatacatatgaactgttacataaagtggccagaaggcggtgacatttgaataaagatggccccatggggcctgaaaagatgtgtgtgaacccagtgggtggtggtgaagacccaccaggcagagaacggaagtgcaacctggcaagtcctggaatggtaaaggagtgccaacgtggctggaatagagtttacatgagcaaaaggtgaggcaggtaatggcagaggatggtagaagcaggtcattaagacc

SEQ ID NO: 84 - DNA, 4046 bp, Homo sapiens
gggcgttacacatttctatagttactagaacagagagcgccattgtcatcgggtatggggattcaaagattgcacaatccacgccttcaaagtccgggttgtcctctttacactgtaggaaatgactctgcaagaaaatccaatcaaattcctatcagcccagtatatttcccaagtccaggctccaaccccataccaagcctagcacagaccagcctgaatgcagagccagccaagaggtttaccccaatttctcggagaagccctggtccttcagaatcatcttagatgtaactgtttattgtctgagtcttaagatgatttgatagataccgaaaccacagaaaggtcaaggcctcacaacacttctcatgtaaggtacagaaagaaaggtgactgagtaccagctggtagaaggacactcttggaccaccgtcagcagcaatgaaccaccatgcagcagcacccacggtagcagcgccgacgtaacctgggaacaaacacagtgatgctgatgcacttgcctctgcagggctcgctgccaccgaggccatgcaggccagtccccacaaggacgaagatcaaagacatgggacagtgatggtaaccggggcctgtggtgctaccaccacctgctcacgcctggtagccagagcaactagaccctggtttctgaaggacaggggtgtttctagaacagaagaactggataacttttcctccagaatgtgtgagaaaaagcacttgctccatcctgtgccaacctttccccttgccgtgccttctcccctcagtgggtagtacttcaaggctgcaagtgtgtgtgtactccatgtaaggctgcacagtttgagggactagattacaccaggacttttggacaaactattgctgcctagttgtacacagatttatttgctccattagaggcccagcagcagttttctagggaaatgctgtcaggagctagggtggaacactgagcagcatggccctgccctcagcagcttctgggattccccccagtattagctttgagttcaggaagtttattgcaaagaagcaacaaggtgcagcagagaatacacagagttcagacgaggcaaatatccccatgtggtagcatcaaaaacaacaagtgcatatacccactaacccacgaattacagtggagcatgaaggccgctggctgcaaggatgaggcactacgcatgtccggatatggaaggatctgacaagcaggaagaaggcaagacaagggtcaacatgcaggtgtgcacagcatgctggaatctctccggaagggcacagggtacatgagcacctcaacgccagagggaagtgactggcccaaaccctttccattctatgccattgtgtgctttttgaatttgaagtcatgtgaatatattatgaaaacacaatgccttcctatgggatcccagggaagtgatttcacctcactttcccaatctatgaaatggggaagaacccggggtgaggaagatgagggctaaagagatgatttatatataaaagggaccagccactgcgcaacccttctcttatggaaacagggactaaattttataacttggtgacaattatctatttaaatcccacctatgaactcttggaaggcagaacctagcgtgaatcattcttatccctttgcacagagggctcaatctgaaaaccctgatgtttaattgctcattcagaaaagcccaagtaagggcaggatgctaaaactggaactaactgtgaaaggactctggtaaattggatgtatagttcatcgaactgtaagagggcatctctgtcttttgctaccctatacggggatagaagaaaaaacacgcttttaagggatgaatttacaaaatttcagctcacaaacattttgtttaaaaatcagtaatataaaaaaattgtactcacagccaatagccaagtaacggaaaaagagccacccgctgatcaatggttcctttgggttccggggaggtttattcatgatgtccagatcaggagggttgaaccccagtgcagtggcaggcaggccatctgtcaccagattgacccagagcagctgaacaggaatcaaagcctcgggaaatccaagggctgctgtcaggaaaatactgtttccaatcaagaaaagaagacaaagagagcccaaatgacttctggccactatttaaagagcatcatcaacccgccctcctccagaaaaataaatgacaacaacttcaggtaatctgtaaaatacttatacccaattttgaattaaagctcaattttacttagtttattacttaaattcagatgactgaggccaggtgcggtggcttatgcctgtaatcccagcactttgggaagccaaggtgggcagactggctgagctcagcagttaagagaccagcctgggcaacatggtgaaacctcatttctactaaaacacaaaaaaatggcagggagtggtggcgcatgcctgtaatcccagctgttcgggaggcttgaacccaggaggtggaggggacagtgagctgagatcgtgccactgcccgaagcctgggcgacagcgagactgtctcaaaaaaataaataaaaataaaaaaattattaagctgactgagataaagccaacttttggagggcaagaatttcatgtgactacctggttaatgttagctcagtctcacgttaaagaggattctttgcacattggggcagctgcagacaaccctcccgagggccaaagcaccactgcttccataaggcatttctgtcttgcccactcccctcttccaactcaggcacaaagaccaaagctgctgcaatctggagagcaaactgcgagaactgggctccatgacccatttagataaaggcgtacagtaagtgatgctgtcacagagacctaccagacaacttccccgacgttggacgagatgaggtagcggatgaactgtttcatgttgttgtagattgcccgcccctcctcaacggcagccacaatggtggagaagttgtcatccgccaggaccatctcagaggcggttttagccaccgcagtgccagagcccatagcaatgccaatctcggctttcttcagagcaggagcatcgttcacgccatcgccagtctgaaagggaaagcaatggttgggtcagccaactggcatgccacattcatacccctaggcaaaagcccactgaatgggaagcaggaggaaaatgaatagagccgtaggtctcttggcaaagagttttagaatttttgtttcataagttggtgtcacaaaacacattttacctaggaaatgtaaaattaccaaataagtttaccgaagtgggacaaaggggacttcaaatttatctgtattatcttactaaaaacaaaaacacaacctatgtggcagtcaagaggaagcacttgtatccacatggataaatttcaagtagaaagatgcagattgcaaaaatatgcaaatttttatttttctgagatggagtcccgctctgtcgcccaggctgtagtgcagtggcgcagtctcggctcactgcacgcctcctgggttcaagcgattctcctgcctcaatctcccgagtagctgggattacaggcgcccaccaccacacccagcaattttttgtatttttagtacagacggggtttcaccatgttggccaggctggtcttgaactcctgaccccaagtgattcacctgcctcggcctcccaagtgttggggttacaggcatgagccactgcactcggccaaaaaatatgccttcaaaagcatgcaaaaataatactgtctacagacacaaaaacagcactcccatgtttttaatatttttgctaaattccaacttcagttacctctgggggagaggagagtacacttatagtatgtttcaaaactaagatttttttttaaaagagaagaaagtaaatttaacataatgtatctgggtgaaaatcaggtgaggggaagaatactggaaatgcttcatcaatagccagctcttaaagaactta

SEQ ID NO: 85 - DNA, 4049 bp, Homo sapiens
taagccacttacgagttaaagacaagacagttatttttctctgtccatttaaaatgttttatttttttaaaactagatgacgtgccactgaaataggcaatgttggcaaaacaatgtctgttacaataaaatacattagacatttaaataaataaccttaaaaactatgtgaagggacataaacccagtcgattgaatctggaacaatgttttctgcacaagcgagtacaggcatacctctcgttaaaactgatgtaaacagaacgaaccatcacaatcctaaagaagaagccaagcggggcgggggtaaggtggggagaggtggggtggggtggggtgaacggaggccaaagtgggtgagggaagtagcaaaccaaaacaatactgactgaggtagcaagactctgctcagtgcagaaaaattggcttatgaataaaaattagactgtgatatcaaattaaatccggatcatcatgcaaaagacacaatacatgctatttagttttagaaaaaaaaccacacacattcatttcctaaaatctgctgccaattaatttgctgacaatgtctgctggctcaactattttttttatacaaggatgagtattaaacagaacactgtacatgctttttcatctacaaaaaaatatttgcataaaatagtgttagttctctgtacatgtcaatggacactttaattatgtgtataaaaaaggaaaatcttgccccactggagtcagaaaaagcaaaacaaaatctagagtatgaaacctccatcaccagccagtatgttcatgtgaaaattcagcagaaatagacagttgctttaaacaataaaaaaattaattgattaagttaaacatcttctttatggaaaactgtcagtcaagaccagaacatatcgctaaagttagtgtctgtgctatagacccagatcaccaggggcattatgagcagcacaaacggccaggaaatcccatcggtgcatgccgagaacgagcaggatttggtggcaggctgcacacactctttaccaggttccaggtagttgcgggccacaaacttgagcgtctcatccatgagaatcacgggcaaggagattttcagcaccatcagccactgggtcacgttcagcggtgtgatctggaagatgagctgacacacagggaagacgtgtcacgcctccagcctcccctggaaggaggtggctggtcccaagccccacccaaccacttactggcaagggttcgacatagaggatcaggaagtggagtgacatggacaggcagatggagcccacgagccagatgttctcccaggggggcatcctcagcaaggactggttttcggacaagctgcagagcaaggagaggtggggaaacgcacccccaaggcaaggcacgtgtcacagtggcagtaagaccctgttggactacacttcagtaaggcggctgttaatgtggcaccatccgctgacctacctccactttctacagtggcaaagttgaagagaatgtcctaatgcaggacaaactgtgaattctgtatctatgttttggcatagcagaccccatcttagtgggttcaaagctgttcccaattgccctggagacttgggctatttagaaatttccatttttgtcacgggcttaactggatggtaccatttgtctgtgtgaaagggtgaggttccttccctgtgggtgctggcatacaggggtaccaaagttcctatttttggcccccacggtttcttttaaggaagagctcctaagaaacacagggctaagcactcccactacttcctggaggtgacgacagctcatgcttttaaaactggtattgcctgttctcctttcttttgggaagggaagaactgtcctgtgatcctcaatcaaccgtgactacacacaattccccggtgccctggcagtcaccatgctcgcctcagcctgccgtgaaggtgcactaacctgttgagggcgttacacatttctatagttactagaacagagagcgccattgtcatcgggtatggggattcaaagattgcacaatccacgccttcaaagtccgggttgtcctctttacactgtaggaaatgactctgcaagaaaatccaatcaaattcctatcagcccagtatatttcccaagtccaggctccaaccccataccaagcctagcacagaccagcctgaatgcagagccagccaagaggtttaccccaatttctcggagaagccctggtccttcagaatcatcttagatgtaactgtttattgtctgagtcttaagatgatttgatagataccgaaaccacagaaaggtcaaggcctcacaacacttctcatgtaaggtacagaaagaaaggtgactgagtaccagctggtagaaggacactcttggaccaccgtcagcagcaatgaaccaccatgcagcagcacccacggtagcagcgccgacgtaacctgggaacaaacacagtgatgctgatgcacttgcctctgcagggctcgctgccaccgaggccatgcaggccagtccccacaaggacgaagatcaaagacatgggacagtgatggtaaccggggcctgtggtgctaccaccacctgctcacgcctggtagccagagcaactagaccctggtttctgaaggacaggggtgtttctagaacagaagaactggataacttttcctccagaatgtgtgagaaaaagcacttgctccatcctgtgccaacctttccccttgccgtgccttctcccctcagtgggtagtacttcaaggctgcaagtgtgtgtgtactccatgtaaggctgcacagtttgagggactagattacaccaggacttttggacaaactattgctgcctagttgtacacagatttatttgctccattagaggcccagcagcagttttctagggaaatgctgtcaggagctagggtggaacactgagcagcatggccctgccctcagcagcttctgggattccccccagtattagctttgagttcaggaagtttattgcaaagaagcaacaaggtgcagcagagaatacacagagttcagacgaggcaaatatccccatgtggtagcatcaaaaacaacaagtgcatatacccactaacccacgaattacagtggagcatgaaggccgctggctgcaaggatgaggcactacgcatgtccggatatggaaggatctgacaagcaggaagaaggcaagacaagggtcaacatgcaggtgtgcacagcatgctggaatctctccggaagggcacagggtacatgagcacctcaacgccagagggaagtgactggcccaaaccctttccattctatgccattgtgtgctttttgaatttgaagtcatgtgaatatattatgaaaacacaatgccttcctatgggatcccagggaagtgatttcacctcactttcccaatctatgaaatggggaagaacccggggtgaggaagatgagggctaaagagatgatttatatataaaagggaccagccactgcgcaacccttctcttatggaaacagggactaaattttataacttggtgacaattatctatttaaatcccacctatgaactcttggaaggcagaacctagcgtgaatcattcttatccctttgcacagagggctcaatctgaaaaccctgatgtttaattgctcattcagaaaagcccaagtaagggcaggatgctaaaactggaactaactgtgaaaggactctggtaaattggatgtatagttcatcgaactgtaagagggcatctctgtcttttgctaccctatacggggatagaagaaaaaacacgcttttaagggatgaatttacaaaatttcagctcacaaacattttgtttaaaaatcagtaatataaaaaaattgtactcacagccaatagccaagtaacggaaaaagagccacccgctgatcaatggttcctttgggttccggggaggtttattcatgatgtccagatcaggagggttgaaccccagtgcagtggcaggcaggccatc

SEQ ID NO: 86 - DNA, 4045 bp, Homo sapiens
taagccacttacgagttaaagacaagacagttatttttctctgtccatttaaaatgttttatttttttaaaactagatgacgtgccactgaaataggcaatgttggcaaaacaatgtctgttacaataaaatacattagacatttaaataaataaccttaaaaactatgtgaagggacataaacccagtcgattgaatctggaacaatgttttctgcacaagcgagtacaggcatacctctcgttaaaactgatgtaaacagaacgaaccatcacaatcctaaagaagaagccaagcggggcgggggtaaggtggggagaggtggggtggggtggggtgaacggaggccaaagtgggtgagggaagtagcaaaccaaaacaatactgactgaggtagcaagactctgctcagtgcagaaaaattggcttatgaataaaaattagactgtgatatcaaattaaatccggatcatcatgcaaaagacacaatacatgctatttagttttagaaaaaaaaccacacacattcatttcctaaaatctgctgccaattaatttgctgacaatgtctgctggctcaactattttttttatacaaggatgagtattaaacagaacactgtacatgctttttcatctacaaaaaaatatttgcataaaatagtgttagttctctgtacatgtcaatggacactttaattatgtgtataaaaaaggaaaatcttgccccactggagtcagaaaaagcaaaacaaaatctagagtatgaaacctccatcaccagccagtatgttcatgtgaaaattcagcagaaatagacagttgctttaaacaataaaaaaattaattgattaagttaaacatcttctttatggaaaactgtcagtcaagaccagaacatatcgctaaagttagtgtctgtgctatagacccagatcaccaggggcattatgagcagcacaaacggccaggaaatcccatcggtgcatgccgagaacgagcaggatttggtggcaggctgcacacactctttaccaggttccaggtagttgcgggccacaaacttgagcgtctcatccatgagaatcacgggcaaggagattttcagcaccatcagccactgggtcacgttcagcggtgtgatctggaagatgagctgacacacagggaagacgtgtcacgcctccagcctcccctggaaggaggtggctggtcccaagccccacccaaccacttactggcaagggttcgacatagaggatcaggaagtggagtgacatggacaggcagatggagcccacgagccagatgttctcccaggggggcatcctcagcaaggactggttttcggacaagctgcagagcaaggagaggtggggaaacgcacccccaaggcaaggcacgtgtcacagtggcagtaagaccctgttggactacacttcagtaaggcggctgttaatgtggcaccatccgctgacctacctccactttctacagtggcaaagttgaagagaatgtcctaatgcaggacaaactgtgaattctgtatctatgttttggcatagcagaccccatcttagtgggttcaaagctgttcccaattgccctggagacttgggctatttagaaatttccatttttgtcacgggcttaactggatggtaccatttgtctgtgtgaaagggtgaggttccttccctgtgggtgctggcatacaggggtaccaaagttcctatttttggcccccacggtttcttttaaggaagagctcctaagaaacacagggctaagcactcccactacttcctggaggtgacgacagctcatgcttttaaaactggtattgcctgttctcctttcttttgggaagggaagaactgtcctgtgatcctcaatcaaccgtgactacacacaattccccggtgccctggcagtcaccatgctcgcctcagcctgccgtgaaggtgcactaacctgttgagggcgttacacatttctatagttactagaacagagagcgccattgtcatcgggtatggggattcaaagattgcacaatccacgccttcaaagtccgggttgtcctctttacactgtaggaaatgactctgcaagaaaatccaatcaaattcctatcagcccagtatatttcccaagtccaggctccaaccccataccaagcctagcacagaccagcctgaatgcagagccagccaagaggtttaccccaatttctcggagaagccctggtccttcagaatcatcttagatgtaactgtttattgtctgagtcttaagatgatttgatagataccgaaaccacagaaaggtcaaggcctcacaacacttctcatgtaaggtacagaaagaaaggtgactgagtaccagctggtagaaggacactcttggaccaccgtcagcagcaatgaaccaccatgcagcagcacccacggtagcagcgccgacgtaacctgggaacaaacacagtgatgctgatgcacttgcctctgcagggctcgctgccaccgaggccatgcaggccagtccccacaaggacgaagatcaaagacatgggacagtgatggtaaccggggcctgtggtgctaccaccacctgctcacgcctggtagccagagcaactagaccctggtttctgaaggacaggggtgtttctagaacagaagaactggataacttttcctccagaatgtgtgagaaaaagcacttgctccatcctgtgccaacctttccccttgccgtgccttctcccctcagtgggtagtacttcaaggctgcaagtgtgtgtgtactccatgtaaggctgcacagtttgagggactagattacaccaggacttttggacaaactattgctgcctagttgtacacagatttatttgctccattagaggcccagcagcagttttctagggaaatgctgtcaggagctagggtggaacactgagcagcatggccctgccctcagcagcttctgggattccccccagtattagctttgagttcaggaagtttattgcaaagaagcaacaaggtgcagcagagaatacacagagttcagacgaggcaaatatccccatgtggtagcatcaaaaacaacaagtgcatatacccactaacccacgaattacagtggagcatgaaggccgctggctgcaaggatgaggcactacgcatgtccggatatggaaggatctgacaagcaggaagaaggcaagacaagggtcaacatgcaggtgtgcacagcatgctggaatctctccggaagggcacagggtacatgagcacctcaacgccagagggaagtgactggcccaaaccctttccattctatgccattgtgtgctttttgaatttgaagtcatgtgaatatattatgaaaacacaatgccttcctatgggatcccagggaagtgatttcacctcactttcccaatctatgaaatggggaagaacccggggtgaggaagatgagggctaaagagatgatttatatataaaagggaccagccactgcgcaacccttctcttatggaaacagggactaaattttataacttggtgacaattatctatttaaatcccacctatgaactcttggaaggcagaacctagcgtgaatcattcttatccctttgcacagagggctcaatctgaaaaccctgatgtttaattgctcattcagaaaagcccaagtaagggcaggatgctaaaactggaactaactgtgaaaggactctggtaaattggatgtatagttcatcgaactgtaagagggcatctctgtcttttgctaccctatacggggatagaagaaaaaacacgcttttaagggatgaatttacaaaatttcagctcacaaacattttgtttaaaaatcagtaatataaaaaaattgtactcacagccaatagccaagtaacggaaaaagagccacccgctgatcaatggttcctttgggttccggggaggtttattcatgatgtccagatcaggagggttgaaccccagtgcagtggcaggcaggc

SEQ ID NO: 87 - DNA, 4042 bp, Homo sapiens
ggaagtggcctatttaagacgaacctatcgatacccagagttcactggttcagttacttgctttcactagtttttagctttttaataaataagtagcaatgttctgggatgactcctggcagctgcgaaccctcattttagcaatagtctgcacagctccttcagcctgttggtctggctgaaatgcctctctccccactccggcttttgtctggcttgggccctcctggtcatcttgtcctaggcagcctgtggaggtctatgaaagccacacctccagccagctgatgctgcgcccgagtcacatggcaggcgccacaggcaaccccggtgctcacagggcatcagggagcacagcagcatctgccatggaggcggcttataagttagtgacatacagttatctcacttggtggcagtcacctttaggctaaagcatccaaatcccaggaagaaaatactcacgttagttgatggatgttggaaggcattggaggaaaacaccacagttaggactgttaatgacttacacactgttggtgagactcatctcgaacatgcgcaaacattgatcgtagtaacggtggtggtggttagtgccacattcaaataaaaatagttctatacaatatgttcatttggtcatgtgctatttacagattttacaaaacacacacatacacacacatacacacttgcccttatgttctctataccaggccagcagaaacttgcataaaatgtacatcacagatgacaattagtgcctgtacattaagaatacaattcctatgactacctacacagcagagcaggagccttcttcccctcaagcagagtacaactaaagttctgagctaagaactggagagaaagttggacatgtctgttagtcccaggtaagccacttacgagttaaagacaagacagttatttttctctgtccatttaaaatgttttatttttttaaaactagatgacgtgccactgaaataggcaatgttggcaaaacaatgtctgttacaataaaatacattagacatttaaataaataaccttaaaaactatgtgaagggacataaacccagtcgattgaatctggaacaatgttttctgcacaagcgagtacaggcatacctctcgttaaaactgatgtaaacagaacgaaccatcacaatcctaaagaagaagccaagcggggcgggggtaaggtggggagaggtggggtggggtggggtgaacggaggccaaagtgggtgagggaagtagcaaaccaaaacaatactgactgaggtagcaagactctgctcagtgcagaaaaattggcttatgaataaaaattagactgtgatatcaaattaaatccggatcatcatgcaaaagacacaatacatgctatttagttttagaaaaaaaaccacacacattcatttcctaaaatctgctgccaattaatttgctgacaatgtctgctggctcaactattttttttatacaaggatgagtattaaacagaacactgtacatgctttttcatctacaaaaaaatatttgcataaaatagtgttagttctctgtacatgtcaatggacactttaattatgtgtataaaaaaggaaaatcttgccccactggagtcagaaaaagcaaaacaaaatctagagtatgaaacctccatcaccagccagtatgttcatgtgaaaattcagcagaaatagacagttgctttaaacaataaaaaaattaattgattaagttaaacatcttctttatggaaaactgtcagtcaagaccagaacatatcgctaaagttagtgtctgtgctatagacccagatcaccaggggcattatgagcagcacaaacggccaggaaatcccatcggtgcatgccgagaacgagcaggatttggtggcaggctgcacacactctttaccaggttccaggtagttgcgggccacaaacttgagcgtctcatccatgagaatcacgggcaaggagattttcagcaccatcagccactgggtcacgttcagcggtgtgatctggaagatgagctgacacacagggaagacgtgtcacgcctccagcctcccctggaaggaggtggctggtcccaagccccacccaaccacttactggcaagggttcgacatagaggatcaggaagtggagtgacatggacaggcagatggagcccacgagccagatgttctcccaggggggcatcctcagcaaggactggttttcggacaagctgcagagcaaggagaggtggggaaacgcacccccaaggcaaggcacgtgtcacagtggcagtaagaccctgttggactacacttcagtaaggcggctgttaatgtggcaccatccgctgacctacctccactttctacagtggcaaagttgaagagaatgtcctaatgcaggacaaactgtgaattctgtatctatgttttggcatagcagaccccatcttagtgggttcaaagctgttcccaattgccctggagacttgggctatttagaaatttccatttttgtcacgggcttaactggatggtaccatttgtctgtgtgaaagggtgaggttccttccctgtgggtgctggcatacaggggtaccaaagttcctatttttggcccccacggtttcttttaaggaagagctcctaagaaacacagggctaagcactcccactacttcctggaggtgacgacagctcatgcttttaaaactggtattgcctgttctcctttcttttgggaagggaagaactgtcctgtgatcctcaatcaaccgtgactacacacaattccccggtgccctggcagtcaccatgctcgcctcagcctgccgtgaaggtgcactaacctgttgagggcgttacacatttctatagttactagaacagagagcgccattgtcatcgggtatggggattcaaagattgcacaatccacgccttcaaagtccgggttgtcctctttacactgtaggaaatgactctgcaagaaaatccaatcaaattcctatcagcccagtatatttcccaagtccaggctccaaccccataccaagcctagcacagaccagcctgaatgcagagccagccaagaggtttaccccaatttctcggagaagccctggtccttcagaatcatcttagatgtaactgtttattgtctgagtcttaagatgatttgatagataccgaaaccacagaaaggtcaaggcctcacaacacttctcatgtaaggtacagaaagaaaggtgactgagtaccagctggtagaaggacactcttggaccaccgtcagcagcaatgaaccaccatgcagcagcacccacggtagcagcgccgacgtaacctgggaacaaacacagtgatgctgatgcacttgcctctgcagggctcgctgccaccgaggccatgcaggccagtccccacaaggacgaagatcaaagacatgggacagtgatggtaaccggggcctgtggtgctaccaccacctgctcacgcctggtagccagagcaactagaccctggtttctgaaggacaggggtgtttctagaacagaagaactggataacttttcctccagaatgtgtgagaaaaagcacttgctccatcctgtgccaacctttccccttgccgtgccttctcccctcagtgggtagtacttcaaggctgcaagtgtgtgtgtactccatgtaaggctgcacagtttgagggactagattacaccaggacttttggacaaactattgctgcctagttgtacacagatttatttgctccattagaggcccagcagcagttttctagggaaatgctgtcaggagctagggtggaacactgagcagcatggccctgccctcagcagcttctgggattccccccagtattagctttgagttcaggaagtttattgcaaagaagcaacaaggtgcagcagagaatacacagagttcagacgaggcaaatatccccatgtggtagcatcaaaaacaacaagtgcatatacccactaacccacg

SEQ ID NO: 88 - DNA, 4042 bp, Homo sapiens
aaggagtaagctggtttttgggctgtgcagagccacgtcctactaactgtgctttaacatcccctgcagagctaagtcttagccaccaaggacaagaccaagcaagggggggtgggggagtggggaagtggcctatttaagacgaacctatcgatacccagagttcactggttcagttacttgctttcactagtttttagctttttaataaataagtagcaatgttctgggatgactcctggcagctgcgaaccctcattttagcaatagtctgcacagctccttcagcctgttggtctggctgaaatgcctctctccccactccggcttttgtctggcttgggccctcctggtcatcttgtcctaggcagcctgtggaggtctatgaaagccacacctccagccagctgatgctgcgcccgagtcacatggcaggcgccacaggcaaccccggtgctcacagggcatcagggagcacagcagcatctgccatggaggcggcttataagttagtgacatacagttatctcacttggtggcagtcacctttaggctaaagcatccaaatcccaggaagaaaatactcacgttagttgatggatgttggaaggcattggaggaaaacaccacagttaggactgttaatgacttacacactgttggtgagactcatctcgaacatgcgcaaacattgatcgtagtaacggtggtggtggttagtgccacattcaaataaaaatagttctatacaatatgttcatttggtcatgtgctatttacagattttacaaaacacacacatacacacacatacacacttgcccttatgttctctataccaggccagcagaaacttgcataaaatgtacatcacagatgacaattagtgcctgtacattaagaatacaattcctatgactacctacacagcagagcaggagccttcttcccctcaagcagagtacaactaaagttctgagctaagaactggagagaaagttggacatgtctgttagtcccaggtaagccacttacgagttaaagacaagacagttatttttctctgtccatttaaaatgttttatttttttaaaactagatgacgtgccactgaaataggcaatgttggcaaaacaatgtctgttacaataaaatacattagacatttaaataaataaccttaaaaactatgtgaagggacataaacccagtcgattgaatctggaacaatgttttctgcacaagcgagtacaggcatacctctcgttaaaactgatgtaaacagaacgaaccatcacaatcctaaagaagaagccaagcggggcgggggtaaggtggggagaggtggggtggggtggggtgaacggaggccaaagtgggtgagggaagtagcaaaccaaaacaatactgactgaggtagcaagactctgctcagtgcagaaaaattggcttatgaataaaaattagactgtgatatcaaattaaatccggatcatcatgcaaaagacacaatacatgctatttagttttagaaaaaaaaccacacacattcatttcctaaaatctgctgccaattaatttgctgacaatgtctgctggctcaactattttttttatacaaggatgagtattaaacagaacactgtacatgctttttcatctacaaaaaaatatttgcataaaatagtgttagttctctgtacatgtcaatggacactttaattatgtgtataaaaaaggaaaatcttgccccactggagtcagaaaaagcaaaacaaaatctagagtatgaaacctccatcaccagccagtatgttcatgtgaaaattcagcagaaatagacagttgctttaaacaataaaaaaattaattgattaagttaaacatcttctttatggaaaactgtcagtcaagaccagaacatatcgctaaagttagtgtctgtgctatagacccagatcaccaggggcattatgagcagcacaaacggccaggaaatcccatcggtgcatgccgagaacgagcaggatttggtggcaggctgcacacactctttaccaggttccaggtagttgcgggccacaaacttgagcgtctcatccatgagaatcacgggcaaggagattttcagcaccatcagccactgggtcacgttcagcggtgtgatctggaagatgagctgacacacagggaagacgtgtcacgcctccagcctcccctggaaggaggtggctggtcccaagccccacccaaccacttactggcaagggttcgacatagaggatcaggaagtggagtgacatggacaggcagatggagcccacgagccagatgttctcccaggggggcatcctcagcaaggactggttttcggacaagctgcagagcaaggagaggtggggaaacgcacccccaaggcaaggcacgtgtcacagtggcagtaagaccctgttggactacacttcagtaaggcggctgttaatgtggcaccatccgctgacctacctccactttctacagtggcaaagttgaagagaatgtcctaatgcaggacaaactgtgaattctgtatctatgttttggcatagcagaccccatcttagtgggttcaaagctgttcccaattgccctggagacttgggctatttagaaatttccatttttgtcacgggcttaactggatggtaccatttgtctgtgtgaaagggtgaggttccttccctgtgggtgctggcatacaggggtaccaaagttcctatttttggcccccacggtttcttttaaggaagagctcctaagaaacacagggctaagcactcccactacttcctggaggtgacgacagctcatgcttttaaaactggtattgcctgttctcctttcttttgggaagggaagaactgtcctgtgatcctcaatcaaccgtgactacacacaattccccggtgccctggcagtcaccatgctcgcctcagcctgccgtgaaggtgcactaacctgttgagggcgttacacatttctatagttactagaacagagagcgccattgtcatcgggtatggggattcaaagattgcacaatccacgccttcaaagtccgggttgtcctctttacactgtaggaaatgactctgcaagaaaatccaatcaaattcctatcagcccagtatatttcccaagtccaggctccaaccccataccaagcctagcacagaccagcctgaatgcagagccagccaagaggtttaccccaatttctcggagaagccctggtccttcagaatcatcttagatgtaactgtttattgtctgagtcttaagatgatttgatagataccgaaaccacagaaaggtcaaggcctcacaacacttctcatgtaaggtacagaaagaaaggtgactgagtaccagctggtagaaggacactcttggaccaccgtcagcagcaatgaaccaccatgcagcagcacccacggtagcagcgccgacgtaacctgggaacaaacacagtgatgctgatgcacttgcctctgcagggctcgctgccaccgaggccatgcaggccagtccccacaaggacgaagatcaaagacatgggacagtgatggtaaccggggcctgtggtgctaccaccacctgctcacgcctggtagccagagcaactagaccctggtttctgaaggacaggggtgtttctagaacagaagaactggataacttttcctccagaatgtgtgagaaaaagcacttgctccatcctgtgccaacctttccccttgccgtgccttctcccctcagtgggtagtacttcaaggctgcaagtgtgtgtgtactccatgtaaggctgcacagtttgagggactagattacaccaggacttttggacaaactattgctgcctagttgtacacagatttatttgctccattagaggcccagcagcagttttctagggaaatgctgtcaggagctagggtggaacactgagcagcatggccctgccctcagcagcttctgggattccccccagtattagctttga

SEQ ID NO: 89 - DNA, 15 bp, Homo sapiens
gtgcacggtgggagt

SEQ ID NO: 90 - DNA, 15 bp, Homo sapiens
agtgcacggtgggag

SEQ ID NO: 91 - DNA, 15 bp, Homo sapiens
gagtgcacggtggga

SEQ ID NO: 92 - DNA, 15 bp, Homo sapiens
tgagtgcacggtggg

SEQ ID NO: 93 - DNA, 15 bp, Homo sapiens
gtgagtgcacggtgg

SEQ ID NO: 94 - DNA, 15 bp, Homo sapiens
cgtgagtgcacggtg

SEQ ID NO: 95 - DNA, 15 bp, Homo sapiens
acgtgagtgcacggt

SEQ ID NO: 96 - DNA, 15 bp, Homo sapiens
cacgtgagtgcacgg

SEQ ID NO: 97 - DNA, 15 bp, Homo sapiens
gcacgtgagtgcacg

SEQ ID NO: 98 - DNA, 15 bp, Homo sapiens
ggcacgtgagtgcac

SEQ ID NO: 99 - DNA, 15 bp, Homo sapiens
gggcacgtgagtgca

SEQ ID NO: 100 - DNA, 15 bp, Homo sapiens
ggggcacgtgagtgc

SEQ ID NO: 101 - DNA, 15 bp, Homo sapiens
aggggcacgtgagtg

SEQ ID NO: 102 - DNA, 15 bp, Homo sapiens
gaggggcacgtgagt

SEQ ID NO: 103 - DNA, 15 bp, Homo sapiens
agaggggcacgtgag

SEQ ID NO: 104 - DNA, 15 bp, Homo sapiens
aagaggggcacgtga

SEQ ID NO: 105 - DNA, 15 bp, Homo sapiens
caagaggggcacgtg

SEQ ID NO: 106 - DNA, 15 bp, Homo sapiens
tcaagaggggcacgt

SEQ ID NO: 107 - DNA, 15 bp, Homo sapiens
ttcaagaggggcacg

SEQ ID NO: 108 - DNA, 15 bp, Homo sapiens
cttcaagaggggcac

SEQ ID NO: 109 - DNA, 15 bp, Homo sapiens
gcttcaagaggggca

SEQ ID NO: 110 - DNA, 15 bp, Homo sapiens
cgcttcaagaggggc

SEQ ID NO: 111 - DNA, 15 bp, Homo sapiens
ccgcttcaagagggg

SEQ ID NO: 112 - DNA, 15 bp, Homo sapiens
gccgcttcaagaggg

SEQ ID NO: 113 - DNA, 15 bp, Homo sapiens
agccgcttcaagagg

SEQ ID NO: 114 - DNA, 15 bp, Homo sapiens
gagccgcttcaagag

SEQ ID NO: 115 - DNA, 15 bp, Homo sapiens
agagccgcttcaaga

SEQ ID NO: 116 - DNA, 15 bp, Homo sapiens
cagagccgcttcaag

SEQ ID NO: 117 - DNA, 15 bp, Homo sapiens
tcagagccgcttcaa

SEQ ID NO: 118 - DNA, 15 bp, Homo sapiens
atcagagccgcttca

SEQ ID NO: 119 - DNA, 15 bp, Homo sapiens
gatcagagccgcttc

SEQ ID NO: 120 - DNA, 15 bp, Homo sapiens
ggatcagagccgctt

SEQ ID NO: 121 - DNA, 15 bp, Homo sapiens
aggatcagagccgct

SEQ ID NO: 122 - DNA, 15 bp, Homo sapiens
caggatcagagccgc

SEQ ID NO: 123 - DNA, 15 bp, Homo sapiens
acaggatcagagccg

SEQ ID NO: 124 - DNA, 15 bp, Homo sapiens
cacaggatcagagcc

SEQ ID NO: 125 - DNA, 15 bp, Homo sapiens
tcacaggatcagagc

SEQ ID NO: 126 - DNA, 15 bp, Homo sapiens
gtcacaggatcagag

SEQ ID NO: 127 - DNA, 15 bp, Homo sapiens
ggtcacaggatcaga

SEQ ID NO: 128 - DNA, 15 bp, Homo sapiens
aggtcacaggatcag

SEQ ID NO: 129 - DNA, 15 bp, Homo sapiens
taggtcacaggatca

SEQ ID NO: 130 - DNA, 15 bp, Homo sapiens
ttaggtcacaggatc

SEQ ID NO: 131 - DNA, 15 bp, Homo sapiens
gttaggtcacaggat

SEQ ID NO: 132 - DNA, 15 bp, Homo sapiens
ggttaggtcacagga

SEQ ID NO: 133 - DNA, 15 bp, Homo sapiens
tggttaggtcacagg

SEQ ID NO: 134 - DNA, 15 bp, Homo sapiens
ctggttaggtcacag

SEQ ID NO: 135 - DNA, 15 bp, Homo sapiens
actggttaggtcaca

SEQ ID NO: 136 - DNA, 15 bp, Homo sapiens
aactggttaggtcac

SEQ ID NO: 137 - DNA, 15 bp, Homo sapiens
aaactggttaggtca

SEQ ID NO: 138 - DNA, 15 bp, Homo sapiens
gaaactggttaggtc

SEQ ID NO: 139 - DNA, 15 bp, Homo sapiens
ggaaactggttaggt

SEQ ID NO: 140 - DNA, 15 bp, Homo sapiens
tggaaactggttagg

SEQ ID NO: 141 - DNA, 15 bp, Homo sapiens
gtggaaactggttag

SEQ ID NO: 142 - DNA, 15 bp, Homo sapiens
ggtggaaactggtta

SEQ ID NO: 143 - DNA, 15 bp, Homo sapiens
aggtggaaactggtt

SEQ ID NO: 144 - DNA, 15 bp, Homo sapiens
caggtggaaactggt

SEQ ID NO: 145 - DNA, 15 bp, Homo sapiens
ccaggtggaaactgg

SEQ ID NO: 146 - DNA, 15 bp, Homo sapiens
gccaggtggaaactg

SEQ ID NO: 147 - DNA, 15 bp, Homo sapiens
agccaggtggaaact

SEQ ID NO: 148 - DNA, 15 bp, Homo sapiens
aagccaggtggaaac

SEQ ID NO: 149 - DNA, 15 bp, Homo sapiens
gaagccaggtggaaa

SEQ ID NO: 150 - DNA, 15 bp, Homo sapiens
agaagccaggtggaa

SEQ ID NO: 151 - DNA, 15 bp, Homo sapiens
gagaagccaggtgga

SEQ ID NO: 152 - DNA, 15 bp, Homo sapiens
agagaagccaggtgg

SEQ ID NO: 153 - DNA, 15 bp, Homo sapiens
gagagaagccaggtg

SEQ ID NO: 154 - DNA, 15 bp, Homo sapiens
tgagagaagccaggt

SEQ ID NO: 155 - DNA, 15 bp, Homo sapiens
ctgagagaagccagg

SEQ ID NO: 156 - DNA, 15 bp, Homo sapiens
actgagagaagccag

SEQ ID NO: 157 - DNA, 15 bp, Homo sapiens
cactgagagaagcca

SEQ ID NO: 158 - DNA, 15 bp, Homo sapiens
gcactgagagaagcc

SEQ ID NO: 159 - DNA, 15 bp, Homo sapiens
cgcactgagagaagc

SEQ ID NO: 160 - DNA, 15 bp, Homo sapiens
acgcactgagagaag

SEQ ID NO: 161 - DNA, 15 bp, Homo sapiens
aacgcactgagagaa

SEQ ID NO: 162 - DNA, 15 bp, Homo sapiens
caacgcactgagaga

SEQ ID NO: 163 - DNA, 15 bp, Homo sapiens
gcaacgcactgagag

SEQ ID NO: 164 - DNA, 15 bp, Homo sapiens
ggcaacgcactgaga

SEQ ID NO: 165 - DNA, 15 bp, Homo sapiens
tggcaacgcactgag

SEQ ID NO: 166 - DNA, 15 bp, Homo sapiens
atggcaacgcactga

SEQ ID NO: 167 - DNA, 15 bp, Homo sapiens
tatggcaacgcactg

SEQ ID NO: 168 - DNA, 15 bp, Homo sapiens
atatggcaacgcact

SEQ ID NO: 169 - DNA, 15 bp, Homo sapiens
tatatggcaacgcac

SEQ ID NO: 170 - DNA, 15 bp, Homo sapiens
ctatatggcaacgca

SEQ ID NO: 171 - DNA, 15 bp, Homo sapiens
actatatggcaacgc

SEQ ID NO: 172 - DNA, 15 bp, Homo sapiens
tactatatggcaacg

SEQ ID NO: 173 - DNA, 15 bp, Homo sapiens
atactatatggcaac

SEQ ID NO: 174 - DNA, 15 bp, Homo sapiens
tatactatatggcaa

SEQ ID NO: 175 - DNA, 15 bp, Homo sapiens
ttatactatatggca

SEQ ID NO: 176 - DNA, 15 bp, Homo sapiens
attatactatatggc

SEQ ID NO: 177 - DNA, 15 bp, Homo sapiens
aattatactatatgg

SEQ ID NO: 178 - DNA, 15 bp, Homo sapiens
aaattatactatatg

SEQ ID NO: 179 - DNA, 15 bp, Homo sapiens
aaaattatactatat

SEQ ID NO: 180 - DNA, 15 bp, Homo sapiens
aaaaattatactata

SEQ ID NO: 181 - DNA, 15 bp, Homo sapiens
aaaaaattatactat

SEQ ID NO: 182 - DNA, 15 bp, Homo sapiens
caaaaaattatacta

SEQ ID NO: 183 - DNA, 15 bp, Homo sapiens
acaaaaaattatact

SEQ ID NO: 184 - DNA, 15 bp, Homo sapiens
aacaaaaaattatac

SEQ ID NO: 185 - DNA, 15 bp, Homo sapiens
aaacaaaaaattata

SEQ ID NO: 186 - DNA, 15 bp, Homo sapiens
caaacaaaaaattat

SEQ ID NO: 187 - DNA, 15 bp, Homo sapiens
acaaacaaaaaatta

SEQ ID NO: 188 - DNA, 15 bp, Homo sapiens
aacaaacaaaaaatt

SEQ ID NO: 189 - DNA, 15 bp, Homo sapiens
aaacaaacaaaaaat

SEQ ID NO: 190 - DNA, 15 bp, Homo sapiens
caaacaaacaaaaaa

SEQ ID NO: 191 - DNA, 15 bp, Homo sapiens
acaaacaaacaaaaa

SEQ ID NO: 192 - DNA, 15 bp, Homo sapiens
aacaaacaaacaaaa

SEQ ID NO: 193 - DNA, 15 bp, Homo sapiens
aaacaaacaaacaaa

SEQ ID NO: 194 - DNA, 15 bp, Homo sapiens
gaaacaaacaaacaa

SEQ ID NO: 195 - DNA, 15 bp, Homo sapiens
cgaaacaaacaaaca

SEQ ID NO: 196 - DNA, 15 bp, Homo sapiens
acgaaacaaacaaac

SEQ ID NO: 197 - DNA, 15 bp, Homo sapiens
cacgaaacaaacaaa

SEQ ID NO: 198 - DNA, 15 bp, Homo sapiens
acacgaaacaaacaa

SEQ ID NO: 199 - DNA, 15 bp, Homo sapiens
tacacgaaacaaaca

SEQ ID NO: 200 - DNA, 15 bp, Homo sapiens
ctacacgaaacaaac

SEQ ID NO: 201 - DNA, 15 bp, Homo sapiens
cctacacgaaacaaa

SEQ ID NO: 202 - DNA, 15 bp, Homo sapiens
ccctacacgaaacaa

SEQ ID NO: 203 - DNA, 15 bp, Homo sapiens
accctacacgaaaca

SEQ ID NO: 204 - DNA, 15 bp, Homo sapiens
aaccctacacgaaac

SEQ ID NO: 205 - DNA, 15 bp, Homo sapiens
aaaccctacacgaaa

SEQ ID NO: 206 - DNA, 15 bp, Homo sapiens
aaaaccctacacgaa

SEQ ID NO: 207 - DNA, 15 bp, Homo sapiens
caaaaccctacacga

SEQ ID NO: 208 - DNA, 15 bp, Homo sapiens
acaaaaccctacacg

SEQ ID NO: 209 - DNA, 15 bp, Homo sapiens
aacaaaaccctacac

SEQ ID NO: 210 - DNA, 15 bp, Homo sapiens
caacaaaaccctaca

SEQ ID NO: 211 - DNA, 15 bp, Homo sapiens
ccaacaaaaccctac

SEQ ID NO: 212 - DNA, 15 bp, Homo sapiens
accaacaaaacccta

SEQ ID NO: 213 - DNA, 15 bp, Homo sapiens
aaccaacaaaaccct

SEQ ID NO: 214 - DNA, 15 bp, Homo sapiens
gaaccaacaaaaccc

SEQ ID NO: 215 - DNA, 15 bp, Homo sapiens
agaaccaacaaaacc

SEQ ID NO: 216 - DNA, 15 bp, Homo sapiens
aagaaccaacaaaac

SEQ ID NO: 217 - DNA, 15 bp, Homo sapiens
aaagaaccaacaaaa

SEQ ID NO: 218 - DNA, 15 bp, Homo sapiens
aaaagaaccaacaaa

SEQ ID NO: 219 - DNA, 15 bp, Homo sapiens
gaaaagaaccaacaa

SEQ ID NO: 220 - DNA, 15 bp, Homo sapiens
ggaaaagaaccaaca

SEQ ID NO: 221 - DNA, 15 bp, Homo sapiens
tggaaaagaaccaac

SEQ ID NO: 222 - DNA, 15 bp, Homo sapiens
ttggaaaagaaccaa

SEQ ID NO: 223 - DNA, 15 bp, Homo sapiens
cttggaaaagaacca

SEQ ID NO: 224 - DNA, 15 bp, Homo sapiens
acttggaaaagaacc

SEQ ID NO: 225 - DNA, 15 bp, Homo sapiens
tacttggaaaagaac

SEQ ID NO: 226 - DNA, 15 bp, Homo sapiens
atacttggaaaagaa

SEQ ID NO: 227 - DNA, 15 bp, Homo sapiens
gatacttggaaaaga

SEQ ID NO: 228 - DNA, 15 bp, Homo sapiens
tgatacttggaaaag

SEQ ID NO: 229 - DNA, 15 bp, Homo sapiens
ttgatacttggaaaa

SEQ ID NO: 230 - DNA, 15 bp, Homo sapiens
attgatacttggaaa

SEQ ID NO: 231 - DNA, 15 bp, Homo sapiens
gattgatacttggaa

SEQ ID NO: 232 - DNA, 15 bp, Homo sapiens
tgattgatacttgga

SEQ ID NO: 233 - DNA, 15 bp, Homo sapiens
ttgattgatacttgg

SEQ ID NO: 234 - DNA, 15 bp, Homo sapiens
tttgattgatacttg

SEQ ID NO: 235 - DNA, 15 bp, Homo sapiens
ttttgattgatactt

SEQ ID NO: 236 - DNA, 15 bp, Homo sapiens
gttttgattgatact

SEQ ID NO: 237 - DNA, 15 bp, Homo sapiens
agttttgattgatac

SEQ ID NO: 238 - DNA, 15 bp, Homo sapiens
tagttttgattgata

SEQ ID NO: 239 - DNA, 15 bp, Homo sapiens
gtagttttgattgat

SEQ ID NO: 240 - DNA, 15 bp, Homo sapiens
tgtagttttgattga

SEQ ID NO: 241 - DNA, 15 bp, Homo sapiens
atgtagttttgattg

SEQ ID NO: 242 - DNA, 15 bp, Homo sapiens
catgtagttttgatt

SEQ ID NO: 243 - DNA, 15 bp, Homo sapiens
gcatgtagttttgat

SEQ ID NO: 244 - DNA, 15 bp, Homo sapiens
ggcatgtagttttga

SEQ ID NO: 245 - DNA, 15 bp, Homo sapiens
tggcatgtagttttg

SEQ ID NO: 246 - DNA, 15 bp, Homo sapiens
ttggcatgtagtttt

SEQ ID NO: 247 - DNA, 15 bp, Homo sapiens
gttggcatgtagttt

SEQ ID NO: 248 - DNA, 15 bp, Homo sapiens
cgttggcatgtagtt

SEQ ID NO: 249 - DNA, 15 bp, Homo sapiens
acgttggcatgtagt

SEQ ID NO: 250 - DNA, 15 bp, Homo sapiens
gacgttggcatgtag

SEQ ID NO: 251 - DNA, 15 bp, Homo sapiens
ggacgttggcatgta

SEQ ID NO: 252 - DNA, 15 bp, Homo sapiens
tggacgttggcatgt

SEQ ID NO: 253 - DNA, 15 bp, Homo sapiens
gtggacgttggcatg

SEQ ID NO: 254 - DNA, 15 bp, Homo sapiens
agtggacgttggcat

SEQ ID NO: 255 - DNA, 15 bp, Homo sapiens
gagtggacgttggca

SEQ ID NO: 256 - DNA, 15 bp, Homo sapiens
ggagtggacgttggc

SEQ ID NO: 257 - DNA, 15 bp, Homo sapiens
aggagtggacgttgg

SEQ ID NO: 258 - DNA, 15 bp, Homo sapiens
aaggagtggacgttg

SEQ ID NO: 259 - DNA, 15 bp, Homo sapiens
caaggagtggacgtt

SEQ ID NO: 260 - DNA, 15 bp, Homo sapiens
ccaaggagtggacgt

SEQ ID NO: 261 - DNA, 15 bp, Homo sapiens
tccaaggagtggacg

SEQ ID NO: 262 - DNA, 15 bp, Homo sapiens
ttccaaggagtggac

SEQ ID NO: 263 - DNA, 15 bp, Homo sapiens
tttccaaggagtgga

SEQ ID NO: 264 - DNA, 15 bp, Homo sapiens
atttccaaggagtgg

SEQ ID NO: 265 - DNA, 15 bp, Homo sapiens
tatttccaaggagtg

SEQ ID NO: 266 - DNA, 15 bp, Homo sapiens
ttatttccaaggagt

SEQ ID NO: 267 - DNA, 15 bp, Homo sapiens
attatttccaaggag

SEQ ID NO: 268 - DNA, 15 bp, Homo sapiens
aattatttccaagga

SEQ ID NO: 269 - DNA, 15 bp, Homo sapiens
taattatttccaagg

SEQ ID NO: 270 - DNA, 15 bp, Homo sapiens
ttaattatttccaag

SEQ ID NO: 271 - DNA, 15 bp, Homo sapiens
tttaattatttccaa

SEQ ID NO: 272 - DNA, 15 bp, Homo sapiens
atttaattatttcca

SEQ ID NO: 273 - DNA, 15 bp, Homo sapiens
catttaattatttcc

SEQ ID NO: 274 - DNA, 15 bp, Homo sapiens
tcatttaattatttc

SEQ ID NO: 275 - DNA, 15 bp, Homo sapiens
gtcatttaattattt

SEQ ID NO: 276 - DNA, 15 bp, Homo sapiens
tgtcatttaattatt

SEQ ID NO: 277 - DNA, 15 bp, Homo sapiens
atgtcatttaattat

SEQ ID NO: 278 - DNA, 15 bp, Homo sapiens
catgtcatttaatta

SEQ ID NO: 279 - DNA, 15 bp, Homo sapiens
tcatgtcatttaatt

SEQ ID NO: 280 - DNA, 15 bp, Homo sapiens
gtcatgtcatttaat

SEQ ID NO: 281 - DNA, 15 bp, Homo sapiens
cgtcatgtcatttaa

SEQ ID NO: 282 - DNA, 15 bp, Homo sapiens
acgtcatgtcattta

SEQ ID NO: 283 - DNA, 15 bp, Homo sapiens
cacgtcatgtcattt

SEQ ID NO: 284 - DNA, 15 bp, Homo sapiens
gcacgtcatgtcatt

SEQ ID NO: 285 - DNA, 15 bp, Homo sapiens
ggcacgtcatgtcat

SEQ ID NO: 286 - DNA, 15 bp, Homo sapiens
aggcacgtcatgtca

SEQ ID NO: 287 - DNA, 15 bp, Homo sapiens
caggcacgtcatgtc

SEQ ID NO: 288 - DNA, 15 bp, Homo sapiens
tcaggcacgtcatgt

SEQ ID NO: 289 - DNA, 15 bp, Homo sapiens
atcaggcacgtcatg

SEQ ID NO: 290 - DNA, 15 bp, Homo sapiens
aatcaggcacgtcat

SEQ ID NO: 291 - DNA, 15 bp, Homo sapiens
aaatcaggcacgtca

SEQ ID NO: 292 - DNA, 15 bp, Homo sapiens
aaaatcaggcacgtc

SEQ ID NO: 293 - DNA, 15 bp, Homo sapiens
aaaaatcaggcacgt

SEQ ID NO: 294 - DNA, 15 bp, Homo sapiens
aaaaaatcaggcacg

SEQ ID NO: 295 - DNA, 15 bp, Homo sapiens
gaaaaaatcaggcac

SEQ ID NO: 296 - DNA, 15 bp, Homo sapiens
tgaaaaaatcaggca

SEQ ID NO: 297 - DNA, 15 bp, Homo sapiens
ctgaaaaaatcaggc

SEQ ID NO: 298 - DNA, 15 bp, Homo sapiens
gctgaaaaaatcagg

SEQ ID NO: 299 - DNA, 15 bp, Homo sapiens
agctgaaaaaatcag

SEQ ID NO: 300 - DNA, 15 bp, Homo sapiens
cagctgaaaaaatca

SEQ ID NO: 301 - DNA, 15 bp, Homo sapiens
ccagctgaaaaaatc

SEQ ID NO: 302 - DNA, 15 bp, Homo sapiens
accagctgaaaaaat

SEQ ID NO: 303 - DNA, 15 bp, Homo sapiens
caccagctgaaaaaa

SEQ ID NO: 304 - DNA, 15 bp, Homo sapiens
tcaccagctgaaaaa

SEQ ID NO: 305 - DNA, 15 bp, Homo sapiens
atcaccagctgaaaa

SEQ ID NO: 306 - DNA, 15 bp, Homo sapiens
catcaccagctgaaa

SEQ ID NO: 307 - DNA, 15 bp, Homo sapiens
gcatcaccagctgaa

SEQ ID NO: 308 - DNA, 15 bp, Homo sapiens
tgcatcaccagctga

SEQ ID NO: 309 - DNA, 15 bp, Homo sapiens
gtgcatcaccagctg

SEQ ID NO: 310 - DNA, 15 bp, Homo sapiens
agtgcatcaccagct

SEQ ID NO: 311 - DNA, 15 bp, Homo sapiens
cagtgcatcaccagc

SEQ ID NO: 312 - DNA, 15 bp, Homo sapiens
acagtgcatcaccag

SEQ ID NO: 313 - DNA, 15 bp, Homo sapiens
tacagtgcatcacca

SEQ ID NO: 314 - DNA, 15 bp, Homo sapiens
ttacagtgcatcacc

SEQ ID NO: 315 - DNA, 15 bp, Homo sapiens
attacagtgcatcac

SEQ ID NO: 316 - DNA, 15 bp, Homo sapiens
aattacagtgcatca

SEQ ID NO: 317 - DNA, 15 bp, Homo sapiens
aaattacagtgcatc

SEQ ID NO: 318 - DNA, 15 bp, Homo sapiens
caaattacagtgcat

SEQ ID NO: 319 - DNA, 15 bp, Homo sapiens
gcaaattacagtgca

SEQ ID NO: 320 - DNA, 15 bp, Homo sapiens
tgcaaattacagtgc

SEQ ID NO: 321 - DNA, 15 bp, Homo sapiens
atgcaaattacagtg

SEQ ID NO: 322 - DNA, 15 bp, Homo sapiens
gatgcaaattacagt

SEQ ID NO: 323 - DNA, 15 bp, Homo sapiens
agatgcaaattacag

SEQ ID NO: 324 - DNA, 15 bp, Homo sapiens
cagatgcaaattaca

SEQ ID NO: 325 - DNA, 15 bp, Homo sapiens
gcagatgcaaattac

SEQ ID NO: 326 - DNA, 15 bp, Homo sapiens
agcagatgcaaatta

SEQ ID NO: 327 - DNA, 15 bp, Homo sapiens
cagcagatgcaaatt

SEQ ID NO: 328 - DNA, 15 bp, Homo sapiens
tcagcagatgcaaat

SEQ ID NO: 329 - DNA, 15 bp, Homo sapiens
ttcagcagatgcaaa

SEQ ID NO: 330 - DNA, 15 bp, Homo sapiens
cttcagcagatgcaa

SEQ ID NO: 331 - DNA, 15 bp, Homo sapiens
ccttcagcagatgca

SEQ ID NO: 332 - DNA, 15 bp, Homo sapiens
tccttcagcagatgc

SEQ ID NO: 333 - DNA, 15 bp, Homo sapiens
ttccttcagcagatg

SEQ ID NO: 334 - DNA, 15 bp, Homo sapiens
attccttcagcagat

SEQ ID NO: 335 - DNA, 15 bp, Homo sapiens
aattccttcagcaga

SEQ ID NO: 336 - DNA, 15 bp, Homo sapiens
aaattccttcagcag

SEQ ID NO: 337 - DNA, 15 bp, Homo sapiens
taaattccttcagca

SEQ ID NO: 338 - DNA, 15 bp, Homo sapiens
ataaattccttcagc

SEQ ID NO: 339 - DNA, 15 bp, Homo sapiens
gataaattccttcag

SEQ ID NO: 340 - DNA, 15 bp, Homo sapiens
agataaattccttca

SEQ ID NO: 341 - DNA, 15 bp, Homo sapiens
aagataaattccttc

SEQ ID NO: 342 - DNA, 15 bp, Homo sapiens
taagataaattcctt

SEQ ID NO: 343 - DNA, 15 bp, Homo sapiens
ttaagataaattcct

SEQ ID NO: 344 - DNA, 15 bp, Homo sapiens
cttaagataaattcc

SEQ ID NO: 345 - DNA, 15 bp, Homo sapiens
acttaagataaattc

SEQ ID NO: 346 - DNA, 15 bp, Homo sapiens
gacttaagataaatt

SEQ ID NO: 347 - DNA, 15 bp, Homo sapiens
ggacttaagataaat

SEQ ID NO: 348 - DNA, 15 bp, Homo sapiens
aggacttaagataaa

SEQ ID NO: 349 - DNA, 15 bp, Homo sapiens
caggacttaagataa

SEQ ID NO: 350 - DNA, 15 bp, Homo sapiens
tcaggacttaagata

SEQ ID NO: 351 - DNA, 15 bp, Homo sapiens
ttcaggacttaagat

SEQ ID NO: 352 - DNA, 15 bp, Homo sapiens
cttcaggacttaaga

SEQ ID NO: 353 - DNA, 15 bp, Homo sapiens
gcttcaggacttaag

SEQ ID NO: 354 - DNA, 15 bp, Homo sapiens
ggcttcaggacttaa

SEQ ID NO: 355 - DNA, 15 bp, Homo sapiens
gggcttcaggactta

SEQ ID NO: 356 - DNA, 15 bp, Homo sapiens
tgggcttcaggactt

SEQ ID NO: 357 - DNA, 15 bp, Homo sapiens
ctgggcttcaggact

SEQ ID NO: 358 - DNA, 15 bp, Homo sapiens
gctgggcttcaggac

SEQ ID NO: 359 - DNA, 15 bp, Homo sapiens
ggctgggcttcagga

SEQ ID NO: 360 - DNA, 15 bp, Homo sapiens
tggctgggcttcagg

SEQ ID NO: 361 - DNA, 15 bp, Homo sapiens
gtggctgggcttcag

SEQ ID NO: 362 - DNA, 15 bp, Homo sapiens
agtggctgggcttca

SEQ ID NO: 363 - DNA, 15 bp, Homo sapiens
aagtggctgggcttc

SEQ ID NO: 364 - DNA, 15 bp, Homo sapiens
caagtggctgggctt

SEQ ID NO: 365 - DNA, 15 bp, Homo sapiens
tcaagtggctgggct

SEQ ID NO: 366 - DNA, 15 bp, Homo sapiens
ctcaagtggctgggc

SEQ ID NO: 367 - DNA, 15 bp, Homo sapiens
tctcaagtggctggg

SEQ ID NO: 368 - DNA, 15 bp, Homo sapiens
gtctcaagtggctgg

SEQ ID NO: 369 - DNA, 15 bp, Homo sapiens
tgtctcaagtggctg

SEQ ID NO: 370 - DNA, 15 bp, Homo sapiens
ttgtctcaagtggct

SEQ ID NO: 371 - DNA, 15 bp, Homo sapiens
gttgtctcaagtggc

SEQ ID NO: 372 - DNA, 15 bp, Homo sapiens
agttgtctcaagtgg

SEQ ID NO: 373 - DNA, 15 bp, Homo sapiens
cagttgtctcaagtg

SEQ ID NO: 374 - DNA, 15 bp, Homo sapiens
tcagttgtctcaagt

SEQ ID NO: 375 - DNA, 15 bp, Homo sapiens
ctcagttgtctcaag

SEQ ID NO: 376 - DNA, 15 bp, Homo sapiens
cctcagttgtctcaa

SEQ ID NO: 377 - DNA, 15 bp, Homo sapiens
acctcagttgtctca

SEQ ID NO: 378 - DNA, 15 bp, Homo sapiens
cacctcagttgtctc

SEQ ID NO: 379 - DNA, 15 bp, Homo sapiens
tcacctcagttgtct

SEQ ID NO: 380 - DNA, 15 bp, Homo sapiens
atcacctcagttgtc

SEQ ID NO: 381 - DNA, 15 bp, Homo sapiens
aatcacctcagttgt

SEQ ID NO: 382 - DNA, 15 bp, Homo sapiens
aaatcacctcagttg

SEQ ID NO: 383 - DNA, 15 bp, Homo sapiens
aaaatcacctcagtt

SEQ ID NO: 384 - DNA, 15 bp, Homo sapiens
aaaaatcacctcagt

SEQ ID NO: 385 - DNA, 15 bp, Homo sapiens
gaaaaatcacctcag

SEQ ID NO: 386 - DNA, 15 bp, Homo sapiens
agaaaaatcacctca

SEQ ID NO: 387 - DNA, 15 bp, Homo sapiens
cagaaaaatcacctc

SEQ ID NO: 388 - DNA, 15 bp, Homo sapiens
gcagaaaaatcacct

SEQ ID NO: 389 - DNA, 15 bp, Homo sapiens
agcagaaaaatcacc

SEQ ID NO: 390 - DNA, 15 bp, Homo sapiens
gagcagaaaaatcac

SEQ ID NO: 391 - DNA, 15 bp, Homo sapiens
agagcagaaaaatca

SEQ ID NO: 392 - DNA, 15 bp, Homo sapiens
cagagcagaaaaatc

SEQ ID NO: 393 - DNA, 15 bp, Homo sapiens
gcagagcagaaaaat

SEQ ID NO: 394 - DNA, 15 bp, Homo sapiens
agcagagcagaaaaa

SEQ ID NO: 395 - DNA, 15 bp, Homo sapiens
aagcagagcagaaaa

SEQ ID NO: 396 - DNA, 15 bp, Homo sapiens
aaagcagagcagaaa

SEQ ID NO: 397 - DNA, 15 bp, Homo sapiens
aaaagcagagcagaa

SEQ ID NO: 398 - DNA, 15 bp, Homo sapiens
caaaagcagagcaga

SEQ ID NO: 399 - DNA, 15 bp, Homo sapiens
gcaaaagcagagcag

SEQ ID NO: 400 - DNA, 15 bp, Homo sapiens
agcaaaagcagagca

SEQ ID NO: 401 - DNA, 15 bp, Homo sapiens
gagcaaaagcagagc

SEQ ID NO: 402 - DNA, 15 bp, Homo sapiens
tgagcaaaagcagag

SEQ ID NO: 403 - DNA, 15 bp, Homo sapiens
atgagcaaaagcaga

SEQ ID NO: 404 - DNA, 15 bp, Homo sapiens
catgagcaaaagcag

SEQ ID NO: 405 - DNA, 15 bp, Homo sapiens
gcatgagcaaaagca

SEQ ID NO: 406 - DNA, 15 bp, Homo sapiens
cgcatgagcaaaagc

SEQ ID NO: 407 - DNA, 15 bp, Homo sapiens
ccgcatgagcaaaag

SEQ ID NO: 408 - DNA, 15 bp, Homo sapiens
tccgcatgagcaaaa

SEQ ID NO: 409 - DNA, 15 bp, Homo sapiens
atccgcatgagcaaa

SEQ ID NO: 410 - DNA, 15 bp, Homo sapiens
catccgcatgagcaa

SEQ ID NO: 411 - DNA, 15 bp, Homo sapiens
ccatccgcatgagca

SEQ ID NO: 412 - DNA, 15 bp, Homo sapiens
accatccgcatgagc

SEQ ID NO: 413 - DNA, 15 bp, Homo sapiens
caccatccgcatgag

SEQ ID NO: 414 - DNA, 15 bp, Homo sapiens
gcaccatccgcatga

SEQ ID NO: 415 - DNA, 15 bp, Homo sapiens
cgcaccatccgcatg

SEQ ID NO: 416 - DNA, 15 bp, Homo sapiens
acgcaccatccgcat

SEQ ID NO: 417 - DNA, 15 bp, Homo sapiens
aacgcaccatccgca

SEQ ID NO: 418 - DNA, 15 bp, Homo sapiens
taacgcaccatccgc

SEQ ID NO: 419 - DNA, 15 bp, Homo sapiens
ataacgcaccatccg

SEQ ID NO: 420 - DNA, 15 bp, Homo sapiens
aataacgcaccatcc

SEQ ID NO: 421 - DNA, 15 bp, Homo sapiens
caataacgcaccatc

SEQ ID NO: 422 - DNA, 15 bp, Homo sapiens
acaataacgcaccat

SEQ ID NO: 423 - DNA, 15 bp, Homo sapiens
aacaataacgcacca

SEQ ID NO: 424 - DNA, 15 bp, Homo sapiens
taacaataacgcacc

SEQ ID NO: 425 - DNA, 15 bp, Homo sapiens
ttaacaataacgcac

SEQ ID NO: 426 - DNA, 15 bp, Homo sapiens
tttaacaataacgca

SEQ ID NO: 427 - DNA, 15 bp, Homo sapiens
gtttaacaataacgc

SEQ ID NO: 428 - DNA, 15 bp, Homo sapiens
tgtttaacaataacg

SEQ ID NO: 429 - DNA, 15 bp, Homo sapiens
gtgtttaacaataac

SEQ ID NO: 430 - DNA, 15 bp, Homo sapiens
tgtgtttaacaataa

SEQ ID NO: 431 - DNA, 15 bp, Homo sapiens
ttgtgtttaacaata

SEQ ID NO: 432 - DNA, 15 bp, Homo sapiens
tttgtgtttaacaat

SEQ ID NO: 433 - DNA, 15 bp, Homo sapiens
ttttgtgtttaacaa

SEQ ID NO: 434 - DNA, 15 bp, Homo sapiens
cttttgtgtttaaca

SEQ ID NO: 435 - DNA, 15 bp, Homo sapiens
acttttgtgtttaac

SEQ ID NO: 436 - DNA, 15 bp, Homo sapiens
cacttttgtgtttaa

SEQ ID NO: 437 - DNA, 15 bp, Homo sapiens
ccacttttgtgttta

SEQ ID NO: 438 - DNA, 15 bp, Homo sapiens
tccacttttgtgttt

SEQ ID NO: 439 - DNA, 15 bp, Homo sapiens
gtccacttttgtgtt

SEQ ID NO: 440 - DNA, 15 bp, Homo sapiens
agtccacttttgtgt

SEQ ID NO: 441 - DNA, 15 bp, Homo sapiens
tagtccacttttgtg

SEQ ID NO: 442 - DNA, 15 bp, Homo sapiens
ttagtccacttttgt

SEQ ID NO: 443 - DNA, 15 bp, Homo sapiens
attagtccacttttg

SEQ ID NO: 444 - DNA, 15 bp, Homo sapiens
aattagtccactttt

SEQ ID NO: 445 - DNA, 15 bp, Homo sapiens
caattagtccacttt

SEQ ID NO: 446 - DNA, 15 bp, Homo sapiens
gcaattagtccactt

SEQ ID NO: 447 - DNA, 15 bp, Homo sapiens
agcaattagtccact

SEQ ID NO: 448 - DNA, 15 bp, Homo sapiens
aagcaattagtccac

SEQ ID NO: 449 - DNA, 15 bp, Homo sapiens
gaagcaattagtcca

SEQ ID NO: 450 - DNA, 15 bp, Homo sapiens
tgaagcaattagtcc

SEQ ID NO: 451 - DNA, 15 bp, Homo sapiens
atgaagcaattagtc

SEQ ID NO: 452 - DNA, 15 bp, Homo sapiens
aatgaagcaattagt

SEQ ID NO: 453 - DNA, 15 bp, Homo sapiens
gaatgaagcaattag

SEQ ID NO: 454 - DNA, 15 bp, Homo sapiens
agaatgaagcaatta

SEQ ID NO: 455 - DNA, 15 bp, Homo sapiens
cagaatgaagcaatt

SEQ ID NO: 456 - DNA, 15 bp, Homo sapiens
gcagaatgaagcaat

SEQ ID NO: 457 - DNA, 15 bp, Homo sapiens
tgcagaatgaagcaa

SEQ ID NO: 458 - DNA, 15 bp, Homo sapiens
ttgcagaatgaagca

SEQ ID NO: 459 - DNA, 15 bp, Homo sapiens
gttgcagaatgaagc

SEQ ID NO: 460 - DNA, 15 bp, Homo sapiens
ggttgcagaatgaag

SEQ ID NO: 461 - DNA, 15 bp, Homo sapiens
aggttgcagaatgaa

SEQ ID NO: 462 - DNA, 15 bp, Homo sapiens
taggttgcagaatga

SEQ ID NO: 463 - DNA, 15 bp, Homo sapiens
gtaggttgcagaatg

SEQ ID NO: 464 - DNA, 15 bp, Homo sapiens
agtaggttgcagaat

SEQ ID NO: 465 - DNA, 15 bp, Homo sapiens
gagtaggttgcagaa

SEQ ID NO: 466 - DNA, 15 bp, Homo sapiens
ggagtaggttgcaga

SEQ ID NO: 467 - DNA, 15 bp, Homo sapiens
cggagtaggttgcag

SEQ ID NO: 468 - DNA, 15 bp, Homo sapiens
acggagtaggttgca

SEQ ID NO: 469 - DNA, 15 bp, Homo sapiens
cacggagtaggttgc

SEQ ID NO: 470 - DNA, 15 bp, Homo sapiens
tcacggagtaggttg

SEQ ID NO: 471 - DNA, 15 bp, Homo sapiens
ttcacggagtaggtt

SEQ ID NO: 472 - DNA, 15 bp, Homo sapiens
cttcacggagtaggt

SEQ ID NO: 473 - DNA, 15 bp, Homo sapiens
tcttcacggagtagg

SEQ ID NO: 474 - DNA, 15 bp, Homo sapiens
ttcttcacggagtag

SEQ ID NO: 475 - DNA, 15 bp, Homo sapiens
tttcttcacggagta

SEQ ID NO: 476 - DNA, 15 bp, Homo sapiens
ctttcttcacggagt

SEQ ID NO: 477 - DNA, 15 bp, Homo sapiens
gctttcttcacggag

SEQ ID NO: 478 - DNA, 15 bp, Homo sapiens
agctttcttcacgga

SEQ ID NO: 479 - DNA, 15 bp, Homo sapiens
cagctttcttcacgg

SEQ ID NO: 480 - DNA, 15 bp, Homo sapiens
gcagctttcttcacg

SEQ ID NO: 481 - DNA, 15 bp, Homo sapiens
agcagctttcttcac

SEQ ID NO: 482 - DNA, 15 bp, Homo sapiens
gagcagctttcttca

SEQ ID NO: 483 - DNA, 15 bp, Homo sapiens
agagcagctttcttc

SEQ ID NO: 484 - DNA, 15 bp, Homo sapiens
aagagcagctttctt

SEQ ID NO: 485 - DNA, 15 bp, Homo sapiens
gaagagcagctttct

SEQ ID NO: 486 - DNA, 15 bp, Homo sapiens
agaagagcagctttc

SEQ ID NO: 487 - DNA, 15 bp, Homo sapiens
aagaagagcagcttt

SEQ ID NO: 488 - DNA, 15 bp, Homo sapiens
aaagaagagcagctt

SEQ ID NO: 489 - DNA, 15 bp, Homo sapiens
caaagaagagcagct

SEQ ID NO: 490 - DNA, 15 bp, Homo sapiens
acaaagaagagcagc

SEQ ID NO: 491 - DNA, 15 bp, Homo sapiens
cacaaagaagagcag

SEQ ID NO: 492 - DNA, 15 bp, Homo sapiens
tcacaaagaagagca

SEQ ID NO: 493 - DNA, 15 bp, Homo sapiens
ttcacaaagaagagc

SEQ ID NO: 494 - DNA, 15 bp, Homo sapiens
cttcacaaagaagag

SEQ ID NO: 495 - DNA, 15 bp, Homo sapiens
tcttcacaaagaaga

SEQ ID NO: 496 - DNA, 15 bp, Homo sapiens
ctcttcacaaagaag

SEQ ID NO: 497 - DNA, 15 bp, Homo sapiens
tctcttcacaaagaa

SEQ ID NO: 498 - DNA, 15 bp, Homo sapiens
ttctcttcacaaaga

SEQ ID NO: 499 - DNA, 15 bp, Homo sapiens
attctcttcacaaag

SEQ ID NO: 500 - DNA, 15 bp, Homo sapiens
tattctcttcacaaa

SEQ ID NO: 501 - DNA, 15 bp, Homo sapiens
atattctcttcacaa

SEQ ID NO: 502 - DNA, 15 bp, Homo sapiens
catattctcttcaca

SEQ ID NO: 503 - DNA, 15 bp, Homo sapiens
acatattctcttcac

SEQ ID NO: 504 - DNA, 15 bp, Homo sapiens
aacatattctcttca

SEQ ID NO: 505 - DNA, 15 bp, Homo sapiens
gaacatattctcttc

SEQ ID NO: 506 - DNA, 15 bp, Homo sapiens
tgaacatattctctt

SEQ ID NO: 507 - DNA, 15 bp, Homo sapiens
atgaacatattctct

SEQ ID NO: 508 - DNA, 15 bp, Homo sapiens
catgaacatattctc

SEQ ID NO: 509 - DNA, 15 bp, Homo sapiens
acatgaacatattct

SEQ ID NO: 510 - DNA, 15 bp, Homo sapiens
aacatgaacatattc

SEQ ID NO: 511 - DNA, 15 bp, Homo sapiens
aaacatgaacatatt

SEQ ID NO: 512 - DNA, 15 bp, Homo sapiens
aaaacatgaacatat

SEQ ID NO: 513 - DNA, 15 bp, Homo sapiens
caaaacatgaacata

SEQ ID NO: 514 - DNA, 15 bp, Homo sapiens
acaaaacatgaacat

SEQ ID NO: 515 - DNA, 15 bp, Homo sapiens
aacaaaacatgaaca

SEQ ID NO: 516 - DNA, 15 bp, Homo sapiens
gaacaaaacatgaac

SEQ ID NO: 517 - DNA, 15 bp, Homo sapiens
tgaacaaaacatgaa

SEQ ID NO: 518 - DNA, 15 bp, Homo sapiens
atgaacaaaacatga

SEQ ID NO: 519 - DNA, 15 bp, Homo sapiens
catgaacaaaacatg

SEQ ID NO: 520 - DNA, 15 bp, Homo sapiens
tcatgaacaaaacat

SEQ ID NO: 521 - DNA, 15 bp, Homo sapiens
ttcatgaacaaaaca

SEQ ID NO: 522 - DNA, 15 bp, Homo sapiens
attcatgaacaaaac

SEQ ID NO: 523 - DNA, 15 bp, Homo sapiens
aattcatgaacaaaa

SEQ ID NO: 524 - DNA, 15 bp, Homo sapiens
gaattcatgaacaaa

SEQ ID NO: 525 - DNA, 15 bp, Homo sapiens
ggaattcatgaacaa

SEQ ID NO: 526 - DNA, 15 bp, Homo sapiens
tggaattcatgaaca

SEQ ID NO: 527 - DNA, 15 bp, Homo sapiens
atggaattcatgaac

SEQ ID NO: 528 - DNA, 15 bp, Homo sapiens
catggaattcatgaa

SEQ ID NO: 529 - DNA, 15 bp, Homo sapiens
gcatggaattcatga

SEQ ID NO: 530 - DNA, 15 bp, Homo sapiens
tgcatggaattcatg

SEQ ID NO: 531 - DNA, 15 bp, Homo sapiens
ttgcatggaattcat

SEQ ID NO: 532 - DNA, 15 bp, Homo sapiens
attgcatggaattca

SEQ ID NO: 533 - DNA, 15 bp, Homo sapiens
aattgcatggaattc

SEQ ID NO: 534 - DNA, 15 bp, Homo sapiens
aaattgcatggaatt

SEQ ID NO: 535 - DNA, 15 bp, Homo sapiens
gaaattgcatggaat

SEQ ID NO: 536 - DNA, 15 bp, Homo sapiens
ggaaattgcatggaa

SEQ ID NO: 537 - DNA, 15 bp, Homo sapiens
gggaaattgcatgga

SEQ ID NO: 538 - DNA, 15 bp, Homo sapiens
tgggaaattgcatgg

SEQ ID NO: 539 - DNA, 15 bp, Homo sapiens
atgggaaattgcatg

SEQ ID NO: 540 - DNA, 15 bp, Homo sapiens
gatgggaaattgcat

SEQ ID NO: 541 - DNA, 15 bp, Homo sapiens
ggatgggaaattgca

SEQ ID NO: 542 - DNA, 15 bp, Homo sapiens
gggatgggaaattgc

SEQ ID NO: 543 - DNA, 15 bp, Homo sapiens
ggggatgggaaattg

SEQ ID NO: 544 - DNA, 15 bp, Homo sapiens
aggggatgggaaatt

SEQ ID NO: 545 - DNA, 15 bp, Homo sapiens
aaggggatgggaaat

SEQ ID NO: 546 - DNA, 15 bp, Homo sapiens
caaggggatgggaaa

SEQ ID NO: 547 - DNA, 15 bp, Homo sapiens
acaaggggatgggaa

SEQ ID NO: 548 - DNA, 15 bp, Homo sapiens
aacaaggggatggga

SEQ ID NO: 549 - DNA, 15 bp, Homo sapiens
taacaaggggatggg

SEQ ID NO: 550 - DNA, 15 bp, Homo sapiens
ttaacaaggggatgg

SEQ ID NO: 551 - DNA, 15 bp, Homo sapiens
cttaacaaggggatg

SEQ ID NO: 552 - DNA, 15 bp, Homo sapiens
acttaacaaggggat

SEQ ID NO: 553 - DNA, 15 bp, Homo sapiens
tacttaacaagggga

SEQ ID NO: 554 - DNA, 15 bp, Homo sapiens
ttacttaacaagggg

SEQ ID NO: 555 - DNA, 15 bp, Homo sapiens
attacttaacaaggg

SEQ ID NO: 556 - DNA, 15 bp, Homo sapiens
cattacttaacaagg

SEQ ID NO: 557 - DNA, 15 bp, Homo sapiens
acattacttaacaag

SEQ ID NO: 558 - DNA, 15 bp, Homo sapiens
tacattacttaacaa

SEQ ID NO: 559 - DNA, 15 bp, Homo sapiens
ctacattacttaaca

SEQ ID NO: 560 - DNA, 15 bp, Homo sapiens
gctacattacttaac

SEQ ID NO: 561 - DNA, 15 bp, Homo sapiens
agctacattacttaa

SEQ ID NO: 562 - DNA, 15 bp, Homo sapiens
aagctacattactta

SEQ ID NO: 563 - DNA, 15 bp, Homo sapiens
gaagctacattactt

SEQ ID NO: 564 - DNA, 15 bp, Homo sapiens
agaagctacattact

SEQ ID NO: 565 - DNA, 15 bp, Homo sapiens
aagaagctacattac

SEQ ID NO: 566 - DNA, 15 bp, Homo sapiens
aaagaagctacatta

SEQ ID NO: 567 - DNA, 15 bp, Homo sapiens
taaagaagctacatt

SEQ ID NO: 568 - DNA, 15 bp, Homo sapiens
ataaagaagctacat

SEQ ID NO: 569 - DNA, 15 bp, Homo sapiens
tataaagaagctaca

SEQ ID NO: 570 - DNA, 15 bp, Homo sapiens
atataaagaagctac

SEQ ID NO: 571 - DNA, 15 bp, Homo sapiens
aatataaagaagcta

SEQ ID NO: 572 - DNA, 15 bp, Homo sapiens
caatataaagaagct

SEQ ID NO: 573 - DNA, 15 bp, Homo sapiens
ccaatataaagaagc

SEQ ID NO: 574 - DNA, 15 bp, Homo sapiens
gccaatataaagaag

SEQ ID NO: 575 - DNA, 15 bp, Homo sapiens
tgccaatataaagaa

SEQ ID NO: 576 - DNA, 15 bp, Homo sapiens
ttgccaatataaaga

SEQ ID NO: 577 - DNA, 15 bp, Homo sapiens
tttgccaatataaag

SEQ ID NO: 578 - DNA, 15 bp, Homo sapiens
ttttgccaatataaa

SEQ ID NO: 579 - DNA, 15 bp, Homo sapiens
attttgccaatataa

SEQ ID NO: 580 - DNA, 15 bp, Homo sapiens
aattttgccaatata

SEQ ID NO: 581 - DNA, 15 bp, Homo sapiens
gaattttgccaatat

SEQ ID NO: 582 - DNA, 15 bp, Homo sapiens
ggaattttgccaata

SEQ ID NO: 583 - DNA, 15 bp, Homo sapiens
gggaattttgccaat

SEQ ID NO: 584 - DNA, 15 bp, Homo sapiens
agggaattttgccaa

SEQ ID NO: 585 - DNA, 15 bp, Homo sapiens
aagggaattttgcca

SEQ ID NO: 586 - DNA, 15 bp, Homo sapiens
aaagggaattttgcc

SEQ ID NO: 587 - DNA, 15 bp, Homo sapiens
taaagggaattttgc

SEQ ID NO: 588 - DNA, 15 bp, Homo sapiens
ataaagggaattttg

SEQ ID NO: 589 - DNA, 15 bp, Homo sapiens
gataaagggaatttt

SEQ ID NO: 590 - DNA, 15 bp, Homo sapiens
agataaagggaattt

SEQ ID NO: 591 - DNA, 15 bp, Homo sapiens
aagataaagggaatt

SEQ ID NO: 592 - DNA, 15 bp, Homo sapiens
caagataaagggaat

SEQ ID NO: 593 - DNA, 15 bp, Homo sapiens
gcaagataaagggaa

SEQ ID NO: 594 - DNA, 15 bp, Homo sapiens
agcaagataaaggga

SEQ ID NO: 595 - DNA, 15 bp, Homo sapiens
cagcaagataaaggg

SEQ ID NO: 596 - DNA, 15 bp, Homo sapiens
acagcaagataaagg

SEQ ID NO: 597 - DNA, 15 bp, Homo sapiens
cacagcaagataaag

SEQ ID NO: 598 - DNA, 15 bp, Homo sapiens
tcacagcaagataaa

SEQ ID NO: 599 - DNA, 15 bp, Homo sapiens
gtcacagcaagataa

SEQ ID NO: 600 - DNA, 15 bp, Homo sapiens
ggtcacagcaagata

SEQ ID NO: 601 - DNA, 15 bp, Homo sapiens
aggtcacagcaagat

SEQ ID NO: 602 - DNA, 15 bp, Homo sapiens
caggtcacagcaaga

SEQ ID NO: 603 - DNA, 15 bp, Homo sapiens
gcaggtcacagcaag

SEQ ID NO: 604 - DNA, 15 bp, Homo sapiens
cgcaggtcacagcaa

SEQ ID NO: 605 - DNA, 15 bp, Homo sapiens
gcgcaggtcacagca

SEQ ID NO: 606 - DNA, 15 bp, Homo sapiens
agcgcaggtcacagc

SEQ ID NO: 607 - DNA, 15 bp, Homo sapiens
aagcgcaggtcacag

SEQ ID NO: 608 - DNA, 15 bp, Homo sapiens
aaagcgcaggtcaca

SEQ ID NO: 609 - DNA, 15 bp, Homo sapiens
caaagcgcaggtcac

SEQ ID NO: 610 - DNA, 15 bp, Homo sapiens
acaaagcgcaggtca

SEQ ID NO: 611 - DNA, 15 bp, Homo sapiens
gacaaagcgcaggtc

SEQ ID NO: 612 - DNA, 15 bp, Homo sapiens
ggacaaagcgcaggt

SEQ ID NO: 613 - DNA, 15 bp, Homo sapiens
aggacaaagcgcagg

SEQ ID NO: 614 - DNA, 15 bp, Homo sapiens
gaggacaaagcgcag

SEQ ID NO: 615 - DNA, 15 bp, Homo sapiens
ggaggacaaagcgca

SEQ ID NO: 616 - DNA, 15 bp, Homo sapiens
gggaggacaaagcgc

SEQ ID NO: 617 - DNA, 15 bp, Homo sapiens
cgggaggacaaagcg

SEQ ID NO: 618 - DNA, 15 bp, Homo sapiens
tcgggaggacaaagc

SEQ ID NO: 619 - DNA, 15 bp, Homo sapiens
ctcgggaggacaaag

SEQ ID NO: 620 - DNA, 15 bp, Homo sapiens
gctcgggaggacaaa

SEQ ID NO: 621 - DNA, 15 bp, Homo sapiens
tgctcgggaggacaa

SEQ ID NO: 622 - DNA, 15 bp, Homo sapiens
ctgctcgggaggaca

SEQ ID NO: 623 - DNA, 15 bp, Homo sapiens
tctgctcgggaggac

SEQ ID NO: 624 - DNA, 15 bp, Homo sapiens
ctctgctcgggagga

SEQ ID NO: 625 - DNA, 15 bp, Homo sapiens
gctctgctcgggagg

SEQ ID NO: 626 - DNA, 15 bp, Homo sapiens
tgctctgctcgggag

SEQ ID NO: 627 - DNA, 15 bp, Homo sapiens
ttgctctgctcggga

SEQ ID NO: 628 - DNA, 15 bp, Homo sapiens
tttgctctgctcggg

SEQ ID NO: 629 - DNA, 15 bp, Homo sapiens
atttgctctgctcgg

SEQ ID NO: 630 - DNA, 15 bp, Homo sapiens
gatttgctctgctcg

SEQ ID NO: 631 - DNA, 15 bp, Homo sapiens
tgatttgctctgctc

SEQ ID NO: 632 - DNA, 15 bp, Homo sapiens
atgatttgctctgct

SEQ ID NO: 633 - DNA, 15 bp, Homo sapiens
gatgatttgctctgc

SEQ ID NO: 634 - DNA, 15 bp, Homo sapiens
agatgatttgctctg

SEQ ID NO: 635 - DNA, 15 bp, Homo sapiens
cagatgatttgctct

SEQ ID NO: 636 - DNA, 15 bp, Homo sapiens
acagatgatttgctc

SEQ ID NO: 637 - DNA, 15 bp, Homo sapiens
cacagatgatttgct

SEQ ID NO: 638 - DNA, 15 bp, Homo sapiens
ccacagatgatttgc

SEQ ID NO: 639 - DNA, 15 bp, Homo sapiens
accacagatgatttg

SEQ ID NO: 640 - DNA, 15 bp, Homo sapiens
aaccacagatgattt

SEQ ID NO: 641 - DNA, 15 bp, Homo sapiens
aaaccacagatgatt

SEQ ID NO: 642 - DNA, 15 bp, Homo sapiens
taaaccacagatgat

SEQ ID NO: 643 - DNA, 15 bp, Homo sapiens
ttaaaccacagatga

SEQ ID NO: 644 - DNA, 15 bp, Homo sapiens
cttaaaccacagatg

SEQ ID NO: 645 - DNA, 15 bp, Homo sapiens
tcttaaaccacagat

SEQ ID NO: 646 - DNA, 15 bp, Homo sapiens
ctcttaaaccacaga

SEQ ID NO: 647 - DNA, 15 bp, Homo sapiens
gctcttaaaccacag

SEQ ID NO: 648 - DNA, 15 bp, Homo sapiens
tgctcttaaaccaca

SEQ ID NO: 649 - DNA, 15 bp, Homo sapiens
ctgctcttaaaccac

SEQ ID NO: 650 - DNA, 15 bp, Homo sapiens
gctgctcttaaacca

SEQ ID NO: 651 - DNA, 15 bp, Homo sapiens
agctgctcttaaacc

SEQ ID NO: 652 - DNA, 15 bp, Homo sapiens
aagctgctcttaaac

SEQ ID NO: 653 - DNA, 15 bp, Homo sapiens
aaagctgctcttaaa

SEQ ID NO: 654 - DNA, 15 bp, Homo sapiens
caaagctgctcttaa

SEQ ID NO: 655 - DNA, 15 bp, Homo sapiens
ccaaagctgctctta

SEQ ID NO: 656 - DNA, 15 bp, Homo sapiens
tccaaagctgctctt

SEQ ID NO: 657 - DNA, 15 bp, Homo sapiens
atccaaagctgctct

SEQ ID NO: 658 - DNA, 15 bp, Homo sapiens
aatccaaagctgctc

SEQ ID NO: 659 - DNA, 15 bp, Homo sapiens
gaatccaaagctgct

SEQ ID NO: 660 - DNA, 15 bp, Homo sapiens
tgaatccaaagctgc

SEQ ID NO: 661 - DNA, 15 bp, Homo sapiens
ttgaatccaaagctg

SEQ ID NO: 662 - DNA, 15 bp, Homo sapiens
cttgaatccaaagct

SEQ ID NO: 663 - DNA, 15 bp, Homo sapiens
acttgaatccaaagc

SEQ ID NO: 664 - DNA, 15 bp, Homo sapiens
gacttgaatccaaag

SEQ ID NO: 665 - DNA, 15 bp, Homo sapiens
ggacttgaatccaaa

SEQ ID NO: 666 - DNA, 15 bp, Homo sapiens
gggacttgaatccaa

SEQ ID NO: 667 - DNA, 15 bp, Homo sapiens
ggggacttgaatcca

SEQ ID NO: 668 - DNA, 15 bp, Homo sapiens
aggggacttgaatcc

SEQ ID NO: 669 - DNA, 15 bp, Homo sapiens
aaggggacttgaatc

SEQ ID NO: 670 - DNA, 15 bp, Homo sapiens
aaaggggacttgaat

SEQ ID NO: 671 - DNA, 15 bp, Homo sapiens
aaaaggggacttgaa

SEQ ID NO: 672 - DNA, 15 bp, Homo sapiens
gaaaaggggacttga

SEQ ID NO: 673 - DNA, 15 bp, Homo sapiens
agaaaaggggacttg

SEQ ID NO: 674 - DNA, 15 bp, Homo sapiens
gagaaaaggggactt

SEQ ID NO: 675 - DNA, 15 bp, Homo sapiens
ggagaaaaggggact

SEQ ID NO: 676 - DNA, 15 bp, Homo sapiens
aggagaaaaggggac

SEQ ID NO: 677 - DNA, 15 bp, Homo sapiens
caggagaaaagggga

SEQ ID NO: 678 - DNA, 15 bp, Homo sapiens
acaggagaaaagggg

SEQ ID NO: 679 - DNA, 15 bp, Homo sapiens
gacaggagaaaaggg

SEQ ID NO: 680 - DNA, 15 bp, Homo sapiens
cgacaggagaaaagg

SEQ ID NO: 681 - DNA, 15 bp, Homo sapiens
tcgacaggagaaaag

SEQ ID NO: 682 - DNA, 15 bp, Homo sapiens
ctcgacaggagaaaa

SEQ ID NO: 683 - DNA, 15 bp, Homo sapiens
cctcgacaggagaaa

SEQ ID NO: 684 - DNA, 15 bp, Homo sapiens
ccctcgacaggagaa

SEQ ID NO: 685 - DNA, 15 bp, Homo sapiens
tccctcgacaggaga

SEQ ID NO: 686 - DNA, 15 bp, Homo sapiens
ttccctcgacaggag

SEQ ID NO: 687 - DNA, 15 bp, Homo sapiens
cttccctcgacagga

SEQ ID NO: 688 - DNA, 15 bp, Homo sapiens
acttccctcgacagg

SEQ ID NO: 689 - DNA, 15 bp, Homo sapiens
cacttccctcgacag

SEQ ID NO: 690 - DNA, 15 bp, Homo sapiens
tcacttccctcgaca

SEQ ID NO: 691 - DNA, 15 bp, Homo sapiens
ctcacttccctcgac

SEQ ID NO: 692 - DNA, 15 bp, Homo sapiens
actcacttccctcga

SEQ ID NO: 693 - DNA, 15 bp, Homo sapiens
gactcacttccctcg

SEQ ID NO: 694 - DNA, 15 bp, Homo sapiens
agactcacttccctc

SEQ ID NO: 695 - DNA, 15 bp, Homo sapiens
tagactcacttccct

SEQ ID NO: 696 - DNA, 15 bp, Homo sapiens
atagactcacttccc

SEQ ID NO: 697 - DNA, 15 bp, Homo sapiens
catagactcacttcc

SEQ ID NO: 698 - DNA, 15 bp, Homo sapiens
tcatagactcacttc

SEQ ID NO: 699 - DNA, 15 bp, Homo sapiens
ttcatagactcactt

SEQ ID NO: 700 - DNA, 15 bp, Homo sapiens
tttcatagactcact

SEQ ID NO: 701 - DNA, 15 bp, Homo sapiens
atttcatagactcac

SEQ ID NO: 702 - DNA, 15 bp, Homo sapiens
catttcatagactca

SEQ ID NO: 703 - DNA, 15 bp, Homo sapiens
ccatttcatagactc

SEQ ID NO: 704 - DNA, 15 bp, Homo sapiens
gccatttcatagact

SEQ ID NO: 705 - DNA, 15 bp, Homo sapiens
ggccatttcatagac

SEQ ID NO: 706 - DNA, 15 bp, Homo sapiens
aggccatttcataga

SEQ ID NO: 707 - DNA, 15 bp, Homo sapiens
aaggccatttcatag

SEQ ID NO: 708 - DNA, 15 bp, Homo sapiens
gaaggccatttcata

SEQ ID NO: 709 - DNA, 15 bp, Homo sapiens
tgaaggccatttcat

SEQ ID NO: 710 - DNA, 15 bp, Homo sapiens
atgaaggccatttca

SEQ ID NO: 711 - DNA, 15 bp, Homo sapiens
gatgaaggccatttc

SEQ ID NO: 712 - DNA, 15 bp, Homo sapiens
agatgaaggccattt

SEQ ID NO: 713 - DNA, 15 bp, Homo sapiens
cagatgaaggccatt

SEQ ID NO: 714 - DNA, 15 bp, Homo sapiens
tcagatgaaggccat

SEQ ID NO: 715 - DNA, 15 bp, Homo sapiens
ttcagatgaaggcca

SEQ ID NO: 716 - DNA, 15 bp, Homo sapiens
tttcagatgaaggcc

SEQ ID NO: 717 - DNA, 15 bp, Homo sapiens
ctttcagatgaaggc

SEQ ID NO: 718 - DNA, 15 bp, Homo sapiens
gctttcagatgaagg

SEQ ID NO: 719 - DNA, 15 bp, Homo sapiens
ggctttcagatgaag

SEQ ID NO: 720 - DNA, 15 bp, Homo sapiens
tggctttcagatgaa

SEQ ID NO: 721 - DNA, 15 bp, Homo sapiens
gtggctttcagatga

SEQ ID NO: 722 - DNA, 15 bp, Homo sapiens
tgtggctttcagatg

SEQ ID NO: 723 - DNA, 15 bp, Homo sapiens
ctgtggctttcagat

SEQ ID NO: 724 - DNA, 15 bp, Homo sapiens
gctgtggctttcaga

SEQ ID NO: 725 - DNA, 15 bp, Homo sapiens
cgctgtggctttcag

SEQ ID NO: 726 - DNA, 15 bp, Homo sapiens
tcgctgtggctttca

SEQ ID NO: 727 - DNA, 15 bp, Homo sapiens
ttcgctgtggctttc

SEQ ID NO: 728 - DNA, 15 bp, Homo sapiens
cttcgctgtggcttt

SEQ ID NO: 729 - DNA, 15 bp, Homo sapiens
gcttcgctgtggctt

SEQ ID NO: 730 - DNA, 15 bp, Homo sapiens
tgcttcgctgtggct

SEQ ID NO: 731 - DNA, 15 bp, Homo sapiens
gtgcttcgctgtggc

SEQ ID NO: 732 - DNA, 15 bp, Homo sapiens
ggtgcttcgctgtgg

SEQ ID NO: 733 - DNA, 15 bp, Homo sapiens
aggtgcttcgctgtg

SEQ ID NO: 734 - DNA, 15 bp, Homo sapiens
gaggtgcttcgctgt

SEQ ID NO: 735 - DNA, 15 bp, Homo sapiens
ggaggtgcttcgctg

SEQ ID NO: 736 - DNA, 15 bp, Homo sapiens
aggaggtgcttcgct

SEQ ID NO: 737 - DNA, 15 bp, Homo sapiens
taggaggtgcttcgc

SEQ ID NO: 738 - DNA, 15 bp, Homo sapiens
ctaggaggtgcttcg

SEQ ID NO: 739 - DNA, 15 bp, Homo sapiens
gctaggaggtgcttc

SEQ ID NO: 740 - DNA, 15 bp, Homo sapiens
ggctaggaggtgctt

SEQ ID NO: 741 - DNA, 15 bp, Homo sapiens
gggctaggaggtgct

SEQ ID NO: 742 - DNA, 15 bp, Homo sapiens
tgggctaggaggtgc

SEQ ID NO: 743 - DNA, 15 bp, Homo sapiens
ttgggctaggaggtg

SEQ ID NO: 744 - DNA, 15 bp, Homo sapiens
cttgggctaggaggt

SEQ ID NO: 745 - DNA, 15 bp, Homo sapiens
acttgggctaggagg

SEQ ID NO: 746 - DNA, 15 bp, Homo sapiens
gacttgggctaggag

SEQ ID NO: 747 - DNA, 15 bp, Homo sapiens
agacttgggctagga

SEQ ID NO: 748 - DNA, 15 bp, Homo sapiens
tagacttgggctagg

SEQ ID NO: 749 - DNA, 15 bp, Homo sapiens
ctagacttgggctag

SEQ ID NO: 750 - DNA, 15 bp, Homo sapiens
gctagacttgggcta

SEQ ID NO: 751 - DNA, 15 bp, Homo sapiens
agctagacttgggct

SEQ ID NO: 752 - DNA, 15 bp, Homo sapiens
cagctagacttgggc

SEQ ID NO: 753 - DNA, 15 bp, Homo sapiens
gcagctagacttggg

SEQ ID NO: 754 - DNA, 15 bp, Homo sapiens
agcagctagacttgg

SEQ ID NO: 755 - DNA, 15 bp, Homo sapiens
cagcagctagacttg

SEQ ID NO: 756 - DNA, 15 bp, Homo sapiens
acagcagctagactt

SEQ ID NO: 757 - DNA, 15 bp, Homo sapiens
cacagcagctagact

SEQ ID NO: 758 - DNA, 15 bp, Homo sapiens
acacagcagctagac

SEQ ID NO: 759 - DNA, 15 bp, Homo sapiens
cacacagcagctaga

SEQ ID NO: 760 - DNA, 15 bp, Homo sapiens
ccacacagcagctag

SEQ ID NO: 761 - DNA, 15 bp, Homo sapiens
gccacacagcagcta

SEQ ID NO: 762 - DNA, 15 bp, Homo sapiens
tgccacacagcagct

SEQ ID NO: 763 - DNA, 15 bp, Homo sapiens
ctgccacacagcagc

SEQ ID NO: 764 - DNA, 15 bp, Homo sapiens
gctgccacacagcag

SEQ ID NO: 765 - DNA, 15 bp, Homo sapiens
agctgccacacagca

SEQ ID NO: 766 - DNA, 15 bp, Homo sapiens
gagctgccacacagc

SEQ ID NO: 767 - DNA, 15 bp, Homo sapiens
ggagctgccacacag

SEQ ID NO: 768 - DNA, 15 bp, Homo sapiens
tggagctgccacaca

SEQ ID NO: 769 - DNA, 15 bp, Homo sapiens
ctggagctgccacac

SEQ ID NO: 770 - DNA, 15 bp, Homo sapiens
gctggagctgccaca

SEQ ID NO: 771 - DNA, 15 bp, Homo sapiens
cgctggagctgccac

SEQ ID NO: 772 - DNA, 15 bp, Homo sapiens
ccgctggagctgcca

SEQ ID NO: 773 - DNA, 15 bp, Homo sapiens
gccgctggagctgcc

SEQ ID NO: 774 - DNA, 15 bp, Homo sapiens
cgccgctggagctgc

SEQ ID NO: 775 - DNA, 15 bp, Homo sapiens
acgccgctggagctg

SEQ ID NO: 776 - DNA, 15 bp, Homo sapiens
cacgccgctggagct

SEQ ID NO: 777 - DNA, 15 bp, Homo sapiens
tcacgccgctggagc

SEQ ID NO: 778 - DNA, 15 bp, Homo sapiens
ttcacgccgctggag

SEQ ID NO: 779 - DNA, 15 bp, Homo sapiens
gttcacgccgctgga

SEQ ID NO: 780 - DNA, 15 bp, Homo sapiens
agttcacgccgctgg

SEQ ID NO: 781 - DNA, 15 bp, Homo sapiens
cagttcacgccgctg

SEQ ID NO: 782 - DNA, 15 bp, Homo sapiens
acagttcacgccgct

SEQ ID NO: 783 - DNA, 15 bp, Homo sapiens
cacagttcacgccgc

SEQ ID NO: 784 - DNA, 15 bp, Homo sapiens
tcacagttcacgccg

SEQ ID NO: 785 - DNA, 15 bp, Homo sapiens
gtcacagttcacgcc

SEQ ID NO: 786 - DNA, 15 bp, Homo sapiens
agtcacagttcacgc

SEQ ID NO: 787 - DNA, 15 bp, Homo sapiens
cagtcacagttcacg

SEQ ID NO: 788 - DNA, 15 bp, Homo sapiens
gcagtcacagttcac

SEQ ID NO: 789 - DNA, 15 bp, Homo sapiens
ggcagtcacagttca

SEQ ID NO: 790 - DNA, 15 bp, Homo sapiens
gggcagtcacagttc

SEQ ID NO: 791 - DNA, 15 bp, Homo sapiens
agggcagtcacagtt

SEQ ID NO: 792 - DNA, 15 bp, Homo sapiens
cagggcagtcacagt

SEQ ID NO: 793 - DNA, 15 bp, Homo sapiens
gcagggcagtcacag

SEQ ID NO: 794 - DNA, 15 bp, Homo sapiens
tgcagggcagtcaca

SEQ ID NO: 795 - DNA, 15 bp, Homo sapiens
ctgcagggcagtcac

SEQ ID NO: 796 - DNA, 15 bp, Homo sapiens
tctgcagggcagtca

SEQ ID NO: 797 - DNA, 15 bp, Homo sapiens
gtctgcagggcagtc

SEQ ID NO: 798 - DNA, 15 bp, Homo sapiens
tgtctgcagggcagt

SEQ ID NO: 799 - DNA, 15 bp, Homo sapiens
gtgtctgcagggcag

SEQ ID NO: 800 - DNA, 15 bp, Homo sapiens
ggtgtctgcagggca

SEQ ID NO: 801 - DNA, 15 bp, Homo sapiens
aggtgtctgcagggc

SEQ ID NO: 802 - DNA, 15 bp, Homo sapiens
taggtgtctgcaggg

SEQ ID NO: 803 - DNA, 15 bp, Homo sapiens
ataggtgtctgcagg

SEQ ID NO: 804 - DNA, 15 bp, Homo sapiens
gataggtgtctgcag

SEQ ID NO: 805 - DNA, 15 bp, Homo sapiens
tgataggtgtctgca

SEQ ID NO: 806 - DNA, 15 bp, Homo sapiens
ttgataggtgtctgc

SEQ ID NO: 807 - DNA, 15 bp, Homo sapiens
cttgataggtgtctg

SEQ ID NO: 808 - DNA, 15 bp, Homo sapiens
gcttgataggtgtct

SEQ ID NO: 809 - DNA, 15 bp, Homo sapiens
cgcttgataggtgtc

SEQ ID NO: 810 - DNA, 15 bp, Homo sapiens
gcgcttgataggtgt

SEQ ID NO: 811 - DNA, 15 bp, Homo sapiens
agcgcttgataggtg

SEQ ID NO: 812 - DNA, 15 bp, Homo sapiens
cagcgcttgataggt

SEQ ID NO: 813 - DNA, 15 bp, Homo sapiens
gcagcgcttgatagg

SEQ ID NO: 814 - DNA, 15 bp, Homo sapiens
cgcagcgcttgatag

SEQ ID NO: 815 - DNA, 15 bp, Homo sapiens
acgcagcgcttgata

SEQ ID NO: 816 - DNA, 15 bp, Homo sapiens
gacgcagcgcttgat

SEQ ID NO: 817 - DNA, 15 bp, Homo sapiens
tgacgcagcgcttga

SEQ ID NO: 818 - DNA, 15 bp, Homo sapiens
ctgacgcagcgcttg

SEQ ID NO: 819 - DNA, 15 bp, Homo sapiens
gctgacgcagcgctt

SEQ ID NO: 820 - DNA, 15 bp, Homo sapiens
agctgacgcagcgct

SEQ ID NO: 821 - DNA, 15 bp, Homo sapiens
tagctgacgcagcgc

SEQ ID NO: 822 - DNA, 15 bp, Homo sapiens
atagctgacgcagcg

SEQ ID NO: 823 - DNA, 15 bp, Homo sapiens
aatagctgacgcagc

SEQ ID NO: 824 - DNA, 15 bp, Homo sapiens
taatagctgacgcag

SEQ ID NO: 825 - DNA, 15 bp, Homo sapiens
ttaatagctgacgca

SEQ ID NO: 826 - DNA, 15 bp, Homo sapiens
attaatagctgacgc

SEQ ID NO: 827 - DNA, 15 bp, Homo sapiens
tattaatagctgacg

SEQ ID NO: 828 - DNA, 15 bp, Homo sapiens
ttattaatagctgac

SEQ ID NO: 829 - DNA, 15 bp, Homo sapiens
attattaatagctga

SEQ ID NO: 830 - DNA, 15 bp, Homo sapiens
tattattaatagctg

SEQ ID NO: 831 - DNA, 15 bp, Homo sapiens
ttattattaatagct

SEQ ID NO: 832 - DNA, 15 bp, Homo sapiens
tttattattaatagc

SEQ ID NO: 833 - DNA, 15 bp, Homo sapiens
ttttattattaatag

SEQ ID NO: 834 - DNA, 15 bp, Homo sapiens
attttattattaata

SEQ ID NO: 835 - DNA, 15 bp, Homo sapiens
gattttattattaat

SEQ ID NO: 836 - DNA, 15 bp, Homo sapiens
tgattttattattaa

SEQ ID NO: 837 - DNA, 15 bp, Homo sapiens
ttgattttattatta

SEQ ID NO: 838 - DNA, 15 bp, Homo sapiens
gttgattttattatt

SEQ ID NO: 839 - DNA, 15 bp, Homo sapiens
agttgattttattat

SEQ ID NO: 840 - DNA, 15 bp, Homo sapiens
gagttgattttatta

SEQ ID NO: 841 - DNA, 15 bp, Homo sapiens
agagttgattttatt

SEQ ID NO: 842 - DNA, 15 bp, Homo sapiens
aagagttgattttat

SEQ ID NO: 843 - DNA, 15 bp, Homo sapiens
gaagagttgatttta

SEQ ID NO: 844 - DNA, 15 bp, Homo sapiens
agaagagttgatttt

SEQ ID NO: 845 - DNA, 15 bp, Homo sapiens
gagaagagttgattt

SEQ ID NO: 846 - DNA, 15 bp, Homo sapiens
ggagaagagttgatt

SEQ ID NO: 847 - DNA, 15 bp, Homo sapiens
gggagaagagttgat

SEQ ID NO: 848 - DNA, 15 bp, Homo sapiens
agggagaagagttga

SEQ ID NO: 849 - DNA, 15 bp, Homo sapiens
gagggagaagagttg

SEQ ID NO: 850 - DNA, 15 bp, Homo sapiens
ggagggagaagagtt

SEQ ID NO: 851 - DNA, 15 bp, Homo sapiens
gggagggagaagagt

SEQ ID NO: 852 - DNA, 15 bp, Homo sapiens
ggggagggagaagag

SEQ ID NO: 853 - DNA, 15 bp, Homo sapiens
gggggagggagaaga

SEQ ID NO: 854 - DNA, 15 bp, Homo sapiens
ggggggagggagaag

SEQ ID NO: 855 - DNA, 15 bp, Homo sapiens
gggggggagggagaa

SEQ ID NO: 856 - DNA, 15 bp, Homo sapiens
cgggggggagggaga

SEQ ID NO: 857 - DNA, 15 bp, Homo sapiens
gcgggggggagggag

SEQ ID NO: 858 - DNA, 15 bp, Homo sapiens
cgcgggggggaggga

SEQ ID NO: 859 - DNA, 15 bp, Homo sapiens
tcgcgggggggaggg

SEQ ID NO: 860 - DNA, 15 bp, Homo sapiens
ctcgcgggggggagg

SEQ ID NO: 861 - DNA, 15 bp, Homo sapiens
cctcgcgggggggag

SEQ ID NO: 862 - DNA, 15 bp, Homo sapiens
ccctcgcggggggga

SEQ ID NO: 863 - DNA, 15 bp, Homo sapiens
cccctcgcggggggg

SEQ ID NO: 864 - DNA, 15 bp, Homo sapiens
ccccctcgcgggggg

SEQ ID NO: 865 - DNA, 15 bp, Homo sapiens
cccccctcgcggggg

SEQ ID NO: 866 - DNA, 15 bp, Homo sapiens
acccccctcgcgggg

SEQ ID NO: 867 - DNA, 15 bp, Homo sapiens
aacccccctcgcggg

SEQ ID NO: 868 - DNA, 15 bp, Homo sapiens
gaacccccctcgcgg

SEQ ID NO: 869 - DNA, 15 bp, Homo sapiens
ggaacccccctcgcg

SEQ ID NO: 870 - DNA, 15 bp, Homo sapiens
gggaacccccctcgc

SEQ ID NO: 871 - DNA, 15 bp, Homo sapiens
agggaacccccctcg

SEQ ID NO: 872 - DNA, 15 bp, Homo sapiens
gagggaacccccctc

SEQ ID NO: 873 - DNA, 15 bp, Homo sapiens
cgagggaacccccct

SEQ ID NO: 874 - DNA, 15 bp, Homo sapiens
acgagggaacccccc

SEQ ID NO: 875 - DNA, 15 bp, Homo sapiens
gacgagggaaccccc

SEQ ID NO: 876 - DNA, 15 bp, Homo sapiens
tgacgagggaacccc

SEQ ID NO: 877 - DNA, 15 bp, Homo sapiens
ctgacgagggaaccc

SEQ ID NO: 878 - DNA, 15 bp, Homo sapiens
cctgacgagggaacc

SEQ ID NO: 879 - DNA, 15 bp, Homo sapiens
ccctgacgagggaac

SEQ ID NO: 880 - DNA, 15 bp, Homo sapiens
gccctgacgagggaa

SEQ ID NO: 881 - DNA, 15 bp, Homo sapiens
ggccctgacgaggga

SEQ ID NO: 882 - DNA, 15 bp, Homo sapiens
gggccctgacgaggg

SEQ ID NO: 883 - DNA, 15 bp, Homo sapiens
tgggccctgacgagg

SEQ ID NO: 884 - DNA, 15 bp, Homo sapiens
ctgggccctgacgag

SEQ ID NO: 885 - DNA, 15 bp, Homo sapiens
tctgggccctgacga

SEQ ID NO: 886 - DNA, 15 bp, Homo sapiens
ttctgggccctgacg

SEQ ID NO: 887 - DNA, 15 bp, Homo sapiens
gttctgggccctgac

SEQ ID NO: 888 - DNA, 15 bp, Homo sapiens
ggttctgggccctga

SEQ ID NO: 889 - DNA, 15 bp, Homo sapiens
gggttctgggccctg

SEQ ID NO: 890 - DNA, 15 bp, Homo sapiens
cgggttctgggccct

SEQ ID NO: 891 - DNA, 15 bp, Homo sapiens
gcgggttctgggccc

SEQ ID NO: 892 - DNA, 15 bp, Homo sapiens
agcgggttctgggcc

SEQ ID NO: 893 - DNA, 15 bp, Homo sapiens
cagcgggttctgggc

SEQ ID NO: 894 - DNA, 15 bp, Homo sapiens
ccagcgggttctggg

SEQ ID NO: 895 - DNA, 15 bp, Homo sapiens
cccagcgggttctgg

SEQ ID NO: 896 - DNA, 15 bp, Homo sapiens
ccccagcgggttctg

SEQ ID NO: 897 - DNA, 15 bp, Homo sapiens
tccccagcgggttct

SEQ ID NO: 898 - DNA, 15 bp, Homo sapiens
ttccccagcgggttc

SEQ ID NO: 899 - DNA, 15 bp, Homo sapiens
cttccccagcgggtt

SEQ ID NO: 900 - DNA, 15 bp, Homo sapiens
tcttccccagcgggt

SEQ ID NO: 901 - DNA, 15 bp, Homo sapiens
ttcttccccagcggg

SEQ ID NO: 902 - DNA, 15 bp, Homo sapiens
attcttccccagcgg

SEQ ID NO: 903 - DNA, 15 bp, Homo sapiens
gattcttccccagcg

SEQ ID NO: 904 - DNA, 15 bp, Homo sapiens
cgattcttccccagc

SEQ ID NO: 905 - DNA, 15 bp, Homo sapiens
ccgattcttccccag

SEQ ID NO: 906 - DNA, 15 bp, Homo sapiens
cccgattcttcccca

SEQ ID NO: 907 - DNA, 15 bp, Homo sapiens
ccccgattcttcccc

SEQ ID NO: 908 - DNA, 15 bp, Homo sapiens
gccccgattcttccc

SEQ ID NO: 909 - DNA, 15 bp, Homo sapiens
agccccgattcttcc

SEQ ID NO: 910 - DNA, 15 bp, Homo sapiens
cagccccgattcttc

SEQ ID NO: 911 - DNA, 15 bp, Homo sapiens
ccagccccgattctt

SEQ ID NO: 912 - DNA, 15 bp, Homo sapiens
gccagccccgattct

SEQ ID NO: 913 - DNA, 15 bp, Homo sapiens
cgccagccccgattc

SEQ ID NO: 914 - DNA, 15 bp, Homo sapiens
acgccagccccgatt

SEQ ID NO: 915 - DNA, 15 bp, Homo sapiens
cacgccagccccgat

SEQ ID NO: 916 - DNA, 15 bp, Homo sapiens
gcacgccagccccga

SEQ ID NO: 917 - DNA, 15 bp, Homo sapiens
cgcacgccagccccg

SEQ ID NO: 918 - DNA, 15 bp, Homo sapiens
tcgcacgccagcccc

SEQ ID NO: 919 - DNA, 15 bp, Homo sapiens
ttcgcacgccagccc

SEQ ID NO: 920 - DNA, 15 bp, Homo sapiens
cttcgcacgccagcc

SEQ ID NO: 921 - DNA, 15 bp, Homo sapiens
ccttcgcacgccagc

SEQ ID NO: 922 - DNA, 15 bp, Homo sapiens
tccttcgcacgccag

SEQ ID NO: 923 - DNA, 15 bp, Homo sapiens
ctccttcgcacgcca

SEQ ID NO: 924 - DNA, 15 bp, Homo sapiens
gctccttcgcacgcc

SEQ ID NO: 925 - DNA, 15 bp, Homo sapiens
agctccttcgcacgc

SEQ ID NO: 926 - DNA, 15 bp, Homo sapiens
cagctccttcgcacg

SEQ ID NO: 927 - DNA, 15 bp, Homo sapiens
ccagctccttcgcac

SEQ ID NO: 928 - DNA, 15 bp, Homo sapiens
gccagctccttcgca

SEQ ID NO: 929 - DNA, 15 bp, Homo sapiens
cgccagctccttcgc

SEQ ID NO: 930 - DNA, 15 bp, Homo sapiens
ccgccagctccttcg

SEQ ID NO: 931 - DNA, 15 bp, Homo sapiens
gccgccagctccttc

SEQ ID NO: 932 - DNA, 15 bp, Homo sapiens
tgccgccagctcctt

SEQ ID NO: 933 - DNA, 15 bp, Homo sapiens
ctgccgccagctcct

SEQ ID NO: 934 - DNA, 15 bp, Homo sapiens
cctgccgccagctcc

SEQ ID NO: 935 - DNA, 15 bp, Homo sapiens
ccctgccgccagctc

SEQ ID NO: 936 - DNA, 15 bp, Homo sapiens
cccctgccgccagct

SEQ ID NO: 937 - DNA, 15 bp, Homo sapiens
ccccctgccgccagc

SEQ ID NO: 938 - DNA, 15 bp, Homo sapiens
accccctgccgccag

SEQ ID NO: 939 - DNA, 15 bp, Homo sapiens
caccccctgccgcca

SEQ ID NO: 940 - DNA, 15 bp, Homo sapiens
acaccccctgccgcc

SEQ ID NO: 941 - DNA, 15 bp, Homo sapiens
tacaccccctgccgc

SEQ ID NO: 942 - DNA, 15 bp, Homo sapiens
ctacaccccctgccg

SEQ ID NO: 943 - DNA, 15 bp, Homo sapiens
cctacaccccctgcc

SEQ ID NO: 944 - DNA, 15 bp, Homo sapiens
tcctacaccccctgc

SEQ ID NO: 945 - DNA, 15 bp, Homo sapiens
atcctacaccccctg

SEQ ID NO: 946 - DNA, 15 bp, Homo sapiens
catcctacaccccct

SEQ ID NO: 947 - DNA, 15 bp, Homo sapiens
gcatcctacaccccc

SEQ ID NO: 948 - DNA, 15 bp, Homo sapiens
cgcatcctacacccc

SEQ ID NO: 949 - DNA, 15 bp, Homo sapiens
ccgcatcctacaccc

SEQ ID NO: 950 - DNA, 15 bp, Homo sapiens
accgcatcctacacc

SEQ ID NO: 951 - DNA, 15 bp, Homo sapiens
caccgcatcctacac

SEQ ID NO: 952 - DNA, 15 bp, Homo sapiens
acaccgcatcctaca

SEQ ID NO: 953 - DNA, 15 bp, Homo sapiens
aacaccgcatcctac

SEQ ID NO: 954 - DNA, 15 bp, Homo sapiens
gaacaccgcatccta

SEQ ID NO: 955 - DNA, 15 bp, Homo sapiens
ggaacaccgcatcct

SEQ ID NO: 956 - DNA, 15 bp, Homo sapiens
gggaacaccgcatcc

SEQ ID NO: 957 - DNA, 15 bp, Homo sapiens
cgggaacaccgcatc

SEQ ID NO: 958 - DNA, 15 bp, Homo sapiens
tcgggaacaccgcat

SEQ ID NO: 959 - DNA, 15 bp, Homo sapiens
ctcgggaacaccgca

SEQ ID NO: 960 - DNA, 15 bp, Homo sapiens
cctcgggaacaccgc

SEQ ID NO: 961 - DNA, 15 bp, Homo sapiens
gcctcgggaacaccg

SEQ ID NO: 962 - DNA, 15 bp, Homo sapiens
cgcctcgggaacacc

SEQ ID NO: 963 - DNA, 15 bp, Homo sapiens
tcgcctcgggaacac

SEQ ID NO: 964 - DNA, 15 bp, Homo sapiens
gtcgcctcgggaaca

SEQ ID NO: 965 - DNA, 15 bp, Homo sapiens
tgtcgcctcgggaac

SEQ ID NO: 966 - DNA, 15 bp, Homo sapiens
ctgtcgcctcgggaa

SEQ ID NO: 967 - DNA, 15 bp, Homo sapiens
tctgtcgcctcggga

SEQ ID NO: 968 - DNA, 15 bp, Homo sapiens
atctgtcgcctcggg

SEQ ID NO: 969 - DNA, 15 bp, Homo sapiens
catctgtcgcctcgg

SEQ ID NO: 970 - DNA, 15 bp, Homo sapiens
tcatctgtcgcctcg

SEQ ID NO: 971 - DNA, 15 bp, Homo sapiens
ttcatctgtcgcctc

SEQ ID NO: 972 - DNA, 15 bp, Homo sapiens
cttcatctgtcgcct

SEQ ID NO: 973 - DNA, 15 bp, Homo sapiens
ccttcatctgtcgcc

SEQ ID NO: 974 - DNA, 15 bp, Homo sapiens
tccttcatctgtcgc

SEQ ID NO: 975 - DNA, 15 bp, Homo sapiens
atccttcatctgtcg

SEQ ID NO: 976 - DNA, 15 bp, Homo sapiens
aatccttcatctgtc

SEQ ID NO: 977 - DNA, 15 bp, Homo sapiens
aaatccttcatctgt

SEQ ID NO: 978 - DNA, 15 bp, Homo sapiens
caaatccttcatctg

SEQ ID NO: 979 - DNA, 15 bp, Homo sapiens
ccaaatccttcatct

SEQ ID NO: 980 - DNA, 15 bp, Homo sapiens
cccaaatccttcatc

SEQ ID NO: 981 - DNA, 15 bp, Homo sapiens
acccaaatccttcat

SEQ ID NO: 982 - DNA, 15 bp, Homo sapiens
aacccaaatccttca

SEQ ID NO: 983 - DNA, 15 bp, Homo sapiens
caacccaaatccttc

SEQ ID NO: 984 - DNA, 15 bp, Homo sapiens
acaacccaaatcctt

SEQ ID NO: 985 - DNA, 15 bp, Homo sapiens
cacaacccaaatcct

SEQ ID NO: 986 - DNA, 15 bp, Homo sapiens
acacaacccaaatcc

SEQ ID NO: 987 - DNA, 15 bp, Homo sapiens
cacacaacccaaatc

SEQ ID NO: 988 - DNA, 15 bp, Homo sapiens
ccacacaacccaaat

SEQ ID NO: 989 - DNA, 15 bp, Homo sapiens
cccacacaacccaaa

SEQ ID NO: 990 - DNA, 15 bp, Homo sapiens
tcccacacaacccaa

SEQ ID NO: 991 - DNA, 15 bp, Homo sapiens
ttcccacacaaccca

SEQ ID NO: 992 - DNA, 15 bp, Homo sapiens
cttcccacacaaccc

SEQ ID NO: 993 - DNA, 15 bp, Homo sapiens
acttcccacacaacc

SEQ ID NO: 994 - DNA, 15 bp, Homo sapiens
cacttcccacacaac

SEQ ID NO: 995 - DNA, 15 bp, Homo sapiens
tcacttcccacacaa

SEQ ID NO: 996 - DNA, 15 bp, Homo sapiens
ttcacttcccacaca

SEQ ID NO: 997 - DNA, 15 bp, Homo sapiens
gttcacttcccacac

SEQ ID NO: 998 - DNA, 15 bp, Homo sapiens
agttcacttcccaca

SEQ ID NO: 999 - DNA, 15 bp, Homo sapiens
cagttcacttcccac

SEQ ID NO: 1000 - DNA, 15 bp, Homo sapiens
gcagttcacttccca

SEQ ID NO: 1001 - DNA, 15 bp, Homo sapiens
cgcagttcacttccc

SEQ ID NO: 1002 - DNA, 15 bp, Homo sapiens
ccgcagttcacttcc

SEQ ID NO: 1003 - DNA, 15 bp, Homo sapiens
tccgcagttcacttc

SEQ ID NO: 1004 - DNA, 15 bp, Homo sapiens
ttccgcagttcactt

SEQ ID NO: 1005 - DNA, 15 bp, Homo sapiens
attccgcagttcact

SEQ ID NO: 1006 - DNA, 15 bp, Homo sapiens
aattccgcagttcac

SEQ ID NO: 1007 - DNA, 15 bp, Homo sapiens
gaattccgcagttca

SEQ ID NO: 1008 - DNA, 15 bp, Homo sapiens
ggaattccgcagttc

SEQ ID NO: 1009 - DNA, 15 bp, Homo sapiens
aggaattccgcagtt

SEQ ID NO: 1010 - DNA, 15 bp, Homo sapiens
gaggaattccgcagt

SEQ ID NO: 1011 - DNA, 15 bp, Homo sapiens
ggaggaattccgcag

SEQ ID NO: 1012 - DNA, 15 bp, Homo sapiens
gggaggaattccgca

SEQ ID NO: 1013 - DNA, 15 bp, Homo sapiens
ggggaggaattccgc

SEQ ID NO: 1014 - DNA, 15 bp, Homo sapiens
aggggaggaattccg

SEQ ID NO: 1015 - DNA, 15 bp, Homo sapiens
aaggggaggaattcc

SEQ ID NO: 1016 - DNA, 15 bp, Homo sapiens
caaggggaggaattc

SEQ ID NO: 1017 - DNA, 15 bp, Homo sapiens
ccaaggggaggaatt

SEQ ID NO: 1018 - DNA, 15 bp, Homo sapiens
accaaggggaggaat

SEQ ID NO: 1019 - DNA, 15 bp, Homo sapiens
aaccaaggggaggaa

SEQ ID NO: 1020 - DNA, 15 bp, Homo sapiens
aaaccaaggggagga

SEQ ID NO: 1021 - DNA, 15 bp, Homo sapiens
gaaaccaaggggagg

SEQ ID NO: 1022 - DNA, 15 bp, Homo sapiens
agaaaccaaggggag

SEQ ID NO: 1023 - DNA, 15 bp, Homo sapiens
cagaaaccaagggga

SEQ ID NO: 1024 - DNA, 15 bp, Homo sapiens
tcagaaaccaagggg

SEQ ID NO: 1025 - DNA, 15 bp, Homo sapiens
ctcagaaaccaaggg

SEQ ID NO: 1026 - DNA, 15 bp, Homo sapiens
cctcagaaaccaagg

SEQ ID NO: 1027 - DNA, 15 bp, Homo sapiens
ccctcagaaaccaag

SEQ ID NO: 1028 - DNA, 15 bp, Homo sapiens
cccctcagaaaccaa

SEQ ID NO: 1029 - DNA, 15 bp, Homo sapiens
ccccctcagaaacca

SEQ ID NO: 1030 - DNA, 15 bp, Homo sapiens
cccccctcagaaacc

SEQ ID NO: 1031 - DNA, 15 bp, Homo sapiens
gcccccctcagaaac

SEQ ID NO: 1032 - DNA, 15 bp, Homo sapiens
agcccccctcagaaa

SEQ ID NO: 1033 - DNA, 15 bp, Homo sapiens
gagcccccctcagaa

SEQ ID NO: 1034 - DNA, 15 bp, Homo sapiens
agagcccccctcaga

SEQ ID NO: 1035 - DNA, 15 bp, Homo sapiens
cagagcccccctcag

SEQ ID NO: 1036 - DNA, 15 bp, Homo sapiens
tcagagcccccctca

SEQ ID NO: 1037 - DNA, 15 bp, Homo sapiens
ttcagagcccccctc

SEQ ID NO: 1038 - DNA, 15 bp, Homo sapiens
cttcagagcccccct

SEQ ID NO: 1039 - DNA, 15 bp, Homo sapiens
ccttcagagcccccc

SEQ ID NO: 1040 - DNA, 15 bp, Homo sapiens
tccttcagagccccc

SEQ ID NO: 1041 - DNA, 15 bp, Homo sapiens
ctccttcagagcccc

SEQ ID NO: 1042 - DNA, 15 bp, Homo sapiens
gctccttcagagccc

SEQ ID NO: 1043 - DNA, 15 bp, Homo sapiens
ggctccttcagagcc

SEQ ID NO: 1044 - DNA, 15 bp, Homo sapiens
tggctccttcagagc

SEQ ID NO: 1045 - DNA, 15 bp, Homo sapiens
ctggctccttcagag

SEQ ID NO: 1046 - DNA, 15 bp, Homo sapiens
tctggctccttcaga

SEQ ID NO: 1047 - DNA, 15 bp, Homo sapiens
atctggctccttcag

SEQ ID NO: 1048 - DNA, 15 bp, Homo sapiens
aatctggctccttca

SEQ ID NO: 1049 - DNA, 15 bp, Homo sapiens
taatctggctccttc

SEQ ID NO: 1050 - DNA, 15 bp, Homo sapiens
ctaatctggctcctt

SEQ ID NO: 1051 - DNA, 15 bp, Homo sapiens
cctaatctggctcct

SEQ ID NO: 1052 - DNA, 15 bp, Homo sapiens
tcctaatctggctcc

SEQ ID NO: 1053 - DNA, 15 bp, Homo sapiens
atcctaatctggctc

SEQ ID NO: 1054 - DNA, 15 bp, Homo sapiens
catcctaatctggct

SEQ ID NO: 1055 - DNA, 15 bp, Homo sapiens
gcatcctaatctggc

SEQ ID NO: 1056 - DNA, 15 bp, Homo sapiens
tgcatcctaatctgg

SEQ ID NO: 1057 - DNA, 15 bp, Homo sapiens
ctgcatcctaatctg

SEQ ID NO: 1058 - DNA, 15 bp, Homo sapiens
tctgcatcctaatct

SEQ ID NO: 1059 - DNA, 15 bp, Homo sapiens
ctctgcatcctaatc

SEQ ID NO: 1060 - DNA, 15 bp, Homo sapiens
gctctgcatcctaat

SEQ ID NO: 1061 - DNA, 15 bp, Homo sapiens
cgctctgcatcctaa

SEQ ID NO: 1062 - DNA, 15 bp, Homo sapiens
gcgctctgcatccta

SEQ ID NO: 1063 - DNA, 15 bp, Homo sapiens
tgcgctctgcatcct

SEQ ID NO: 1064 - DNA, 15 bp, Homo sapiens
ctgcgctctgcatcc

SEQ ID NO: 1065 - DNA, 15 bp, Homo sapiens
gctgcgctctgcatc

SEQ ID NO: 1066 - DNA, 15 bp, Homo sapiens
ggctgcgctctgcat

SEQ ID NO: 1067 - DNA, 15 bp, Homo sapiens
gggctgcgctctgca

SEQ ID NO: 1068 - DNA, 15 bp, Homo sapiens
cgggctgcgctctgc

SEQ ID NO: 1069 - DNA, 15 bp, Homo sapiens
ccgggctgcgctctg

SEQ ID NO: 1070 - DNA, 15 bp, Homo sapiens
cccgggctgcgctct

SEQ ID NO: 1071 - DNA, 15 bp, Homo sapiens
gcccgggctgcgctc

SEQ ID NO: 1072 - DNA, 15 bp, Homo sapiens
cgcccgggctgcgct

SEQ ID NO: 1073 - DNA, 15 bp, Homo sapiens
tcgcccgggctgcgc

SEQ ID NO: 1074 - DNA, 15 bp, Homo sapiens
gtcgcccgggctgcg

SEQ ID NO: 1075 - DNA, 15 bp, Homo sapiens
ggtcgcccgggctgc

SEQ ID NO: 1076 - DNA, 15 bp, Homo sapiens
cggtcgcccgggctg

SEQ ID NO: 1077 - DNA, 15 bp, Homo sapiens
tcggtcgcccgggct

SEQ ID NO: 1078 - DNA, 15 bp, Homo sapiens
ctcggtcgcccgggc

SEQ ID NO: 1079 - DNA, 15 bp, Homo sapiens
cctcggtcgcccggg

SEQ ID NO: 1080 - DNA, 15 bp, Homo sapiens
ccctcggtcgcccgg

SEQ ID NO: 1081 - DNA, 15 bp, Homo sapiens
gccctcggtcgcccg

SEQ ID NO: 1082 - DNA, 15 bp, Homo sapiens
cgccctcggtcgccc

SEQ ID NO: 1083 - DNA, 15 bp, Homo sapiens
tcgccctcggtcgcc

SEQ ID NO: 1084 - DNA, 15 bp, Homo sapiens
ctcgccctcggtcgc

SEQ ID NO: 1085 - DNA, 15 bp, Homo sapiens
cctcgccctcggtcg

SEQ ID NO: 1086 - DNA, 15 bp, Homo sapiens
tcctcgccctcggtc

SEQ ID NO: 1087 - DNA, 15 bp, Homo sapiens
ctcctcgccctcggt

SEQ ID NO: 1088 - DNA, 15 bp, Homo sapiens
cctcctcgccctcgg

SEQ ID NO: 1089 - DNA, 15 bp, Homo sapiens
gcctcctcgccctcg

SEQ ID NO: 1090 - DNA, 15 bp, Homo sapiens
cgcctcctcgccctc

SEQ ID NO: 1091 - DNA, 15 bp, Homo sapiens
tcgcctcctcgccct

SEQ ID NO: 1092 - DNA, 15 bp, Homo sapiens
ctcgcctcctcgccc

SEQ ID NO: 1093 - DNA, 15 bp, Homo sapiens
gctcgcctcctcgcc

SEQ ID NO: 1094 - DNA, 15 bp, Homo sapiens
ggctcgcctcctcgc

SEQ ID NO: 1095 - DNA, 15 bp, Homo sapiens
tggctcgcctcctcg

SEQ ID NO: 1096 - DNA, 15 bp, Homo sapiens
ttggctcgcctcctc

SEQ ID NO: 1097 - DNA, 15 bp, Homo sapiens
cttggctcgcctcct

SEQ ID NO: 1098 - DNA, 15 bp, Homo sapiens
ccttggctcgcctcc

SEQ ID NO: 1099 - DNA, 15 bp, Homo sapiens
tccttggctcgcctc

SEQ ID NO: 1100 - DNA, 15 bp, Homo sapiens
gtccttggctcgcct

SEQ ID NO: 1101 - DNA, 15 bp, Homo sapiens
tgtccttggctcgcc

SEQ ID NO: 1102 - DNA, 15 bp, Homo sapiens
atgtccttggctcgc

SEQ ID NO: 1103 - DNA, 15 bp, Homo sapiens
gatgtccttggctcg

SEQ ID NO: 1104 - DNA, 15 bp, Homo sapiens
tgatgtccttggctc

SEQ ID NO: 1105 - DNA, 15 bp, Homo sapiens
ctgatgtccttggct

SEQ ID NO: 1106 - DNA, 15 bp, Homo sapiens
gctgatgtccttggc

SEQ ID NO: 1107 - DNA, 15 bp, Homo sapiens
ggctgatgtccttgg

SEQ ID NO: 1108 - DNA, 15 bp, Homo sapiens
gggctgatgtccttg

SEQ ID NO: 1109 - DNA, 15 bp, Homo sapiens
cgggctgatgtcctt

SEQ ID NO: 1110 - DNA, 15 bp, Homo sapiens
tcgggctgatgtcct

SEQ ID NO: 1111 - DNA, 15 bp, Homo sapiens
ctcgggctgatgtcc

SEQ ID NO: 1112 - DNA, 15 bp, Homo sapiens
cctcgggctgatgtc

SEQ ID NO: 1113 - DNA, 15 bp, Homo sapiens
ccctcgggctgatgt

SEQ ID NO: 1114 - DNA, 15 bp, Homo sapiens
gccctcgggctgatg

SEQ ID NO: 1115 - DNA, 15 bp, Homo sapiens
cgccctcgggctgat

SEQ ID NO: 1116 - DNA, 15 bp, Homo sapiens
gcgccctcgggctga

SEQ ID NO: 1117 - DNA, 15 bp, Homo sapiens
ggcgccctcgggctg

SEQ ID NO: 1118 - DNA, 15 bp, Homo sapiens
aggcgccctcgggct

SEQ ID NO: 1119 - DNA, 15 bp, Homo sapiens
gaggcgccctcgggc

SEQ ID NO: 1120 - DNA, 15 bp, Homo sapiens
cgaggcgccctcggg

SEQ ID NO: 1121 - DNA, 15 bp, Homo sapiens
tcgaggcgccctcgg

SEQ ID NO: 1122 - DNA, 15 bp, Homo sapiens
ctcgaggcgccctcg

SEQ ID NO: 1123 - DNA, 15 bp, Homo sapiens
tctcgaggcgccctc

SEQ ID NO: 1124 - DNA, 15 bp, Homo sapiens
gtctcgaggcgccct

SEQ ID NO: 1125 - DNA, 15 bp, Homo sapiens
cgtctcgaggcgccc

SEQ ID NO: 1126 - DNA, 15 bp, Homo sapiens
gcgtctcgaggcgcc

SEQ ID NO: 1127 - DNA, 15 bp, Homo sapiens
ggcgtctcgaggcgc

SEQ ID NO: 1128 - DNA, 15 bp, Homo sapiens
gggcgtctcgaggcg

SEQ ID NO: 1129 - DNA, 15 bp, Homo sapiens
ggggcgtctcgaggc

SEQ ID NO: 1130 - DNA, 15 bp, Homo sapiens
cggggcgtctcgagg

SEQ ID NO: 1131 - DNA, 15 bp, Homo sapiens
gcggggcgtctcgag

SEQ ID NO: 1132 - DNA, 15 bp, Homo sapiens
cgcggggcgtctcga

SEQ ID NO: 1133 - DNA, 15 bp, Homo sapiens
acgcggggcgtctcg

SEQ ID NO: 1134 - DNA, 15 bp, Homo sapiens
cacgcggggcgtctc

SEQ ID NO: 1135 - DNA, 15 bp, Homo sapiens
ccacgcggggcgtct

SEQ ID NO: 1136 - DNA, 15 bp, Homo sapiens
tccacgcggggcgtc

SEQ ID NO: 1137 - DNA, 15 bp, Homo sapiens
gtccacgcggggcgt

SEQ ID NO: 1138 - DNA, 15 bp, Homo sapiens
ggtccacgcggggcg

SEQ ID NO: 1139 - DNA, 15 bp, Homo sapiens
cggtccacgcggggc

SEQ ID NO: 1140 - DNA, 15 bp, Homo sapiens
gcggtccacgcgggg

SEQ ID NO: 1141 - DNA, 15 bp, Homo sapiens
cgcggtccacgcggg

SEQ ID NO: 1142 - DNA, 15 bp, Homo sapiens
gcgcggtccacgcgg

SEQ ID NO: 1143 - DNA, 15 bp, Homo sapiens
agcgcggtccacgcg

SEQ ID NO: 1144 - DNA, 15 bp, Homo sapiens
gagcgcggtccacgc

SEQ ID NO: 1145 - DNA, 15 bp, Homo sapiens
ggagcgcggtccacg

SEQ ID NO: 1146 - DNA, 15 bp, Homo sapiens
gggagcgcggtccac

SEQ ID NO: 1147 - DNA, 15 bp, Homo sapiens
tgggagcgcggtcca

SEQ ID NO: 1148 - DNA, 15 bp, Homo sapiens
ctgggagcgcggtcc

SEQ ID NO: 1149 - DNA, 15 bp, Homo sapiens
gctgggagcgcggtc

SEQ ID NO: 1150 - DNA, 15 bp, Homo sapiens
agctgggagcgcggt

SEQ ID NO: 1151 - DNA, 15 bp, Homo sapiens
gagctgggagcgcgg

SEQ ID NO: 1152 - DNA, 15 bp, Homo sapiens
ggagctgggagcgcg

SEQ ID NO: 1153 - DNA, 15 bp, Homo sapiens
aggagctgggagcgc

SEQ ID NO: 1154 - DNA, 15 bp, Homo sapiens
gaggagctgggagcg

SEQ ID NO: 1155 - DNA, 15 bp, Homo sapiens
cgaggagctgggagc

SEQ ID NO: 1156 - DNA, 15 bp, Homo sapiens
ccgaggagctgggag

SEQ ID NO: 1157 - DNA, 15 bp, Homo sapiens
gccgaggagctggga

SEQ ID NO: 1158 - DNA, 15 bp, Homo sapiens
ggccgaggagctggg

SEQ ID NO: 1159 - DNA, 15 bp, Homo sapiens
aggccgaggagctgg

SEQ ID NO: 1160 - DNA, 15 bp, Homo sapiens
gaggccgaggagctg

SEQ ID NO: 1161 - DNA, 15 bp, Homo sapiens
cgaggccgaggagct

SEQ ID NO: 1162 - DNA, 15 bp, Homo sapiens
gcgaggccgaggagc

SEQ ID NO: 1163 - DNA, 15 bp, Homo sapiens
ggcgaggccgaggag

SEQ ID NO: 1164 - DNA, 15 bp, Homo sapiens
aggcgaggccgagga

SEQ ID NO: 1165 - DNA, 15 bp, Homo sapiens
aaggcgaggccgagg

SEQ ID NO: 1166 - DNA, 15 bp, Homo sapiens
gaaggcgaggccgag

SEQ ID NO: 1167 - DNA, 15 bp, Homo sapiens
ggaaggcgaggccga

SEQ ID NO: 1168 - DNA, 15 bp, Homo sapiens
tggaaggcgaggccg

SEQ ID NO: 1169 - DNA, 15 bp, Homo sapiens
ttggaaggcgaggcc

SEQ ID NO: 1170 - DNA, 15 bp, Homo sapiens
gttggaaggcgaggc

SEQ ID NO: 1171 - DNA, 15 bp, Homo sapiens
ggttggaaggcgagg

SEQ ID NO: 1172 - DNA, 15 bp, Homo sapiens
tggttggaaggcgag

SEQ ID NO: 1173 - DNA, 15 bp, Homo sapiens
atggttggaaggcga

SEQ ID NO: 1174 - DNA, 15 bp, Homo sapiens
gatggttggaaggcg

SEQ ID NO: 1175 - DNA, 15 bp, Homo sapiens
ggatggttggaaggc

SEQ ID NO: 1176 - DNA, 15 bp, Homo sapiens
cggatggttggaagg

SEQ ID NO: 1177 - DNA, 15 bp, Homo sapiens
gcggatggttggaag

SEQ ID NO: 1178 - DNA, 15 bp, Homo sapiens
ggcggatggttggaa

SEQ ID NO: 1179 - DNA, 15 bp, Homo sapiens
gggcggatggttgga

SEQ ID NO: 1180 - DNA, 15 bp, Homo sapiens
tgggcggatggttgg

SEQ ID NO: 1181 - DNA, 15 bp, Homo sapiens
gtgggcggatggttg

SEQ ID NO: 1182 - DNA, 15 bp, Homo sapiens
ggtgggcggatggtt

SEQ ID NO: 1183 - DNA, 15 bp, Homo sapiens
cggtgggcggatggt

SEQ ID NO: 1184 - DNA, 15 bp, Homo sapiens
ccggtgggcggatgg

SEQ ID NO: 1185 - DNA, 15 bp, Homo sapiens
gccggtgggcggatg

SEQ ID NO: 1186 - DNA, 15 bp, Homo sapiens
ggccggtgggcggat

SEQ ID NO: 1187 - DNA, 15 bp, Homo sapiens
gggccggtgggcgga

SEQ ID NO: 1188 - DNA, 15 bp, Homo sapiens
ggggccggtgggcgg

SEQ ID NO: 1189 - DNA, 15 bp, Homo sapiens
tggggccggtgggcg

SEQ ID NO: 1190 - DNA, 15 bp, Homo sapiens
ctggggccggtgggc

SEQ ID NO: 1191 - DNA, 15 bp, Homo sapiens
tctggggccggtggg

SEQ ID NO: 1192 - DNA, 15 bp, Homo sapiens
ctctggggccggtgg

SEQ ID NO: 1193 - DNA, 15 bp, Homo sapiens
gctctggggccggtg

SEQ ID NO: 1194 - DNA, 15 bp, Homo sapiens
tgctctggggccggt

SEQ ID NO: 1195 - DNA, 15 bp, Homo sapiens
ctgctctggggccgg

SEQ ID NO: 1196 - DNA, 15 bp, Homo sapiens
gctgctctggggccg

SEQ ID NO: 1197 - DNA, 15 bp, Homo sapiens
cgctgctctggggcc

SEQ ID NO: 1198 - DNA, 15 bp, Homo sapiens
acgctgctctggggc

SEQ ID NO: 1199 - DNA, 15 bp, Homo sapiens
cacgctgctctgggg

SEQ ID NO: 1200 - DNA, 15 bp, Homo sapiens
gcacgctgctctggg

SEQ ID NO: 1201 - DNA, 15 bp, Homo sapiens
ggcacgctgctctgg

SEQ ID NO: 1202 - DNA, 15 bp, Homo sapiens
gggcacgctgctctg

SEQ ID NO: 1203 - DNA, 15 bp, Homo sapiens
tgggcacgctgctct

SEQ ID NO: 1204 - DNA, 15 bp, Homo sapiens
gtgggcacgctgctc

SEQ ID NO: 1205 - DNA, 15 bp, Homo sapiens
agtgggcacgctgct

SEQ ID NO: 1206 - DNA, 15 bp, Homo sapiens
cagtgggcacgctgc

SEQ ID NO: 1207 - DNA, 15 bp, Homo sapiens
acagtgggcacgctg

SEQ ID NO: 1208 - DNA, 15 bp, Homo sapiens
cacagtgggcacgct

SEQ ID NO: 1209 - DNA, 15 bp, Homo sapiens
tcacagtgggcacgc

SEQ ID NO: 1210 - DNA, 15 bp, Homo sapiens
ctcacagtgggcacg

SEQ ID NO: 1211 - DNA, 15 bp, Homo sapiens
gctcacagtgggcac

SEQ ID NO: 1212 - DNA, 15 bp, Homo sapiens
cgctcacagtgggca

SEQ ID NO: 1213 - DNA, 15 bp, Homo sapiens
gcgctcacagtgggc

SEQ ID NO: 1214 - DNA, 15 bp, Homo sapiens
ggcgctcacagtggg

SEQ ID NO: 1215 - DNA, 15 bp, Homo sapiens
gggcgctcacagtgg

SEQ ID NO: 1216 - DNA, 15 bp, Homo sapiens
ggggcgctcacagtg

SEQ ID NO: 1217 - DNA, 15 bp, Homo sapiens
tggggcgctcacagt

SEQ ID NO: 1218 - DNA, 15 bp, Homo sapiens
gtggggcgctcacag

SEQ ID NO: 1219 - DNA, 15 bp, Homo sapiens
ggtggggcgctcaca

SEQ ID NO: 1220 - DNA, 15 bp, Homo sapiens
gggtggggcgctcac

SEQ ID NO: 1221 - DNA, 15 bp, Homo sapiens
agggtggggcgctca

SEQ ID NO: 1222 - DNA, 15 bp, Homo sapiens
cagggtggggcgctc

SEQ ID NO: 1223 - DNA, 15 bp, Homo sapiens
gcagggtggggcgct

SEQ ID NO: 1224 - DNA, 15 bp, Homo sapiens
cgcagggtggggcgc

SEQ ID NO: 1225 - DNA, 15 bp, Homo sapiens
acgcagggtggggcg

SEQ ID NO: 1226 - DNA, 15 bp, Homo sapiens
gacgcagggtggggc

SEQ ID NO: 1227 - DNA, 15 bp, Homo sapiens
agacgcagggtgggg

SEQ ID NO: 1228 - DNA, 15 bp, Homo sapiens
cagacgcagggtggg

SEQ ID NO: 1229 - DNA, 15 bp, Homo sapiens
gcagacgcagggtgg

SEQ ID NO: 1230 - DNA, 15 bp, Homo sapiens
tgcagacgcagggtg

SEQ ID NO: 1231 - DNA, 15 bp, Homo sapiens
ctgcagacgcagggt

SEQ ID NO: 1232 - DNA, 15 bp, Homo sapiens
cctgcagacgcaggg

SEQ ID NO: 1233 - DNA, 15 bp, Homo sapiens
acctgcagacgcagg

SEQ ID NO: 1234 - DNA, 15 bp, Homo sapiens
cacctgcagacgcag

SEQ ID NO: 1235 - DNA, 15 bp, Homo sapiens
ccacctgcagacgca

SEQ ID NO: 1236 - DNA, 15 bp, Homo sapiens
cccacctgcagacgc

SEQ ID NO: 1237 - DNA, 15 bp, Homo sapiens
acccacctgcagacg

SEQ ID NO: 1238 - DNA, 15 bp, Homo sapiens
cacccacctgcagac

SEQ ID NO: 1239 - DNA, 15 bp, Homo sapiens
ccacccacctgcaga

SEQ ID NO: 1240 - DNA, 15 bp, Homo sapiens
cccacccacctgcag

SEQ ID NO: 1241 - DNA, 15 bp, Homo sapiens
acccacccacctgca

SEQ ID NO: 1242 - DNA, 15 bp, Homo sapiens
gacccacccacctgc

SEQ ID NO: 1243 - DNA, 15 bp, Homo sapiens
tgacccacccacctg

SEQ ID NO: 1244 - DNA, 15 bp, Homo sapiens
ctgacccacccacct

SEQ ID NO: 1245 - DNA, 15 bp, Homo sapiens
tctgacccacccacc

SEQ ID NO: 1246 - DNA, 15 bp, Homo sapiens
ctctgacccacccac

SEQ ID NO: 1247 - DNA, 15 bp, Homo sapiens
tctctgacccaccca

SEQ ID NO: 1248 - DNA, 15 bp, Homo sapiens
ttctctgacccaccc

SEQ ID NO: 1249 - DNA, 15 bp, Homo sapiens
gttctctgacccacc

SEQ ID NO: 1250 - DNA, 15 bp, Homo sapiens
ggttctctgacccac

SEQ ID NO: 1251 - DNA, 15 bp, Homo sapiens
cggttctctgaccca

SEQ ID NO: 1252 - DNA, 15 bp, Homo sapiens
gcggttctctgaccc

SEQ ID NO: 1253 - DNA, 15 bp, Homo sapiens
tgcggttctctgacc

SEQ ID NO: 1254 - DNA, 15 bp, Homo sapiens
ctgcggttctctgac

SEQ ID NO: 1255 - DNA, 15 bp, Homo sapiens
cctgcggttctctga

SEQ ID NO: 1256 - DNA, 15 bp, Homo sapiens
gcctgcggttctctg

SEQ ID NO: 1257 - DNA, 15 bp, Homo sapiens
tgcctgcggttctct

SEQ ID NO: 1258 - DNA, 15 bp, Homo sapiens
gtgcctgcggttctc

SEQ ID NO: 1259 - DNA, 15 bp, Homo sapiens
tgtgcctgcggttct

SEQ ID NO: 1260 - DNA, 15 bp, Homo sapiens
ctgtgcctgcggttc

SEQ ID NO: 1261 - DNA, 15 bp, Homo sapiens
tctgtgcctgcggtt

SEQ ID NO: 1262 - DNA, 15 bp, Homo sapiens
ttctgtgcctgcggt

SEQ ID NO: 1263 - DNA, 15 bp, Homo sapiens
cttctgtgcctgcgg

SEQ ID NO: 1264 - DNA, 15 bp, Homo sapiens
tcttctgtgcctgcg

SEQ ID NO: 1265 - DNA, 15 bp, Homo sapiens
ctcttctgtgcctgc

SEQ ID NO: 1266 - DNA, 15 bp, Homo sapiens
cctcttctgtgcctg

SEQ ID NO: 1267 - DNA, 15 bp, Homo sapiens
ccctcttctgtgcct

SEQ ID NO: 1268 - DNA, 15 bp, Homo sapiens
accctcttctgtgcc

SEQ ID NO: 1269 - DNA, 15 bp, Homo sapiens
taccctcttctgtgc

SEQ ID NO: 1270 - DNA, 15 bp, Homo sapiens
gtaccctcttctgtg

SEQ ID NO: 1271 - DNA, 15 bp, Homo sapiens
ggtaccctcttctgt

SEQ ID NO: 1272 - DNA, 15 bp, Homo sapiens
gggtaccctcttctg

SEQ ID NO: 1273 - DNA, 15 bp, Homo sapiens
tgggtaccctcttct

SEQ ID NO: 1274 - DNA, 15 bp, Homo sapiens
ctgggtaccctcttc

SEQ ID NO: 1275 - DNA, 15 bp, Homo sapiens
gctgggtaccctctt

SEQ ID NO: 1276 - DNA, 15 bp, Homo sapiens
agctgggtaccctct

SEQ ID NO: 1277 - DNA, 15 bp, Homo sapiens
aagctgggtaccctc

SEQ ID NO: 1278 - DNA, 15 bp, Homo sapiens
gaagctgggtaccct

SEQ ID NO: 1279 - DNA, 15 bp, Homo sapiens
ggaagctgggtaccc

SEQ ID NO: 1280 - DNA, 15 bp, Homo sapiens
gggaagctgggtacc

SEQ ID NO: 1281 - DNA, 15 bp, Homo sapiens
ggggaagctgggtac

SEQ ID NO: 1282 - DNA, 15 bp, Homo sapiens
aggggaagctgggta

SEQ ID NO: 1283 - DNA, 15 bp, Homo sapiens
gaggggaagctgggt

SEQ ID NO: 1284 - DNA, 15 bp, Homo sapiens
ggaggggaagctggg

SEQ ID NO: 1285 - DNA, 15 bp, Homo sapiens
cggaggggaagctgg

SEQ ID NO: 1286 - DNA, 15 bp, Homo sapiens
gcggaggggaagctg

SEQ ID NO: 1287 - DNA, 15 bp, Homo sapiens
ggcggaggggaagct

SEQ ID NO: 1288 - DNA, 15 bp, Homo sapiens
tggcggaggggaagc

SEQ ID NO: 1289 - DNA, 15 bp, Homo sapiens
ctggcggaggggaag

SEQ ID NO: 1290 - DNA, 15 bp, Homo sapiens
gctggcggaggggaa

SEQ ID NO: 1291 - DNA, 15 bp, Homo sapiens
ggctggcggagggga

SEQ ID NO: 1292 - DNA, 15 bp, Homo sapiens
gggctggcggagggg

SEQ ID NO: 1293 - DNA, 15 bp, Homo sapiens
ggggctggcggaggg

SEQ ID NO: 1294 - DNA, 15 bp, Homo sapiens
cggggctggcggagg

SEQ ID NO: 1295 - DNA, 15 bp, Homo sapiens
gcggggctggcggag

SEQ ID NO: 1296 - DNA, 15 bp, Homo sapiens
cgcggggctggcgga

SEQ ID NO: 1297 - DNA, 15 bp, Homo sapiens
tcgcggggctggcgg

SEQ ID NO: 1298 - DNA, 15 bp, Homo sapiens
gtcgcggggctggcg

SEQ ID NO: 1299 - DNA, 15 bp, Homo sapiens
ggtcgcggggctggc

SEQ ID NO: 1300 - DNA, 15 bp, Homo sapiens
cggtcgcggggctgg

SEQ ID NO: 1301 - DNA, 15 bp, Homo sapiens
gcggtcgcggggctg

SEQ ID NO: 1302 - DNA, 15 bp, Homo sapiens
cgcggtcgcggggct

SEQ ID NO: 1303 - DNA, 15 bp, Homo sapiens
ccgcggtcgcggggc

SEQ ID NO: 1304 - DNA, 15 bp, Homo sapiens
gccgcggtcgcgggg

SEQ ID NO: 1305 - DNA, 15 bp, Homo sapiens
cgccgcggtcgcggg

SEQ ID NO: 1306 - DNA, 15 bp, Homo sapiens
gcgccgcggtcgcgg

SEQ ID NO: 1307 - DNA, 15 bp, Homo sapiens
cgcgccgcggtcgcg

SEQ ID NO: 1308 - DNA, 15 bp, Homo sapiens
gcgcgccgcggtcgc

SEQ ID NO: 1309 - DNA, 15 bp, Homo sapiens
cgcgcgccgcggtcg

SEQ ID NO: 1310 - DNA, 15 bp, Homo sapiens
gcgcgcgccgcggtc

SEQ ID NO: 1311 - DNA, 15 bp, Homo sapiens
cgcgcgcgccgcggt

SEQ ID NO: 1312 - DNA, 15 bp, Homo sapiens
ccgcgcgcgccgcgg

SEQ ID NO: 1313 - DNA, 15 bp, Homo sapiens
gccgcgcgcgccgcg

SEQ ID NO: 1314 - DNA, 15 bp, Homo sapiens
ggccgcgcgcgccgc

SEQ ID NO: 1315 - DNA, 15 bp, Homo sapiens
aggccgcgcgcgccg

SEQ ID NO: 1316 - DNA, 15 bp, Homo sapiens
gaggccgcgcgcgcc

SEQ ID NO: 1317 - DNA, 15 bp, Homo sapiens
cgaggccgcgcgcgc

SEQ ID NO: 1318 - DNA, 15 bp, Homo sapiens
tcgaggccgcgcgcg

SEQ ID NO: 1319 - DNA, 15 bp, Homo sapiens
atcgaggccgcgcgc

SEQ ID NO: 1320 - DNA, 15 bp, Homo sapiens
gatcgaggccgcgcg

SEQ ID NO: 1321 - DNA, 15 bp, Homo sapiens
ggatcgaggccgcgc

SEQ ID NO: 1322 - DNA, 15 bp, Homo sapiens
cggatcgaggccgcg

SEQ ID NO: 1323 - DNA, 15 bp, Homo sapiens
ccggatcgaggccgc

SEQ ID NO: 1324 - DNA, 15 bp, Homo sapiens
cccggatcgaggccg

SEQ ID NO: 1325 - DNA, 15 bp, Homo sapiens
acccggatcgaggcc

SEQ ID NO: 1326 - DNA, 15 bp, Homo sapiens
aacccggatcgaggc

SEQ ID NO: 1327 - DNA, 15 bp, Homo sapiens
gaacccggatcgagg

SEQ ID NO: 1328 - DNA, 15 bp, Homo sapiens
ggaacccggatcgag

SEQ ID NO: 1329 - DNA, 15 bp, Homo sapiens
aggaacccggatcga

SEQ ID NO: 1330 - DNA, 15 bp, Homo sapiens
taggaacccggatcg

SEQ ID NO: 1331 - DNA, 15 bp, Homo sapiens
ctaggaacccggatc

SEQ ID NO: 1332 - DNA, 15 bp, Homo sapiens
cctaggaacccggat

SEQ ID NO: 1333 - DNA, 15 bp, Homo sapiens
ccctaggaacccgga

SEQ ID NO: 1334 - DNA, 15 bp, Homo sapiens
cccctaggaacccgg

SEQ ID NO: 1335 - DNA, 15 bp, Homo sapiens
gcccctaggaacccg

SEQ ID NO: 1336 - DNA, 15 bp, Homo sapiens
cgcccctaggaaccc

SEQ ID NO: 1337 - DNA, 15 bp, Homo sapiens
ccgcccctaggaacc

SEQ ID NO: 1338 - DNA, 15 bp, Homo sapiens
gccgcccctaggaac

SEQ ID NO: 1339 - DNA, 15 bp, Homo sapiens
cgccgcccctaggaa

SEQ ID NO: 1340 - DNA, 15 bp, Homo sapiens
gcgccgcccctagga

SEQ ID NO: 1341 - DNA, 15 bp, Homo sapiens
cgcgccgcccctagg

SEQ ID NO: 1342 - DNA, 15 bp, Homo sapiens
gcgcgccgcccctag

SEQ ID NO: 1343 - DNA, 15 bp, Homo sapiens
cgcgcgccgccccta

SEQ ID NO: 1344 - DNA, 15 bp, Homo sapiens
ccgcgcgccgcccct

SEQ ID NO: 1345 - DNA, 15 bp, Homo sapiens
cccgcgcgccgcccc

SEQ ID NO: 1346 - DNA, 15 bp, Homo sapiens
tcccgcgcgccgccc

SEQ ID NO: 1347 - DNA, 15 bp, Homo sapiens
ctcccgcgcgccgcc

SEQ ID NO: 1348 - DNA, 15 bp, Homo sapiens
cctcccgcgcgccgc

SEQ ID NO: 1349 - DNA, 15 bp, Homo sapiens
ccctcccgcgcgccg

SEQ ID NO: 1350 - DNA, 15 bp, Homo sapiens
cccctcccgcgcgcc

SEQ ID NO: 1351 - DNA, 15 bp, Homo sapiens
ccccctcccgcgcgc

SEQ ID NO: 1352 - DNA, 15 bp, Homo sapiens
gccccctcccgcgcg

SEQ ID NO: 1353 - DNA, 15 bp, Homo sapiens
cgccccctcccgcgc

SEQ ID NO: 1354 - DNA, 15 bp, Homo sapiens
ccgccccctcccgcg

SEQ ID NO: 1355 - DNA, 15 bp, Homo sapiens
cccgccccctcccgc

SEQ ID NO: 1356 - DNA, 15 bp, Homo sapiens
ccccgccccctcccg

SEQ ID NO: 1357 - DNA, 15 bp, Homo sapiens
gccccgccccctccc

SEQ ID NO: 1358 - DNA, 15 bp, Homo sapiens
ggccccgccccctcc

SEQ ID NO: 1359 - DNA, 15 bp, Homo sapiens
aggccccgccccctc

SEQ ID NO: 1360 - DNA, 15 bp, Homo sapiens
caggccccgccccct

SEQ ID NO: 1361 - DNA, 15 bp, Homo sapiens
gcaggccccgccccc

SEQ ID NO: 1362 - DNA, 15 bp, Homo sapiens
cgcaggccccgcccc

SEQ ID NO: 1363 - DNA, 15 bp, Homo sapiens
gcgcaggccccgccc

SEQ ID NO: 1364 - DNA, 15 bp, Homo sapiens
cgcgcaggccccgcc

SEQ ID NO: 1365 - DNA, 15 bp, Homo sapiens
ccgcgcaggccccgc

SEQ ID NO: 1366 - DNA, 15 bp, Homo sapiens
gccgcgcaggccccg

SEQ ID NO: 1367 - DNA, 15 bp, Homo sapiens
tgccgcgcaggcccc

SEQ ID NO: 1368 - DNA, 15 bp, Homo sapiens
ctgccgcgcaggccc

SEQ ID NO: 1369 - DNA, 15 bp, Homo sapiens
gctgccgcgcaggcc

SEQ ID NO: 1370 - DNA, 15 bp, Homo sapiens
cgctgccgcgcaggc

SEQ ID NO: 1371 - DNA, 15 bp, Homo sapiens
acgctgccgcgcagg

SEQ ID NO: 1372 - DNA, 15 bp, Homo sapiens
cacgctgccgcgcag

SEQ ID NO: 1373 - DNA, 15 bp, Homo sapiens
ccacgctgccgcgca

SEQ ID NO: 1374 - DNA, 15 bp, Homo sapiens
cccacgctgccgcgc

SEQ ID NO: 1375 - DNA, 15 bp, Homo sapiens
gcccacgctgccgcg

SEQ ID NO: 1376 - DNA, 15 bp, Homo sapiens
cgcccacgctgccgc

SEQ ID NO: 1377 - DNA, 15 bp, Homo sapiens
gcgcccacgctgccg

SEQ ID NO: 1378 - DNA, 15 bp, Homo sapiens
ggcgcccacgctgcc

SEQ ID NO: 1379 - DNA, 15 bp, Homo sapiens
tggcgcccacgctgc

SEQ ID NO: 1380 - DNA, 15 bp, Homo sapiens
ctggcgcccacgctg

SEQ ID NO: 1381 - DNA, 15 bp, Homo sapiens
cctggcgcccacgct

SEQ ID NO: 1382 - DNA, 15 bp, Homo sapiens
gcctggcgcccacgc

SEQ ID NO: 1383 - DNA, 15 bp, Homo sapiens
cgcctggcgcccacg

SEQ ID NO: 1384 - DNA, 15 bp, Homo sapiens
gcgcctggcgcccac

SEQ ID NO: 1385 - DNA, 15 bp, Homo sapiens
cgcgcctggcgccca

SEQ ID NO: 1386 - DNA, 15 bp, Homo sapiens
gcgcgcctggcgccc

SEQ ID NO: 1387 - DNA, 15 bp, Homo sapiens
cgcgcgcctggcgcc

SEQ ID NO: 1388 - DNA, 15 bp, Homo sapiens
ccgcgcgcctggcgc

SEQ ID NO: 1389 - DNA, 15 bp, Homo sapiens
cccgcgcgcctggcg

SEQ ID NO: 1390 - DNA, 15 bp, Homo sapiens
tcccgcgcgcctggc

SEQ ID NO: 1391 - DNA, 15 bp, Homo sapiens
ctcccgcgcgcctgg

SEQ ID NO: 1392 - DNA, 15 bp, Homo sapiens
cctcccgcgcgcctg

SEQ ID NO: 1393 - DNA, 15 bp, Homo sapiens
tcctcccgcgcgcct

SEQ ID NO: 1394 - DNA, 15 bp, Homo sapiens
ctcctcccgcgcgcc

SEQ ID NO: 1395 - DNA, 15 bp, Homo sapiens
cctcctcccgcgcgc

SEQ ID NO: 1396 - DNA, 15 bp, Homo sapiens
ccctcctcccgcgcg

SEQ ID NO: 1397 - DNA, 15 bp, Homo sapiens
tccctcctcccgcgc

SEQ ID NO: 1398 - DNA, 15 bp, Homo sapiens
ctccctcctcccgcg

SEQ ID NO: 1399 - DNA, 15 bp, Homo sapiens
gctccctcctcccgc

SEQ ID NO: 1400 - DNA, 15 bp, Homo sapiens
ggctccctcctcccg

SEQ ID NO: 1401 - DNA, 15 bp, Homo sapiens
cggctccctcctccc

SEQ ID NO: 1402 - DNA, 15 bp, Homo sapiens
ccggctccctcctcc

SEQ ID NO: 1403 - DNA, 15 bp, Homo sapiens
cccggctccctcctc

SEQ ID NO: 1404 - DNA, 15 bp, Homo sapiens
tcccggctccctcct

SEQ ID NO: 1405 - DNA, 15 bp, Homo sapiens
ctcccggctccctcc

SEQ ID NO: 1406 - DNA, 15 bp, Homo sapiens
cctcccggctccctc

SEQ ID NO: 1407 - DNA, 15 bp, Homo sapiens
tcctcccggctccct

SEQ ID NO: 1408 - DNA, 15 bp, Homo sapiens
ctcctcccggctccc

SEQ ID NO: 1409 - DNA, 15 bp, Homo sapiens
cctcctcccggctcc

SEQ ID NO: 1410 - DNA, 15 bp, Homo sapiens
ccctcctcccggctc

SEQ ID NO: 1411 - DNA, 15 bp, Homo sapiens
cccctcctcccggct

SEQ ID NO: 1412 - DNA, 15 bp, Homo sapiens
ccccctcctcccggc

SEQ ID NO: 1413 - DNA, 15 bp, Homo sapiens
gccccctcctcccgg

SEQ ID NO: 1414 - DNA, 15 bp, Homo sapiens
cgccccctcctcccg

SEQ ID NO: 1415 - DNA, 15 bp, Homo sapiens
ccgccccctcctccc

SEQ ID NO: 1416 - DNA, 15 bp, Homo sapiens
cccgccccctcctcc

SEQ ID NO: 1417 - DNA, 15 bp, Homo sapiens
ccccgccccctcctc

SEQ ID NO: 1418 - DNA, 15 bp, Homo sapiens
gccccgccccctcct

SEQ ID NO: 1419 - DNA, 15 bp, Homo sapiens
cggccccgccccctc

SEQ ID NO: 1420 - DNA, 15 bp, Homo sapiens
gcggccccgccccct

SEQ ID NO: 1421 - DNA, 15 bp, Homo sapiens
cgcggccccgccccc

SEQ ID NO: 1422 - DNA, 15 bp, Homo sapiens
gcgcggccccgcccc

SEQ ID NO: 1423 - DNA, 15 bp, Homo sapiens
ggcgcggccccgccc

SEQ ID NO: 1424 - DNA, 15 bp, Homo sapiens
cggcgcggccccgcc

SEQ ID NO: 1425 - DNA, 15 bp, Homo sapiens
gcggcgcggccccgc

SEQ ID NO: 1426 - DNA, 15 bp, Homo sapiens
ggcggcgcggccccg

SEQ ID NO: 1427 - DNA, 15 bp, Homo sapiens
gggcggcgcggcccc

SEQ ID NO: 1428 - DNA, 15 bp, Homo sapiens
cgggcggcgcggccc

SEQ ID NO: 1429 - DNA, 15 bp, Homo sapiens
gcgggcggcgcggcc

SEQ ID NO: 1430 - DNA, 15 bp, Homo sapiens
cgcgggcggcgcggc

SEQ ID NO: 1431 - DNA, 15 bp, Homo sapiens
gcgcgggcggcgcgg

SEQ ID NO: 1432 - DNA, 15 bp, Homo sapiens
ggcgcgggcggcgcg

SEQ ID NO: 1433 - DNA, 15 bp, Homo sapiens
cggcgcgggcggcgc

SEQ ID NO: 1434 - DNA, 15 bp, Homo sapiens
gcggcgcgggcggcg

SEQ ID NO: 1435 - DNA, 15 bp, Homo sapiens
cgcggcgcgggcggc

SEQ ID NO: 1436 - DNA, 15 bp, Homo sapiens
gcgcggcgcgggcgg

SEQ ID NO: 1437 - DNA, 15 bp, Homo sapiens
agcgcggcgcgggcg

SEQ ID NO: 1438 - DNA, 15 bp, Homo sapiens
cagcgcggcgcgggc

SEQ ID NO: 1439 - DNA, 15 bp, Homo sapiens
ccagcgcggcgcggg

SEQ ID NO: 1440 - DNA, 15 bp, Homo sapiens
cccagcgcggcgcgg

SEQ ID NO: 1441 - DNA, 15 bp, Homo sapiens
gcccagcgcggcgcg

SEQ ID NO: 1442 - DNA, 15 bp, Homo sapiens
cgcccagcgcggcgc

SEQ ID NO: 1443 - DNA, 15 bp, Homo sapiens
gcgcccagcgcggcg

SEQ ID NO: 1444 - DNA, 15 bp, Homo sapiens
agcgcccagcgcggc

SEQ ID NO: 1445 - DNA, 15 bp, Homo sapiens
gagcgcccagcgcgg

SEQ ID NO: 1446 - DNA, 15 bp, Homo sapiens
agagcgcccagcgcg

SEQ ID NO: 1447 - DNA, 15 bp, Homo sapiens
gagagcgcccagcgc

SEQ ID NO: 1448 - DNA, 15 bp, Homo sapiens
cgagagcgcccagcg

SEQ ID NO: 1449 - DNA, 15 bp, Homo sapiens
ccgagagcgcccagc

SEQ ID NO: 1450 - DNA, 15 bp, Homo sapiens
gccgagagcgcccag

SEQ ID NO: 1451 - DNA, 15 bp, Homo sapiens
ggccgagagcgccca

SEQ ID NO: 1452 - DNA, 15 bp, Homo sapiens
tggccgagagcgccc

SEQ ID NO: 1453 - DNA, 15 bp, Homo sapiens
ttggccgagagcgcc

SEQ ID NO: 1454 - DNA, 15 bp, Homo sapiens
attggccgagagcgc

SEQ ID NO: 1455 - DNA, 15 bp, Homo sapiens
cattggccgagagcg

SEQ ID NO: 1456 - DNA, 15 bp, Homo sapiens
tcattggccgagagc

SEQ ID NO: 1457 - DNA, 15 bp, Homo sapiens
ctcattggccgagag

SEQ ID NO: 1458 - DNA, 15 bp, Homo sapiens
gctcattggccgaga

SEQ ID NO: 1459 - DNA, 15 bp, Homo sapiens
cgctcattggccgag

SEQ ID NO: 1460 - DNA, 15 bp, Homo sapiens
ccgctcattggccga

SEQ ID NO: 1461 - DNA, 15 bp, Homo sapiens
gccgctcattggccg

SEQ ID NO: 1462 - DNA, 15 bp, Homo sapiens
cgccgctcattggcc

SEQ ID NO: 1463 - DNA, 15 bp, Homo sapiens
acgccgctcattggc

SEQ ID NO: 1464 - DNA, 15 bp, Homo sapiens
gacgccgctcattgg

SEQ ID NO: 1465 - DNA, 15 bp, Homo sapiens
ggacgccgctcattg

SEQ ID NO: 1466 - DNA, 15 bp, Homo sapiens
tggacgccgctcatt

SEQ ID NO: 1467 - DNA, 15 bp, Homo sapiens
gtggacgccgctcat

SEQ ID NO: 1468 - DNA, 15 bp, Homo sapiens
tgtggacgccgctca

SEQ ID NO: 1469 - DNA, 15 bp, Homo sapiens
atgtggacgccgctc

SEQ ID NO: 1470 - DNA, 15 bp, Homo sapiens
catgtggacgccgct

SEQ ID NO: 1471 - DNA, 15 bp, Homo sapiens
gcatgtggacgccgc

SEQ ID NO: 1472 - DNA, 15 bp, Homo sapiens
ggcatgtggacgccg

SEQ ID NO: 1473 - DNA, 15 bp, Homo sapiens
cggcatgtggacgcc

SEQ ID NO: 1474 - DNA, 15 bp, Homo sapiens
gcggcatgtggacgc

SEQ ID NO: 1475 - DNA, 15 bp, Homo sapiens
cgcggcatgtggacg

SEQ ID NO: 1476 - DNA, 15 bp, Homo sapiens
ccgcggcatgtggac

SEQ ID NO: 1477 - DNA, 15 bp, Homo sapiens
gccgcggcatgtgga

SEQ ID NO: 1478 - DNA, 15 bp, Homo sapiens
cgccgcggcatgtgg

SEQ ID NO: 1479 - DNA, 15 bp, Homo sapiens
ccgccgcggcatgtg

SEQ ID NO: 1480 - DNA, 15 bp, Homo sapiens
gccgccgcggcatgt

SEQ ID NO: 1481 - DNA, 15 bp, Homo sapiens
cgccgccgcggcatg

SEQ ID NO: 1482 - DNA, 15 bp, Homo sapiens
ccgccgccgcggcat

SEQ ID NO: 1483 - DNA, 15 bp, Homo sapiens
gccgccgccgcggca

SEQ ID NO: 1484 - DNA, 15 bp, Homo sapiens
cgccgccgccgcggc

SEQ ID NO: 1485 - DNA, 15 bp, Homo sapiens
tcgccgccgccgcgg

SEQ ID NO: 1486 - DNA, 15 bp, Homo sapiens
ttcgccgccgccgcg

SEQ ID NO: 1487 - DNA, 15 bp, Homo sapiens
tttcgccgccgccgc

SEQ ID NO: 1488 - DNA, 15 bp, Homo sapiens
ctttcgccgccgccg

SEQ ID NO: 1489 - DNA, 15 bp, Homo sapiens
cctttcgccgccgcc

SEQ ID NO: 1490 - DNA, 15 bp, Homo sapiens
ccctttcgccgccgc

SEQ ID NO: 1491 - DNA, 15 bp, Homo sapiens
cccctttcgccgccg

SEQ ID NO: 1492 - DNA, 15 bp, Homo sapiens
tcccctttcgccgcc

SEQ ID NO: 1493 - DNA, 15 bp, Homo sapiens
ctcccctttcgccgc

SEQ ID NO: 1494 - DNA, 15 bp, Homo sapiens
cctcccctttcgccg

SEQ ID NO: 1495 - DNA, 15 bp, Homo sapiens
gcctcccctttcgcc

SEQ ID NO: 1496 - DNA, 15 bp, Homo sapiens
tgcctcccctttcgc

SEQ ID NO: 1497 - DNA, 15 bp, Homo sapiens
ctgcctcccctttcg

SEQ ID NO: 1498 - DNA, 15 bp, Homo sapiens
gctgcctcccctttc

SEQ ID NO: 1499 - DNA, 15 bp, Homo sapiens
cgctgcctccccttt

SEQ ID NO: 1500 - DNA, 15 bp, Homo sapiens
ccgctgcctcccctt

SEQ ID NO: 1501 - DNA, 15 bp, Homo sapiens
gccgctgcctcccct

SEQ ID NO: 1502 - DNA, 15 bp, Homo sapiens
ggccgctgcctcccc

SEQ ID NO: 1503 - DNA, 15 bp, Homo sapiens
cggccgctgcctccc

SEQ ID NO: 1504 - DNA, 15 bp, Homo sapiens
tcggccgctgcctcc

SEQ ID NO: 1505 - DNA, 15 bp, Homo sapiens
atcggccgctgcctc

SEQ ID NO: 1506 - DNA, 15 bp, Homo sapiens
tatcggccgctgcct

SEQ ID NO: 1507 - DNA, 15 bp, Homo sapiens
ttatcggccgctgcc

SEQ ID NO: 1508 - DNA, 15 bp, Homo sapiens
tttatcggccgctgc

SEQ ID NO: 1509 - DNA, 15 bp, Homo sapiens
atttatcggccgctg

SEQ ID NO: 1510 - DNA, 15 bp, Homo sapiens
catttatcggccgct

SEQ ID NO: 1511 - DNA, 15 bp, Homo sapiens
gcatttatcggccgc

SEQ ID NO: 1512 - DNA, 15 bp, Homo sapiens
agcatttatcggccg

SEQ ID NO: 1513 - DNA, 15 bp, Homo sapiens
tagcatttatcggcc

SEQ ID NO: 1514 - DNA, 15 bp, Homo sapiens
atagcatttatcggc

SEQ ID NO: 1515 - DNA, 15 bp, Homo sapiens
aatagcatttatcgg

SEQ ID NO: 1516 - DNA, 15 bp, Homo sapiens
taatagcatttatcg

SEQ ID NO: 1517 - DNA, 15 bp, Homo sapiens
ctaatagcatttatc

SEQ ID NO: 1518 - DNA, 15 bp, Homo sapiens
tctaatagcatttat

SEQ ID NO: 1519 - DNA, 15 bp, Homo sapiens
ctctaatagcattta

SEQ ID NO: 1520 - DNA, 15 bp, Homo sapiens
gctctaatagcattt

SEQ ID NO: 1521 - DNA, 15 bp, Homo sapiens
tgctctaatagcatt

SEQ ID NO: 1522 - DNA, 15 bp, Homo sapiens
ctgctctaatagcat

SEQ ID NO: 1523 - DNA, 15 bp, Homo sapiens
gctgctctaatagca

SEQ ID NO: 1524 - DNA, 15 bp, Homo sapiens
ggctgctctaatagc

SEQ ID NO: 1525 - DNA, 15 bp, Homo sapiens
cggctgctctaatag

SEQ ID NO: 1526 - DNA, 15 bp, Homo sapiens
gcggctgctctaata

SEQ ID NO: 1527 - DNA, 15 bp, Homo sapiens
ggcggctgctctaat

SEQ ID NO: 1528 - DNA, 15 bp, Homo sapiens
cggcggctgctctaa

SEQ ID NO: 1529 - DNA, 15 bp, Homo sapiens
gcggcggctgctcta

SEQ ID NO: 1530 - DNA, 15 bp, Homo sapiens
cgcggcggctgctct

SEQ ID NO: 1531 - DNA, 15 bp, Homo sapiens
ccgcggcggctgctc

SEQ ID NO: 1532 - DNA, 15 bp, Homo sapiens
tccgcggcggctgct

SEQ ID NO: 1533 - DNA, 15 bp, Homo sapiens
ctccgcggcggctgc

SEQ ID NO: 1534 - DNA, 15 bp, Homo sapiens
gctccgcggcggctg

SEQ ID NO: 1535 - DNA, 15 bp, Homo sapiens
ggctccgcggcggct

SEQ ID NO: 1536 - DNA, 15 bp, Homo sapiens
cggctccgcggcggc

SEQ ID NO: 1537 - DNA, 15 bp, Homo sapiens
acggctccgcggcgg

SEQ ID NO: 1538 - DNA, 15 bp, Homo sapiens
gacggctccgcggcg

SEQ ID NO: 1539 - DNA, 15 bp, Homo sapiens
ggacggctccgcggc

SEQ ID NO: 1540 - DNA, 15 bp, Homo sapiens
gggacggctccgcgg

SEQ ID NO: 1541 - DNA, 15 bp, Homo sapiens
ggggacggctccgcg

SEQ ID NO: 1542 - DNA, 15 bp, Homo sapiens
cggggacggctccgc

SEQ ID NO: 1543 - DNA, 15 bp, Homo sapiens
tcggggacggctccg

SEQ ID NO: 1544 - DNA, 15 bp, Homo sapiens
gtcggggacggctcc

SEQ ID NO: 1545 - DNA, 15 bp, Homo sapiens
cgtcggggacggctc

SEQ ID NO: 1546 - DNA, 15 bp, Homo sapiens
gcgtcggggacggct

SEQ ID NO: 1547 - DNA, 15 bp, Homo sapiens
ggcgtcggggacggc

SEQ ID NO: 1548 - DNA, 15 bp, Homo sapiens
tggcgtcggggacgg

SEQ ID NO: 1549 - DNA, 15 bp, Homo sapiens
gtggcgtcggggacg

SEQ ID NO: 1550 - DNA, 15 bp, Homo sapiens
ggtggcgtcggggac

SEQ ID NO: 1551 - DNA, 15 bp, Homo sapiens
aggtggcgtcgggga

SEQ ID NO: 1552 - DNA, 15 bp, Homo sapiens
gaggtggcgtcgggg

SEQ ID NO: 1553 - DNA, 15 bp, Homo sapiens
ggaggtggcgtcggg

SEQ ID NO: 1554 - DNA, 15 bp, Homo sapiens
aggaggtggcgtcgg

SEQ ID NO: 1555 - DNA, 15 bp, Homo sapiens
aaggaggtggcgtcg

SEQ ID NO: 1556 - DNA, 15 bp, Homo sapiens
aaaggaggtggcgtc

SEQ ID NO: 1557 - DNA, 15 bp, Homo sapiens
aaaaggaggtggcgt

SEQ ID NO: 1558 - DNA, 15 bp, Homo sapiens
gaaaaggaggtggcg

SEQ ID NO: 1559 - DNA, 15 bp, Homo sapiens
ggaaaaggaggtggc

SEQ ID NO: 1560 - DNA, 15 bp, Homo sapiens
aggaaaaggaggtgg

SEQ ID NO: 1561 - DNA, 15 bp, Homo sapiens
aaggaaaaggaggtg

SEQ ID NO: 1562 - DNA, 15 bp, Homo sapiens
gaaggaaaaggaggt

SEQ ID NO: 1563 - DNA, 15 bp, Homo sapiens
cgaaggaaaaggagg

SEQ ID NO: 1564 - DNA, 15 bp, Homo sapiens
gcgaaggaaaaggag

SEQ ID NO: 1565 - DNA, 15 bp, Homo sapiens
ggcgaaggaaaagga

SEQ ID NO: 1566 - DNA, 15 bp, Homo sapiens
cggcgaaggaaaagg

SEQ ID NO: 1567 - DNA, 15 bp, Homo sapiens
gcggcgaaggaaaag

SEQ ID NO: 1568 - DNA, 15 bp, Homo sapiens
tgcggcgaaggaaaa

SEQ ID NO: 1569 - DNA, 15 bp, Homo sapiens
ctgcggcgaaggaaa

SEQ ID NO: 1570 - DNA, 15 bp, Homo sapiens
actgcggcgaaggaa

SEQ ID NO: 1571 - DNA, 15 bp, Homo sapiens
aactgcggcgaagga

SEQ ID NO: 1572 - DNA, 15 bp, Homo sapiens
aaactgcggcgaagg

SEQ ID NO: 1573 - DNA, 15 bp, Homo sapiens
gaaactgcggcgaag

SEQ ID NO: 1574 - DNA, 15 bp, Homo sapiens
ggaaactgcggcgaa

SEQ ID NO: 1575 - DNA, 15 bp, Homo sapiens
aggaaactgcggcga

SEQ ID NO: 1576 - DNA, 15 bp, Homo sapiens
gaggaaactgcggcg

SEQ ID NO: 1577 - DNA, 15 bp, Homo sapiens
ggaggaaactgcggc

SEQ ID NO: 1578 - DNA, 15 bp, Homo sapiens
cggaggaaactgcgg

SEQ ID NO: 1579 - DNA, 15 bp, Homo sapiens
gcggaggaaactgcg

SEQ ID NO: 1580 - DNA, 15 bp, Homo sapiens
ggcggaggaaactgc

SEQ ID NO: 1581 - DNA, 15 bp, Homo sapiens
cggcggaggaaactg

SEQ ID NO: 1582 - DNA, 15 bp, Homo sapiens
gcggcggaggaaact

SEQ ID NO: 1583 - DNA, 15 bp, Homo sapiens
agcggcggaggaaac

SEQ ID NO: 1584 - DNA, 15 bp, Homo sapiens
cagcggcggaggaaa

SEQ ID NO: 1585 - DNA, 15 bp, Homo sapiens
acagcggcggaggaa

SEQ ID NO: 1586 - DNA, 15 bp, Homo sapiens
gacagcggcggagga

SEQ ID NO: 1587 - DNA, 15 bp, Homo sapiens
cgacagcggcggagg

SEQ ID NO: 1588 - DNA, 15 bp, Homo sapiens
ccgacagcggcggag

SEQ ID NO: 1589 - DNA, 15 bp, Homo sapiens
cccgacagcggcgga

SEQ ID NO: 1590 - DNA, 15 bp, Homo sapiens
gcccgacagcggcgg

SEQ ID NO: 1591 - DNA, 15 bp, Homo sapiens
cgcccgacagcggcg

SEQ ID NO: 1592 - DNA, 15 bp, Homo sapiens
acgcccgacagcggc

SEQ ID NO: 1593 - DNA, 15 bp, Homo sapiens
cacgcccgacagcgg

SEQ ID NO: 1594 - DNA, 15 bp, Homo sapiens
gcacgcccgacagcg

SEQ ID NO: 1595 - DNA, 15 bp, Homo sapiens
cgcacgcccgacagc

SEQ ID NO: 1596 - DNA, 15 bp, Homo sapiens
ccgcacgcccgacag

SEQ ID NO: 1597 - DNA, 15 bp, Homo sapiens
gccgcacgcccgaca

SEQ ID NO: 1598 - DNA, 15 bp, Homo sapiens
cgccgcacgcccgac

SEQ ID NO: 1599 - DNA, 15 bp, Homo sapiens
gcgccgcacgcccga

SEQ ID NO: 1600 - DNA, 15 bp, Homo sapiens
agcgccgcacgcccg

SEQ ID NO: 1601 - DNA, 15 bp, Homo sapiens
cagcgccgcacgccc

SEQ ID NO: 1602 - DNA, 15 bp, Homo sapiens
tcagcgccgcacgcc

SEQ ID NO: 1603 - DNA, 15 bp, Homo sapiens
ctcagcgccgcacgc

SEQ ID NO: 1604 - DNA, 15 bp, Homo sapiens
cctcagcgccgcacg

SEQ ID NO: 1605 - DNA, 15 bp, Homo sapiens
ccctcagcgccgcac

SEQ ID NO: 1606 - DNA, 15 bp, Homo sapiens
tccctcagcgccgca

SEQ ID NO: 1607 - DNA, 15 bp, Homo sapiens
gtccctcagcgccgc

SEQ ID NO: 1608 - DNA, 15 bp, Homo sapiens
ggtccctcagcgccg

SEQ ID NO: 1609 - DNA, 15 bp, Homo sapiens
gggtccctcagcgcc

SEQ ID NO: 1610 - DNA, 15 bp, Homo sapiens
cgggtccctcagcgc

SEQ ID NO: 1611 - DNA, 15 bp, Homo sapiens
ccgggtccctcagcg

SEQ ID NO: 1612 - DNA, 15 bp, Homo sapiens
cccgggtccctcagc

SEQ ID NO: 1613 - DNA, 15 bp, Homo sapiens
gcccgggtccctcag

SEQ ID NO: 1614 - DNA, 15 bp, Homo sapiens
cgcccgggtccctca

SEQ ID NO: 1615 - DNA, 15 bp, Homo sapiens
tcgcccgggtccctc

SEQ ID NO: 1616 - DNA, 15 bp, Homo sapiens
ctcgcccgggtccct

SEQ ID NO: 1617 - DNA, 15 bp, Homo sapiens
gctcgcccgggtccc

SEQ ID NO: 1618 - DNA, 15 bp, Homo sapiens
cgctcgcccgggtcc

SEQ ID NO: 1619 - DNA, 15 bp, Homo sapiens
gcgctcgcccgggtc

SEQ ID NO: 1620 - DNA, 15 bp, Homo sapiens
cgcgctcgcccgggt

SEQ ID NO: 1621 - DNA, 15 bp, Homo sapiens
gcgcgctcgcccggg

SEQ ID NO: 1622 - DNA, 15 bp, Homo sapiens
ggcgcgctcgcccgg

SEQ ID NO: 1623 - DNA, 15 bp, Homo sapiens
cggcgcgctcgcccg

SEQ ID NO: 1624 - DNA, 15 bp, Homo sapiens
gcggcgcgctcgccc

SEQ ID NO: 1625 - DNA, 15 bp, Homo sapiens
cgcggcgcgctcgcc

SEQ ID NO: 1626 - DNA, 15 bp, Homo sapiens
gcgcggcgcgctcgc

SEQ ID NO: 1627 - DNA, 15 bp, Homo sapiens
tgcgcggcgcgctcg

SEQ ID NO: 1628 - DNA, 15 bp, Homo sapiens
gtgcgcggcgcgctc

SEQ ID NO: 1629 - DNA, 15 bp, Homo sapiens
ggtgcgcggcgcgct

SEQ ID NO: 1630 - DNA, 15 bp, Homo sapiens
cggtgcgcggcgcgc

SEQ ID NO: 1631 - DNA, 15 bp, Homo sapiens
gcggtgcgcggcgcg

SEQ ID NO: 1632 - DNA, 15 bp, Homo sapiens
ggcggtgcgcggcgc

SEQ ID NO: 1633 - DNA, 15 bp, Homo sapiens
gggcggtgcgcggcg

SEQ ID NO: 1634 - DNA, 15 bp, Homo sapiens
ggggcggtgcgcggc

SEQ ID NO: 1635 - DNA, 15 bp, Homo sapiens
cggggcggtgcgcgg

SEQ ID NO: 1636 - DNA, 15 bp, Homo sapiens
gcggggcggtgcgcg

SEQ ID NO: 1637 - DNA, 15 bp, Homo sapiens
ggcggggcggtgcgc

SEQ ID NO: 1638 - DNA, 15 bp, Homo sapiens
cggcggggcggtgcg

SEQ ID NO: 1639 - DNA, 15 bp, Homo sapiens
ccggcggggcggtgc

SEQ ID NO: 1640 - DNA, 15 bp, Homo sapiens
gccggcggggcggtg

SEQ ID NO: 1641 - DNA, 15 bp, Homo sapiens
agccggcggggcggt

SEQ ID NO: 1642 - DNA, 15 bp, Homo sapiens
gagccggcggggcgg

SEQ ID NO: 1643 - DNA, 15 bp, Homo sapiens
cgagccggcggggcg

SEQ ID NO: 1644 - DNA, 15 bp, Homo sapiens
gcgagccggcggggc

SEQ ID NO: 1645 - DNA, 15 bp, Homo sapiens
ggcgagccggcgggg

SEQ ID NO: 1646 - DNA, 15 bp, Homo sapiens
aggcgagccggcggg

SEQ ID NO: 1647 - DNA, 15 bp, Homo sapiens
gaggcgagccggcgg

SEQ ID NO: 1648 - DNA, 15 bp, Homo sapiens
ggaggcgagccggcg

SEQ ID NO: 1649 - DNA, 15 bp, Homo sapiens
gggaggcgagccggc

SEQ ID NO: 1650 - DNA, 15 bp, Homo sapiens
agggaggcgagccgg

SEQ ID NO: 1651 - DNA, 15 bp, Homo sapiens
gagggaggcgagccg

SEQ ID NO: 1652 - DNA, 15 bp, Homo sapiens
cgagggaggcgagcc

SEQ ID NO: 1653 - DNA, 15 bp, Homo sapiens
gcgagggaggcgagc

SEQ ID NO: 1654 - DNA, 15 bp, Homo sapiens
ggcgagggaggcgag

SEQ ID NO: 1655 - DNA, 15 bp, Homo sapiens
cggcgagggaggcga

SEQ ID NO: 1656 - DNA, 15 bp, Homo sapiens
gcggcgagggaggcg

SEQ ID NO: 1657 - DNA, 15 bp, Homo sapiens
cgcggcgagggaggc

SEQ ID NO: 1658 - DNA, 15 bp, Homo sapiens
acgcggcgagggagg

SEQ ID NO: 1659 - DNA, 15 bp, Homo sapiens
aacgcggcgagggag

SEQ ID NO: 1660 - DNA, 15 bp, Homo sapiens
gaacgcggcgaggga

SEQ ID NO: 1661 - DNA, 15 bp, Homo sapiens
ggaacgcggcgaggg

SEQ ID NO: 1662 - DNA, 15 bp, Homo sapiens
cggaacgcggcgagg

SEQ ID NO: 1663 - DNA, 15 bp, Homo sapiens
gcggaacgcggcgag

SEQ ID NO: 1664 - DNA, 15 bp, Homo sapiens
ggcggaacgcggcga

SEQ ID NO: 1665 - DNA, 15 bp, Homo sapiens
gggcggaacgcggcg

SEQ ID NO: 1666 - DNA, 15 bp, Homo sapiens
agggcggaacgcggc

SEQ ID NO: 1667 - DNA, 15 bp, Homo sapiens
gagggcggaacgcgg

SEQ ID NO: 1668 - DNA, 15 bp, Homo sapiens
tgagggcggaacgcg

SEQ ID NO: 1669 - DNA, 15 bp, Homo sapiens
ctgagggcggaacgc

SEQ ID NO: 1670 - DNA, 15 bp, Homo sapiens
actgagggcggaacg

SEQ ID NO: 1671 - DNA, 15 bp, Homo sapiens
cactgagggcggaac

SEQ ID NO: 1672 - DNA, 15 bp, Homo sapiens
ccactgagggcggaa

SEQ ID NO: 1673 - DNA, 15 bp, Homo sapiens
accactgagggcgga

SEQ ID NO: 1674 - DNA, 15 bp, Homo sapiens
gaccactgagggcgg

SEQ ID NO: 1675 - DNA, 15 bp, Homo sapiens
agaccactgagggcg

SEQ ID NO: 1676 - DNA, 15 bp, Homo sapiens
cagaccactgagggc

SEQ ID NO: 1677 - DNA, 15 bp, Homo sapiens
gcagaccactgaggg

SEQ ID NO: 1678 - DNA, 15 bp, Homo sapiens
ggcagaccactgagg

SEQ ID NO: 1679 - DNA, 15 bp, Homo sapiens
cggcagaccactgag

SEQ ID NO: 1680 - DNA, 15 bp, Homo sapiens
ccggcagaccactga

SEQ ID NO: 1681 - DNA, 15 bp, Homo sapiens
cccggcagaccactg

SEQ ID NO: 1682 - DNA, 15 bp, Homo sapiens
gcccggcagaccact

SEQ ID NO: 1683 - DNA, 15 bp, Homo sapiens
cgcccggcagaccac

SEQ ID NO: 1684 - DNA, 15 bp, Homo sapiens
gcgcccggcagacca

SEQ ID NO: 1685 - DNA, 15 bp, Homo sapiens
ggcgcccggcagacc

SEQ ID NO: 1686 - DNA, 15 bp, Homo sapiens
gggcgcccggcagac

SEQ ID NO: 1687 - DNA, 15 bp, Homo sapiens
ggggcgcccggcaga

SEQ ID NO: 1688 - DNA, 15 bp, Homo sapiens
gggggcgcccggcag

SEQ ID NO: 1689 - DNA, 15 bp, Homo sapiens
agggggcgcccggca

SEQ ID NO: 1690 - DNA, 15 bp, Homo sapiens
gagggggcgcccggc

SEQ ID NO: 1691 - DNA, 15 bp, Homo sapiens
ggagggggcgcccgg

SEQ ID NO: 1692 - DNA, 15 bp, Homo sapiens
aggagggggcgcccg

SEQ ID NO: 1693 - DNA, 15 bp, Homo sapiens
gaggagggggcgccc

SEQ ID NO: 1694 - DNA, 15 bp, Homo sapiens
ggaggagggggcgcc

SEQ ID NO: 1695 - DNA, 15 bp, Homo sapiens
cggaggagggggcgc

SEQ ID NO: 1696 - DNA, 15 bp, Homo sapiens
ccggaggagggggcg

SEQ ID NO: 1697 - DNA, 15 bp, Homo sapiens
gccggaggagggggc

SEQ ID NO: 1698 - DNA, 15 bp, Homo sapiens
ggccggaggaggggg

SEQ ID NO: 1699 - DNA, 15 bp, Homo sapiens
gggccggaggagggg

SEQ ID NO: 1700 - DNA, 15 bp, Homo sapiens
cgggccggaggaggg

SEQ ID NO: 1701 - DNA, 15 bp, Homo sapiens
ccgggccggaggagg

SEQ ID NO: 1702 - DNA, 15 bp, Homo sapiens
cccgggccggaggag

SEQ ID NO: 1703 - DNA, 15 bp, Homo sapiens
gcccgggccggagga

SEQ ID NO: 1704 - DNA, 15 bp, Homo sapiens
cgcccgggccggagg

SEQ ID NO: 1705 - DNA, 15 bp, Homo sapiens
ccgcccgggccggag

SEQ ID NO: 1706 - DNA, 15 bp, Homo sapiens
cccgcccgggccgga

SEQ ID NO: 1707 - DNA, 15 bp, Homo sapiens
ccccgcccgggccgg

SEQ ID NO: 1708 - DNA, 15 bp, Homo sapiens
gccccgcccgggccg

SEQ ID NO: 1709 - DNA, 15 bp, Homo sapiens
ggccccgcccgggcc

SEQ ID NO: 1710 - DNA, 15 bp, Homo sapiens
aggccccgcccgggc

SEQ ID NO: 1711 - DNA, 15 bp, Homo sapiens
gaggccccgcccggg

SEQ ID NO: 1712 - DNA, 15 bp, Homo sapiens
agaggccccgcccgg

SEQ ID NO: 1713 - DNA, 15 bp, Homo sapiens
cagaggccccgcccg

SEQ ID NO: 1714 - DNA, 15 bp, Homo sapiens
tcagaggccccgccc

SEQ ID NO: 1715 - DNA, 15 bp, Homo sapiens
atcagaggccccgcc

SEQ ID NO: 1716 - DNA, 15 bp, Homo sapiens
gatcagaggccccgc

SEQ ID NO: 1717 - DNA, 15 bp, Homo sapiens
cgatcagaggccccg

SEQ ID NO: 1718 - DNA, 15 bp, Homo sapiens
gcgatcagaggcccc

SEQ ID NO: 1719 - DNA, 15 bp, Homo sapiens
ggcgatcagaggccc

SEQ ID NO: 1720 - DNA, 15 bp, Homo sapiens
aggcgatcagaggcc

SEQ ID NO: 1721 - DNA, 15 bp, Homo sapiens
gaggcgatcagaggc

SEQ ID NO: 1722 - DNA, 15 bp, Homo sapiens
tgaggcgatcagagg

SEQ ID NO: 1723 - DNA, 15 bp, Homo sapiens
ttgaggcgatcagag

SEQ ID NO: 1724 - DNA, 15 bp, Homo sapiens
cttgaggcgatcaga

SEQ ID NO: 1725 - DNA, 15 bp, Homo sapiens
tcttgaggcgatcag

SEQ ID NO: 1726 - DNA, 15 bp, Homo sapiens
ctcttgaggcgatca

SEQ ID NO: 1727 - DNA, 15 bp, Homo sapiens
tctcttgaggcgatc

SEQ ID NO: 1728 - DNA, 15 bp, Homo sapiens
ctctcttgaggcgat

SEQ ID NO: 1729 - DNA, 15 bp, Homo sapiens
gctctcttgaggcga

SEQ ID NO: 1730 - DNA, 15 bp, Homo sapiens
cgctctcttgaggcg

SEQ ID NO: 1731 - DNA, 15 bp, Homo sapiens
ccgctctcttgaggc

SEQ ID NO: 1732 - DNA, 15 bp, Homo sapiens
cccgctctcttgagg

SEQ ID NO: 1733 - DNA, 15 bp, Homo sapiens
ccccgctctcttgag

SEQ ID NO: 1734 - DNA, 15 bp, Homo sapiens
tccccgctctcttga

SEQ ID NO: 1735 - DNA, 15 bp, Homo sapiens
ctccccgctctcttg

SEQ ID NO: 1736 - DNA, 15 bp, Homo sapiens
cctccccgctctctt

SEQ ID NO: 1737 - DNA, 15 bp, Homo sapiens
ccctccccgctctct

SEQ ID NO: 1738 - DNA, 15 bp, Homo sapiens
cccctccccgctctc

SEQ ID NO: 1739 - DNA, 15 bp, Homo sapiens
ccccctccccgctct

SEQ ID NO: 1740 - DNA, 15 bp, Homo sapiens
gccccctccccgctc

SEQ ID NO: 1741 - DNA, 15 bp, Homo sapiens
agccccctccccgct

SEQ ID NO: 1742 - DNA, 15 bp, Homo sapiens
gagccccctccccgc

SEQ ID NO: 1743 - DNA, 15 bp, Homo sapiens
cgagccccctccccg

SEQ ID NO: 1744 - DNA, 15 bp, Homo sapiens
ccgagccccctcccc

SEQ ID NO: 1745 - DNA, 15 bp, Homo sapiens
cccgagccccctccc

SEQ ID NO: 1746 - DNA, 15 bp, Homo sapiens
ccccgagccccctcc

SEQ ID NO: 1747 - DNA, 15 bp, Homo sapiens
cccccgagccccctc

SEQ ID NO: 1748 - DNA, 15 bp, Homo sapiens
gcccccgagccccct

SEQ ID NO: 1749 - DNA, 15 bp, Homo sapiens
ggcccccgagccccc

SEQ ID NO: 1750 - DNA, 15 bp, Homo sapiens
cggcccccgagcccc

SEQ ID NO: 1751 - DNA, 15 bp, Homo sapiens
gcggcccccgagccc

SEQ ID NO: 1752 - DNA, 15 bp, Homo sapiens
cgcggcccccgagcc

SEQ ID NO: 1753 - DNA, 15 bp, Homo sapiens
ccgcggcccccgagc

SEQ ID NO: 1754 - DNA, 15 bp, Homo sapiens
gccgcggcccccgag

SEQ ID NO: 1755 - DNA, 15 bp, Homo sapiens
ggccgcggcccccga

SEQ ID NO: 1756 - DNA, 15 bp, Homo sapiens
aggccgcggcccccg

SEQ ID NO: 1757 - DNA, 15 bp, Homo sapiens
caggccgcggccccc

SEQ ID NO: 1758 - DNA, 15 bp, Homo sapiens
gcaggccgcggcccc

SEQ ID NO: 1759 - DNA, 15 bp, Homo sapiens
ggcaggccgcggccc

SEQ ID NO: 1760 - DNA, 15 bp, Homo sapiens
gggcaggccgcggcc

SEQ ID NO: 1761 - DNA, 15 bp, Homo sapiens
agggcaggccgcggc

SEQ ID NO: 1762 - DNA, 15 bp, Homo sapiens
gagggcaggccgcgg

SEQ ID NO: 1763 - DNA, 15 bp, Homo sapiens
ggagggcaggccgcg

SEQ ID NO: 1764 - DNA, 15 bp, Homo sapiens
gggagggcaggccgc

SEQ ID NO: 1765 - DNA, 15 bp, Homo sapiens
cgggagggcaggccg

SEQ ID NO: 1766 - DNA, 15 bp, Homo sapiens
ccgggagggcaggcc

SEQ ID NO: 1767 - DNA, 15 bp, Homo sapiens
gccgggagggcaggc

SEQ ID NO: 1768 - DNA, 15 bp, Homo sapiens
cgccgggagggcagg

SEQ ID NO: 1769 - DNA, 15 bp, Homo sapiens
ccgccgggagggcag

SEQ ID NO: 1770 - DNA, 15 bp, Homo sapiens
cccgccgggagggca

SEQ ID NO: 1771 - DNA, 15 bp, Homo sapiens
gcccgccgggagggc

SEQ ID NO: 1772 - DNA, 15 bp, Homo sapiens
cgcccgccgggaggg

SEQ ID NO: 1773 - DNA, 15 bp, Homo sapiens
ccgcccgccgggagg

SEQ ID NO: 1774 - DNA, 15 bp, Homo sapiens
gccgcccgccgggag

SEQ ID NO: 1775 - DNA, 15 bp, Homo sapiens
agccgcccgccggga

SEQ ID NO: 1776 - DNA, 15 bp, Homo sapiens
cagccgcccgccggg

SEQ ID NO: 1777 - DNA, 15 bp, Homo sapiens
tcagccgcccgccgg

SEQ ID NO: 1778 - DNA, 15 bp, Homo sapiens
ctcagccgcccgccg

SEQ ID NO: 1779 - DNA, 15 bp, Homo sapiens
cctcagccgcccgcc

SEQ ID NO: 1780 - DNA, 15 bp, Homo sapiens
ccctcagccgcccgc

SEQ ID NO: 1781 - DNA, 15 bp, Homo sapiens
gccctcagccgcccg

SEQ ID NO: 1782 - DNA, 15 bp, Homo sapiens
cgccctcagccgccc

SEQ ID NO: 1783 - DNA, 15 bp, Homo sapiens
tcgccctcagccgcc

SEQ ID NO: 1784 - DNA, 15 bp, Homo sapiens
ctcgccctcagccgc

SEQ ID NO: 1785 - DNA, 15 bp, Homo sapiens
cctcgccctcagccg

SEQ ID NO: 1786 - DNA, 15 bp, Homo sapiens
ccctcgccctcagcc

SEQ ID NO: 1787 - DNA, 15 bp, Homo sapiens
tccctcgccctcagc

SEQ ID NO: 1788 - DNA, 15 bp, Homo sapiens
ctccctcgccctcag

SEQ ID NO: 1789 - DNA, 15 bp, Homo sapiens
cctccctcgccctca

SEQ ID NO: 1790 - DNA, 15 bp, Homo sapiens
gcctccctcgccctc

SEQ ID NO: 1791 - DNA, 15 bp, Homo sapiens
ggcctccctcgccct

SEQ ID NO: 1792 - DNA, 15 bp, Homo sapiens
gggcctccctcgccc

SEQ ID NO: 1793 - DNA, 15 bp, Homo sapiens
agggcctccctcgcc

SEQ ID NO: 1794 - DNA, 15 bp, Homo sapiens
gagggcctccctcgc

SEQ ID NO: 1795 - DNA, 15 bp, Homo sapiens
ggagggcctccctcg

SEQ ID NO: 1796 - DNA, 15 bp, Homo sapiens
gggagggcctccctc

SEQ ID NO: 1797 - DNA, 15 bp, Homo sapiens
agggagggcctccct

SEQ ID NO: 1798 - DNA, 15 bp, Homo sapiens
aagggagggcctccc

SEQ ID NO: 1799 - DNA, 15 bp, Homo sapiens
gaagggagggcctcc

SEQ ID NO: 1800 - DNA, 15 bp, Homo sapiens
agaagggagggcctc

SEQ ID NO: 1801 - DNA, 15 bp, Homo sapiens
cagaagggagggcct

SEQ ID NO: 1802 - DNA, 15 bp, Homo sapiens
ccagaagggagggcc

SEQ ID NO: 1803 - DNA, 15 bp, Homo sapiens
gccagaagggagggc

SEQ ID NO: 1804 - DNA, 15 bp, Homo sapiens
cgccagaagggaggg

SEQ ID NO: 1805 - DNA, 15 bp, Homo sapiens
tcgccagaagggagg

SEQ ID NO: 1806 - DNA, 15 bp, Homo sapiens
ctcgccagaagggag

SEQ ID NO: 1807 - DNA, 15 bp, Homo sapiens
cctcgccagaaggga

SEQ ID NO: 1808 - DNA, 15 bp, Homo sapiens
ccctcgccagaaggg

SEQ ID NO: 1809 - DNA, 15 bp, Homo sapiens
cccctcgccagaagg

SEQ ID NO: 1810 - DNA, 15 bp, Homo sapiens
tcccctcgccagaag

SEQ ID NO: 1811 - DNA, 15 bp, Homo sapiens
ctcccctcgccagaa

SEQ ID NO: 1812 - DNA, 15 bp, Homo sapiens
cctcccctcgccaga

SEQ ID NO: 1813 - DNA, 15 bp, Homo sapiens
ccctcccctcgccag

SEQ ID NO: 1814 - DNA, 15 bp, Homo sapiens
tccctcccctcgcca

SEQ ID NO: 1815 - DNA, 15 bp, Homo sapiens
ctccctcccctcgcc

SEQ ID NO: 1816 - DNA, 15 bp, Homo sapiens
cctccctcccctcgc

SEQ ID NO: 1817 - DNA, 15 bp, Homo sapiens
ccctccctcccctcg

SEQ ID NO: 1818 - DNA, 15 bp, Homo sapiens
accctccctcccctc

SEQ ID NO: 1819 - DNA, 15 bp, Homo sapiens
caccctccctcccct

SEQ ID NO: 1820 - DNA, 15 bp, Homo sapiens
ccaccctccctcccc

SEQ ID NO: 1821 - DNA, 15 bp, Homo sapiens
cccaccctccctccc

SEQ ID NO: 1822 - DNA, 15 bp, Homo sapiens
acccaccctccctcc

SEQ ID NO: 1823 - DNA, 15 bp, Homo sapiens
gacccaccctccctc

SEQ ID NO: 1824 - DNA, 15 bp, Homo sapiens
tgacccaccctccct

SEQ ID NO: 1825 - DNA, 15 bp, Homo sapiens
ctgacccaccctccc

SEQ ID NO: 1826 - DNA, 15 bp, Homo sapiens
cctgacccaccctcc

SEQ ID NO: 1827 - DNA, 15 bp, Homo sapiens
tcctgacccaccctc

SEQ ID NO: 1828 - DNA, 15 bp, Homo sapiens
ctcctgacccaccct

SEQ ID NO: 1829 - DNA, 15 bp, Homo sapiens
gctcctgacccaccc

SEQ ID NO: 1830 - DNA, 15 bp, Homo sapiens
ggctcctgacccacc

SEQ ID NO: 1831 - DNA, 15 bp, Homo sapiens
gggctcctgacccac

SEQ ID NO: 1832 - DNA, 15 bp, Homo sapiens
ggggctcctgaccca

SEQ ID NO: 1833 - DNA, 15 bp, Homo sapiens
gggggctcctgaccc

SEQ ID NO: 1834 - DNA, 15 bp, Homo sapiens
tgggggctcctgacc

SEQ ID NO: 1835 - DNA, 15 bp, Homo sapiens
ttgggggctcctgac

SEQ ID NO: 1836 - DNA, 15 bp, Homo sapiens
gttgggggctcctga

SEQ ID NO: 1837 - DNA, 15 bp, Homo sapiens
ggttgggggctcctg

SEQ ID NO: 1838 - DNA, 15 bp, Homo sapiens
gggttgggggctcct

SEQ ID NO: 1839 - DNA, 15 bp, Homo sapiens
cgggttgggggctcc

SEQ ID NO: 1840 - DNA, 15 bp, Homo sapiens
gcgggttgggggctc

SEQ ID NO: 1841 - DNA, 15 bp, Homo sapiens
ggcgggttgggggct

SEQ ID NO: 1842 - DNA, 15 bp, Homo sapiens
gggcgggttgggggc

SEQ ID NO: 1843 - DNA, 15 bp, Homo sapiens
agggcgggttggggg

SEQ ID NO: 1844 - DNA, 15 bp, Homo sapiens
cagggcgggttgggg

SEQ ID NO: 1845 - DNA, 15 bp, Homo sapiens
gcagggcgggttggg

SEQ ID NO: 1846 - DNA, 15 bp, Homo sapiens
cgcagggcgggttgg

SEQ ID NO: 1847 - DNA, 15 bp, Homo sapiens
ccgcagggcgggttg

SEQ ID NO: 1848 - DNA, 15 bp, Homo sapiens
tccgcagggcgggtt

SEQ ID NO: 1849 - DNA, 15 bp, Homo sapiens
ctccgcagggcgggt

SEQ ID NO: 1850 - DNA, 15 bp, Homo sapiens
gctccgcagggcggg

SEQ ID NO: 1851 - DNA, 15 bp, Homo sapiens
agctccgcagggcgg

SEQ ID NO: 1852 - DNA, 15 bp, Homo sapiens
gagctccgcagggcg

SEQ ID NO: 1853 - DNA, 15 bp, Homo sapiens
cgagctccgcagggc

SEQ ID NO: 1854 - DNA, 15 bp, Homo sapiens
ccgagctccgcaggg

SEQ ID NO: 1855 - DNA, 15 bp, Homo sapiens
cccgagctccgcagg

SEQ ID NO: 1856 - DNA, 15 bp, Homo sapiens
ccccgagctccgcag

SEQ ID NO: 1857 - DNA, 15 bp, Homo sapiens
gccccgagctccgca

SEQ ID NO: 1858 - DNA, 15 bp, Homo sapiens
ggccccgagctccgc

SEQ ID NO: 1859 - DNA, 15 bp, Homo sapiens
cggccccgagctccg

SEQ ID NO: 1860 - DNA, 15 bp, Homo sapiens
gcggccccgagctcc

SEQ ID NO: 1861 - DNA, 15 bp, Homo sapiens
cgcggccccgagctc

SEQ ID NO: 1862 - DNA, 15 bp, Homo sapiens
gcgcggccccgagct

SEQ ID NO: 1863 - DNA, 15 bp, Homo sapiens
cgcgcggccccgagc

SEQ ID NO: 1864 - DNA, 15 bp, Homo sapiens
tcgcgcggccccgag

SEQ ID NO: 1865 - DNA, 15 bp, Homo sapiens
ctcgcgcggccccga

SEQ ID NO: 1866 - DNA, 15 bp, Homo sapiens
cctcgcgcggccccg

SEQ ID NO: 1867 - DNA, 15 bp, Homo sapiens
ccctcgcgcggcccc

SEQ ID NO: 1868 - DNA, 15 bp, Homo sapiens
cccctcgcgcggccc

SEQ ID NO: 1869 - DNA, 15 bp, Homo sapiens
gcccctcgcgcggcc

SEQ ID NO: 1870 - DNA, 15 bp, Homo sapiens
cgcccctcgcgcggc

SEQ ID NO: 1871 - DNA, 15 bp, Homo sapiens
ccgcccctcgcgcgg

SEQ ID NO: 1872 - DNA, 15 bp, Homo sapiens
accgcccctcgcgcg

SEQ ID NO: 1873 - DNA, 15 bp, Homo sapiens
aaccgcccctcgcgc

SEQ ID NO: 1874 - DNA, 15 bp, Homo sapiens
caaccgcccctcgcg

SEQ ID NO: 1875 - DNA, 15 bp, Homo sapiens
acaaccgcccctcgc

SEQ ID NO: 1876 - DNA, 15 bp, Homo sapiens
gacaaccgcccctcg

SEQ ID NO: 1877 - DNA, 15 bp, Homo sapiens
agacaaccgcccctc

SEQ ID NO: 1878 - DNA, 15 bp, Homo sapiens
cagacaaccgcccct

SEQ ID NO: 1879 - DNA, 15 bp, Homo sapiens
ccagacaaccgcccc

SEQ ID NO: 1880 - DNA, 15 bp, Homo sapiens
cccagacaaccgccc

SEQ ID NO: 1881 - DNA, 15 bp, Homo sapiens
ccccagacaaccgcc

SEQ ID NO: 1882 - DNA, 15 bp, Homo sapiens
cccccagacaaccgc

SEQ ID NO: 1883 - DNA, 15 bp, Homo sapiens
tcccccagacaaccg

SEQ ID NO: 1884 - DNA, 15 bp, Homo sapiens
ctcccccagacaacc

SEQ ID NO: 1885 - DNA, 15 bp, Homo sapiens
cctcccccagacaac

SEQ ID NO: 1886 - DNA, 15 bp, Homo sapiens
ccctcccccagacaa

SEQ ID NO: 1887 - DNA, 15 bp, Homo sapiens
cccctcccccagaca

SEQ ID NO: 1888 - DNA, 15 bp, Homo sapiens
ccccctcccccagac

SEQ ID NO: 1889 - DNA, 15 bp, Homo sapiens
gccccctcccccaga

SEQ ID NO: 1890 - DNA, 15 bp, Homo sapiens
cgccccctcccccag

SEQ ID NO: 1891 - DNA, 15 bp, Homo sapiens
gcgccccctccccca

SEQ ID NO: 1892 - DNA, 15 bp, Homo sapiens
cgcgccccctccccc

SEQ ID NO: 1893 - DNA, 15 bp, Homo sapiens
ccgcgccccctcccc

SEQ ID NO: 1894 - DNA, 15 bp, Homo sapiens
cccgcgccccctccc

SEQ ID NO: 1895 - DNA, 15 bp, Homo sapiens
ccccgcgccccctcc

SEQ ID NO: 1896 - DNA, 15 bp, Homo sapiens
accccgcgccccctc

SEQ ID NO: 1897 - DNA, 15 bp, Homo sapiens
caccccgcgccccct

SEQ ID NO: 1898 - DNA, 15 bp, Homo sapiens
tcaccccgcgccccc

SEQ ID NO: 1899 - DNA, 15 bp, Homo sapiens
atcaccccgcgcccc

SEQ ID NO: 1900 - DNA, 15 bp, Homo sapiens
aatcaccccgcgccc

SEQ ID NO: 1901 - DNA, 15 bp, Homo sapiens
gaatcaccccgcgcc

SEQ ID NO: 1902 - DNA, 15 bp, Homo sapiens
tgaatcaccccgcgc

SEQ ID NO: 1903 - DNA, 15 bp, Homo sapiens
ctgaatcaccccgcg

SEQ ID NO: 1904 - DNA, 15 bp, Homo sapiens
gctgaatcaccccgc

SEQ ID NO: 1905 - DNA, 15 bp, Homo sapiens
cgctgaatcaccccg

SEQ ID NO: 1906 - DNA, 15 bp, Homo sapiens
gcgctgaatcacccc

SEQ ID NO: 1907 - DNA, 15 bp, Homo sapiens
ggcgctgaatcaccc

SEQ ID NO: 1908 - DNA, 15 bp, Homo sapiens
gggcgctgaatcacc

SEQ ID NO: 1909 - DNA, 15 bp, Homo sapiens
cgggcgctgaatcac

SEQ ID NO: 1910 - DNA, 15 bp, Homo sapiens
ccgggcgctgaatca

SEQ ID NO: 1911 - DNA, 15 bp, Homo sapiens
gccgggcgctgaatc

SEQ ID NO: 1912 - DNA, 15 bp, Homo sapiens
cgccgggcgctgaat

SEQ ID NO: 1913 - DNA, 15 bp, Homo sapiens
tcgccgggcgctgaa

SEQ ID NO: 1914 - DNA, 15 bp, Homo sapiens
ctcgccgggcgctga

SEQ ID NO: 1915 - DNA, 15 bp, Homo sapiens
cctcgccgggcgctg

SEQ ID NO: 1916 - DNA, 15 bp, Homo sapiens
gcctcgccgggcgct

SEQ ID NO: 1917 - DNA, 15 bp, Homo sapiens
cgcctcgccgggcgc

SEQ ID NO: 1918 - DNA, 15 bp, Homo sapiens
ccgcctcgccgggcg

SEQ ID NO: 1919 - DNA, 15 bp, Homo sapiens
tccgcctcgccgggc

SEQ ID NO: 1920 - DNA, 15 bp, Homo sapiens
ttccgcctcgccggg

SEQ ID NO: 1921 - DNA, 15 bp, Homo sapiens
cttccgcctcgccgg

SEQ ID NO: 1922 - DNA, 15 bp, Homo sapiens
gcttccgcctcgccg

SEQ ID NO: 1923 - DNA, 15 bp, Homo sapiens
cgcttccgcctcgcc

SEQ ID NO: 1924 - DNA, 15 bp, Homo sapiens
ccgcttccgcctcgc

SEQ ID NO: 1925 - DNA, 15 bp, Homo sapiens
gccgcttccgcctcg

SEQ ID NO: 1926 - DNA, 15 bp, Homo sapiens
ggccgcttccgcctc

SEQ ID NO: 1927 - DNA, 15 bp, Homo sapiens
cggccgcttccgcct

SEQ ID NO: 1928 - DNA, 15 bp, Homo sapiens
gcggccgcttccgcc

SEQ ID NO: 1929 - DNA, 15 bp, Homo sapiens
tgcggccgcttccgc

SEQ ID NO: 1930 - DNA, 15 bp, Homo sapiens
ttgcggccgcttccg

SEQ ID NO: 1931 - DNA, 15 bp, Homo sapiens
cttgcggccgcttcc

SEQ ID NO: 1932 - DNA, 15 bp, Homo sapiens
tcttgcggccgcttc

SEQ ID NO: 1933 - DNA, 15 bp, Homo sapiens
ctcttgcggccgctt

SEQ ID NO: 1934 - DNA, 15 bp, Homo sapiens
cctcttgcggccgct

SEQ ID NO: 1935 - DNA, 15 bp, Homo sapiens
tcctcttgcggccgc

SEQ ID NO: 1936 - DNA, 15 bp, Homo sapiens
ctcctcttgcggccg

SEQ ID NO: 1937 - DNA, 15 bp, Homo sapiens
cctcctcttgcggcc

SEQ ID NO: 1938 - DNA, 15 bp, Homo sapiens
tcctcctcttgcggc

SEQ ID NO: 1939 - DNA, 15 bp, Homo sapiens
ctcctcctcttgcgg

SEQ ID NO: 1940 - DNA, 15 bp, Homo sapiens
cctcctcctcttgcg

SEQ ID NO: 1941 - DNA, 15 bp, Homo sapiens
ccctcctcctcttgc

SEQ ID NO: 1942 - DNA, 15 bp, Homo sapiens
cccctcctcctcttg

SEQ ID NO: 1943 - DNA, 15 bp, Homo sapiens
tcccctcctcctctt

SEQ ID NO: 1944 - DNA, 15 bp, Homo sapiens
ctcccctcctcctct

SEQ ID NO: 1945 - DNA, 15 bp, Homo sapiens
tctcccctcctcctc

SEQ ID NO: 1946 - DNA, 15 bp, Homo sapiens
ctctcccctcctcct

SEQ ID NO: 1947 - DNA, 15 bp, Homo sapiens
gctctcccctcctcc

SEQ ID NO: 1948 - DNA, 15 bp, Homo sapiens
ggctctcccctcctc

SEQ ID NO: 1949 - DNA, 15 bp, Homo sapiens
gggctctcccctcct

SEQ ID NO: 1950 - DNA, 15 bp, Homo sapiens
cgggctctcccctcc

SEQ ID NO: 1951 - DNA, 15 bp, Homo sapiens
acgggctctcccctc

SEQ ID NO: 1952 - DNA, 15 bp, Homo sapiens
gacgggctctcccct

SEQ ID NO: 1953 - DNA, 15 bp, Homo sapiens
ggacgggctctcccc

SEQ ID NO: 1954 - DNA, 15 bp, Homo sapiens
cggacgggctctccc

SEQ ID NO: 1955 - DNA, 15 bp, Homo sapiens
gcggacgggctctcc

SEQ ID NO: 1956 - DNA, 15 bp, Homo sapiens
cgcggacgggctctc

SEQ ID NO: 1957 - DNA, 15 bp, Homo sapiens
gcgcggacgggctct

SEQ ID NO: 1958 - DNA, 15 bp, Homo sapiens
ggcgcggacgggctc

SEQ ID NO: 1959 - DNA, 15 bp, Homo sapiens
aggcgcggacgggct

SEQ ID NO: 1960 - DNA, 15 bp, Homo sapiens
caggcgcggacgggc

SEQ ID NO: 1961 - DNA, 15 bp, Homo sapiens
ccaggcgcggacggg

SEQ ID NO: 1962 - DNA, 15 bp, Homo sapiens
cccaggcgcggacgg

SEQ ID NO: 1963 - DNA, 15 bp, Homo sapiens
gcccaggcgcggacg

SEQ ID NO: 1964 - DNA, 15 bp, Homo sapiens
agcccaggcgcggac

SEQ ID NO: 1965 - DNA, 15 bp, Homo sapiens
gagcccaggcgcgga

SEQ ID NO: 1966 - DNA, 15 bp, Homo sapiens
ggagcccaggcgcgg

SEQ ID NO: 1967 - DNA, 15 bp, Homo sapiens
gggagcccaggcgcg

SEQ ID NO: 1968 - DNA, 15 bp, Homo sapiens
cgggagcccaggcgc

SEQ ID NO: 1969 - DNA, 15 bp, Homo sapiens
ccgggagcccaggcg

SEQ ID NO: 1970 - DNA, 15 bp, Homo sapiens
cccgggagcccaggc

SEQ ID NO: 1971 - DNA, 15 bp, Homo sapiens
ccccgggagcccagg

SEQ ID NO: 1972 - DNA, 15 bp, Homo sapiens
accccgggagcccag

SEQ ID NO: 1973 - DNA, 15 bp, Homo sapiens
caccccgggagccca

SEQ ID NO: 1974 - DNA, 15 bp, Homo sapiens
ccaccccgggagccc

SEQ ID NO: 1975 - DNA, 15 bp, Homo sapiens
gccaccccgggagcc

SEQ ID NO: 1976 - DNA, 15 bp, Homo sapiens
tgccaccccgggagc

SEQ ID NO: 1977 - DNA, 15 bp, Homo sapiens
gtgccaccccgggag

SEQ ID NO: 1978 - DNA, 15 bp, Homo sapiens
cgtgccaccccggga

SEQ ID NO: 1979 - DNA, 15 bp, Homo sapiens
tcgtgccaccccggg

SEQ ID NO: 1980 - DNA, 15 bp, Homo sapiens
ctcgtgccaccccgg

SEQ ID NO: 1981 - DNA, 15 bp, Homo sapiens
gctcgtgccaccccg

SEQ ID NO: 1982 - DNA, 15 bp, Homo sapiens
ggctcgtgccacccc

SEQ ID NO: 1983 - DNA, 15 bp, Homo sapiens
gggctcgtgccaccc

SEQ ID NO: 1984 - DNA, 15 bp, Homo sapiens
cgggctcgtgccacc

SEQ ID NO: 1985 - DNA, 15 bp, Homo sapiens
gcgggctcgtgccac

SEQ ID NO: 1986 - DNA, 15 bp, Homo sapiens
cgcgggctcgtgcca

SEQ ID NO: 1987 - DNA, 15 bp, Homo sapiens
ccgcgggctcgtgcc

SEQ ID NO: 1988 - DNA, 15 bp, Homo sapiens
gccgcgggctcgtgc

SEQ ID NO: 1989 - DNA, 15 bp, Homo sapiens
ggccgcgggctcgtg

SEQ ID NO: 1990 - DNA, 15 bp, Homo sapiens
cggccgcgggctcgt

SEQ ID NO: 1991 - DNA, 15 bp, Homo sapiens
ccggccgcgggctcg

SEQ ID NO: 1992 - DNA, 15 bp, Homo sapiens
tccggccgcgggctc

SEQ ID NO: 1993 - DNA, 15 bp, Homo sapiens
ctccggccgcgggct

SEQ ID NO: 1994 - DNA, 15 bp, Homo sapiens
actccggccgcgggc

SEQ ID NO: 1995 - DNA, 15 bp, Homo sapiens
cactccggccgcggg

SEQ ID NO: 1996 - DNA, 15 bp, Homo sapiens
gcactccggccgcgg

SEQ ID NO: 1997 - DNA, 15 bp, Homo sapiens
cgcactccggccgcg

SEQ ID NO: 1998 - DNA, 15 bp, Homo sapiens
tcgcactccggccgc

SEQ ID NO: 1999 - DNA, 15 bp, Homo sapiens
ctcgcactccggccg

SEQ ID NO: 2000 - DNA, 15 bp, Homo sapiens
cctcgcactccggcc

SEQ ID NO: 2001 - DNA, 15 bp, Homo sapiens
gcctcgcactccggc

SEQ ID NO: 2002 - DNA, 15 bp, Homo sapiens
cgcctcgcactccgg

SEQ ID NO: 2003 - DNA, 15 bp, Homo sapiens
ccgcctcgcactccg

SEQ ID NO: 2004 - DNA, 15 bp, Homo sapiens
tccgcctcgcactcc

SEQ ID NO: 2005 - DNA, 15 bp, Homo sapiens
ctccgcctcgcactc

SEQ ID NO: 2006 - DNA, 15 bp, Homo sapiens
cctccgcctcgcact

SEQ ID NO: 2007 - DNA, 15 bp, Homo sapiens
gcctccgcctcgcac

SEQ ID NO: 2008 - DNA, 15 bp, Homo sapiens
cgcctccgcctcgca

SEQ ID NO: 2009 - DNA, 15 bp, Homo sapiens
tcgcctccgcctcgc

SEQ ID NO: 2010 - DNA, 15 bp, Homo sapiens
ctcgcctccgcctcg

SEQ ID NO: 2011 - DNA, 15 bp, Homo sapiens
cctcgcctccgcctc

SEQ ID NO: 2012 - DNA, 15 bp, Homo sapiens
tcctcgcctccgcct

SEQ ID NO: 2013 - DNA, 15 bp, Homo sapiens
ctcctcgcctccgcc

SEQ ID NO: 2014 - DNA, 15 bp, Homo sapiens
cctcctcgcctccgc

SEQ ID NO: 2015 - DNA, 15 bp, Homo sapiens
gcctcctcgcctccg

SEQ ID NO: 2016 - DNA, 15 bp, Homo sapiens
ggcctcctcgcctcc

SEQ ID NO: 2017 - DNA, 15 bp, Homo sapiens
cggcctcctcgcctc

SEQ ID NO: 2018 - DNA, 15 bp, Homo sapiens
gcggcctcctcgcct

SEQ ID NO: 2019 - DNA, 15 bp, Homo sapiens
cgcggcctcctcgcc

SEQ ID NO: 2020 - DNA, 15 bp, Homo sapiens
ccgcggcctcctcgc

SEQ ID NO: 2021 - DNA, 15 bp, Homo sapiens
cccgcggcctcctcg

SEQ ID NO: 2022 - DNA, 15 bp, Homo sapiens
ccccgcggcctcctc

SEQ ID NO: 2023 - DNA, 15 bp, Homo sapiens
tccccgcggcctcct

SEQ ID NO: 2024 - DNA, 15 bp, Homo sapiens
gtccccgcggcctcc

SEQ ID NO: 2025 - DNA, 15 bp, Homo sapiens
cgtccccgcggcctc

SEQ ID NO: 2026 - DNA, 15 bp, Homo sapiens
ccgtccccgcggcct

SEQ ID NO: 2027 - DNA, 15 bp, Homo sapiens
cccgtccccgcggcc

SEQ ID NO: 2028 - DNA, 15 bp, Homo sapiens
tcccgtccccgcggc

SEQ ID NO: 2029 - DNA, 15 bp, Homo sapiens
ctcccgtccccgcgg

SEQ ID NO: 2030 - DNA, 15 bp, Homo sapiens
cctcccgtccccgcg

SEQ ID NO: 2031 - DNA, 15 bp, Homo sapiens
gcctcccgtccccgc

SEQ ID NO: 2032 - DNA, 15 bp, Homo sapiens
cgcctcccgtccccg

SEQ ID NO: 2033 - DNA, 15 bp, Homo sapiens
tcgcctcccgtcccc

SEQ ID NO: 2034 - DNA, 15 bp, Homo sapiens
ctcgcctcccgtccc

SEQ ID NO: 2035 - DNA, 15 bp, Homo sapiens
cctcgcctcccgtcc

SEQ ID NO: 2036 - DNA, 15 bp, Homo sapiens
gcctcgcctcccgtc

SEQ ID NO: 2037 - DNA, 15 bp, Homo sapiens
ggcctcgcctcccgt

SEQ ID NO: 2038 - DNA, 15 bp, Homo sapiens
cggcctcgcctcccg

SEQ ID NO: 2039 - DNA, 15 bp, Homo sapiens
ccggcctcgcctccc

SEQ ID NO: 2040 - DNA, 15 bp, Homo sapiens
gccggcctcgcctcc

SEQ ID NO: 2041 - DNA, 15 bp, Homo sapiens
ggccggcctcgcctc

SEQ ID NO: 2042 - DNA, 15 bp, Homo sapiens
cggccggcctcgcct

SEQ ID NO: 2043 - DNA, 15 bp, Homo sapiens
ccggccggcctcgcc

SEQ ID NO: 2044 - DNA, 15 bp, Homo sapiens
cccggccggcctcgc

SEQ ID NO: 2045 - DNA, 15 bp, Homo sapiens
gcccggccggcctcg

SEQ ID NO: 2046 - DNA, 15 bp, Homo sapiens
ggcccggccggcctc

SEQ ID NO: 2047 - DNA, 15 bp, Homo sapiens
gggcccggccggcct

SEQ ID NO: 2048 - DNA, 15 bp, Homo sapiens
ggggcccggccggcc

SEQ ID NO: 2049 - DNA, 15 bp, Homo sapiens
gggggcccggccggc

SEQ ID NO: 2050 - DNA, 15 bp, Homo sapiens
cgggggcccggccgg

SEQ ID NO: 2051 - DNA, 15 bp, Homo sapiens
tcgggggcccggccg

SEQ ID NO: 2052 - DNA, 15 bp, Homo sapiens
ttcgggggcccggcc

SEQ ID NO: 2053 - DNA, 15 bp, Homo sapiens
cttcgggggcccggc

SEQ ID NO: 2054 - DNA, 15 bp, Homo sapiens
gcttcgggggcccgg

SEQ ID NO: 2055 - DNA, 15 bp, Homo sapiens
ggcttcgggggcccg

SEQ ID NO: 2056 - DNA, 15 bp, Homo sapiens
tggcttcgggggccc

SEQ ID NO: 2057 - DNA, 15 bp, Homo sapiens
atggcttcgggggcc

SEQ ID NO: 2058 - DNA, 15 bp, Homo sapiens
catggcttcgggggc

SEQ ID NO: 2059 - DNA, 15 bp, Homo sapiens
ccatggcttcggggg

SEQ ID NO: 2060 - DNA, 15 bp, Homo sapiens
tccatggcttcgggg

SEQ ID NO: 2061 - DNA, 15 bp, Homo sapiens
ctccatggcttcggg

SEQ ID NO: 2062 - DNA, 15 bp, Homo sapiens
tctccatggcttcgg

SEQ ID NO: 2063 - DNA, 15 bp, Homo sapiens
ttctccatggcttcg

SEQ ID NO: 2064 - DNA, 15 bp, Homo sapiens
gttctccatggcttc

SEQ ID NO: 2065 - DNA, 15 bp, Homo sapiens
cgttctccatggctt

SEQ ID NO: 2066 - DNA, 15 bp, Homo sapiens
gcgttctccatggct

SEQ ID NO: 2067 - DNA, 15 bp, Homo sapiens
cgcgttctccatggc

SEQ ID NO: 2068 - DNA, 15 bp, Homo sapiens
gcgcgttctccatgg

SEQ ID NO: 2069 - DNA, 15 bp, Homo sapiens
tgcgcgttctccatg

SEQ ID NO: 2070 - DNA, 15 bp, Homo sapiens
gtgcgcgttctccat

SEQ ID NO: 2071 - DNA, 15 bp, Homo sapiens
tgtgcgcgttctcca

SEQ ID NO: 2072 - DNA, 15 bp, Homo sapiens
gtgtgcgcgttctcc

SEQ ID NO: 2073 - DNA, 15 bp, Homo sapiens
ggtgtgcgcgttctc

SEQ ID NO: 2074 - DNA, 15 bp, Homo sapiens
tggtgtgcgcgttct

SEQ ID NO: 2075 - DNA, 15 bp, Homo sapiens
ttggtgtgcgcgttc

SEQ ID NO: 2076 - DNA, 15 bp, Homo sapiens
cttggtgtgcgcgtt

SEQ ID NO: 2077 - DNA, 15 bp, Homo sapiens
tcttggtgtgcgcgt

SEQ ID NO: 2078 - DNA, 15 bp, Homo sapiens
gtcttggtgtgcgcg

SEQ ID NO: 2079 - DNA, 15 bp, Homo sapiens
cgtcttggtgtgcgc

SEQ ID NO: 2080 - DNA, 15 bp, Homo sapiens
ccgtcttggtgtgcg

SEQ ID NO: 2081 - DNA, 15 bp, Homo sapiens
accgtcttggtgtgc

SEQ ID NO: 2082 - DNA, 15 bp, Homo sapiens
caccgtcttggtgtg

SEQ ID NO: 2083 - DNA, 15 bp, Homo sapiens
ccaccgtcttggtgt

SEQ ID NO: 2084 - DNA, 15 bp, Homo sapiens
tccaccgtcttggtg

SEQ ID NO: 2085 - DNA, 15 bp, Homo sapiens
ctccaccgtcttggt

SEQ ID NO: 2086 - DNA, 15 bp, Homo sapiens
cctccaccgtcttgg

SEQ ID NO: 2087 - DNA, 15 bp, Homo sapiens
tcctccaccgtcttg

SEQ ID NO: 2088 - DNA, 15 bp, Homo sapiens
ctcctccaccgtctt

SEQ ID NO: 2089 - DNA, 15 bp, Homo sapiens
cctcctccaccgtct

SEQ ID NO: 2090 - DNA, 15 bp, Homo sapiens
acctcctccaccgtc

SEQ ID NO: 2091 - DNA, 15 bp, Homo sapiens
cacctcctccaccgt

SEQ ID NO: 2092 - DNA, 15 bp, Homo sapiens
gcacctcctccaccg

SEQ ID NO: 2093 - DNA, 15 bp, Homo sapiens
agcacctcctccacc

SEQ ID NO: 2094 - DNA, 15 bp, Homo sapiens
cagcacctcctccac

SEQ ID NO: 2095 - DNA, 15 bp, Homo sapiens
ccagcacctcctcca

SEQ ID NO: 2096 - DNA, 15 bp, Homo sapiens
cccagcacctcctcc

SEQ ID NO: 2097 - DNA, 15 bp, Homo sapiens
gcccagcacctcctc

SEQ ID NO: 2098 - DNA, 15 bp, Homo sapiens
ggcccagcacctcct

SEQ ID NO: 2099 - DNA, 15 bp, Homo sapiens
tggcccagcacctcc

SEQ ID NO: 2100 - DNA, 15 bp, Homo sapiens
gtggcccagcacctc

SEQ ID NO: 2101 - DNA, 15 bp, Homo sapiens
agtggcccagcacct

SEQ ID NO: 2102 - DNA, 15 bp, Homo sapiens
aagtggcccagcacc

SEQ ID NO: 2103 - DNA, 15 bp, Homo sapiens
gaagtggcccagcac

SEQ ID NO: 2104 - DNA, 15 bp, Homo sapiens
cgaagtggcccagca

SEQ ID NO: 2105 - DNA, 15 bp, Homo sapiens
ccgaagtggcccagc

SEQ ID NO: 2106 - DNA, 15 bp, Homo sapiens
gccgaagtggcccag

SEQ ID NO: 2107 - DNA, 15 bp, Homo sapiens
cgccgaagtggccca

SEQ ID NO: 2108 - DNA, 15 bp, Homo sapiens
acgccgaagtggccc

SEQ ID NO: 2109 - DNA, 15 bp, Homo sapiens
gacgccgaagtggcc

SEQ ID NO: 2110 - DNA, 15 bp, Homo sapiens
tgacgccgaagtggc

SEQ ID NO: 2111 - DNA, 15 bp, Homo sapiens
ttgacgccgaagtgg

SEQ ID NO: 2112 - DNA, 15 bp, Homo sapiens
gttgacgccgaagtg

SEQ ID NO: 2113 - DNA, 15 bp, Homo sapiens
cgttgacgccgaagt

SEQ ID NO: 2114 - DNA, 15 bp, Homo sapiens
tcgttgacgccgaag

SEQ ID NO: 2115 - DNA, 15 bp, Homo sapiens
ctcgttgacgccgaa

SEQ ID NO: 2116 - DNA, 15 bp, Homo sapiens
tctcgttgacgccga

SEQ ID NO: 2117 - DNA, 15 bp, Homo sapiens
ctctcgttgacgccg

SEQ ID NO: 2118 - DNA, 15 bp, Homo sapiens
actctcgttgacgcc

SEQ ID NO: 2119 - DNA, 15 bp, Homo sapiens
tactctcgttgacgc

SEQ ID NO: 2120 - DNA, 15 bp, Homo sapiens
gtactctcgttgacg

SEQ ID NO: 2121 - DNA, 15 bp, Homo sapiens
cgtactctcgttgac

SEQ ID NO: 2122 - DNA, 15 bp, Homo sapiens
ccgtactctcgttga

SEQ ID NO: 2123 - DNA, 15 bp, Homo sapiens
cccgtactctcgttg

SEQ ID NO: 2124 - DNA, 15 bp, Homo sapiens
ccccgtactctcgtt

SEQ ID NO: 2125 - DNA, 15 bp, Homo sapiens
gccccgtactctcgt

SEQ ID NO: 2126 - DNA, 15 bp, Homo sapiens
agccccgtactctcg

SEQ ID NO: 2127 - DNA, 15 bp, Homo sapiens
cagccccgtactctc

SEQ ID NO: 2128 - DNA, 15 bp, Homo sapiens
tcagccccgtactct

SEQ ID NO: 2129 - DNA, 15 bp, Homo sapiens
ctcagccccgtactc

SEQ ID NO: 2130 - DNA, 15 bp, Homo sapiens
gctcagccccgtact

SEQ ID NO: 2131 - DNA, 15 bp, Homo sapiens
ggctcagccccgtac

SEQ ID NO: 2132 - DNA, 15 bp, Homo sapiens
aggctcagccccgta

SEQ ID NO: 2133 - DNA, 15 bp, Homo sapiens
caggctcagccccgt

SEQ ID NO: 2134 - DNA, 15 bp, Homo sapiens
ccaggctcagccccg

SEQ ID NO: 2135 - DNA, 15 bp, Homo sapiens
tccaggctcagcccc

SEQ ID NO: 2136 - DNA, 15 bp, Homo sapiens
ttccaggctcagccc

SEQ ID NO: 2137 - DNA, 15 bp, Homo sapiens
gttccaggctcagcc

SEQ ID NO: 2138 - DNA, 15 bp, Homo sapiens
tgttccaggctcagc

SEQ ID NO: 2139 - DNA, 15 bp, Homo sapiens
ctgttccaggctcag

SEQ ID NO: 2140 - DNA, 15 bp, Homo sapiens
cctgttccaggctca

SEQ ID NO: 2141 - DNA, 15 bp, Homo sapiens
acctgttccaggctc

SEQ ID NO: 2142 - DNA, 15 bp, Homo sapiens
gacctgttccaggct

SEQ ID NO: 2143 - DNA, 15 bp, Homo sapiens
tgacctgttccaggc

SEQ ID NO: 2144 - DNA, 15 bp, Homo sapiens
ttgacctgttccagg

SEQ ID NO: 2145 - DNA, 15 bp, Homo sapiens
cttgacctgttccag

SEQ ID NO: 2146 - DNA, 15 bp, Homo sapiens
tcttgacctgttcca

SEQ ID NO: 2147 - DNA, 15 bp, Homo sapiens
ttcttgacctgttcc

SEQ ID NO: 2148 - DNA, 15 bp, Homo sapiens
cttcttgacctgttc

SEQ ID NO: 2149 - DNA, 15 bp, Homo sapiens
gcttcttgacctgtt

SEQ ID NO: 2150 - DNA, 15 bp, Homo sapiens
agcttcttgacctgt

SEQ ID NO: 2151 - DNA, 15 bp, Homo sapiens
aagcttcttgacctg

SEQ ID NO: 2152 - DNA, 15 bp, Homo sapiens
taagcttcttgacct

SEQ ID NO: 2153 - DNA, 15 bp, Homo sapiens
ttaagcttcttgacc

SEQ ID NO: 2154 - DNA, 15 bp, Homo sapiens
cttaagcttcttgac

SEQ ID NO: 2155 - DNA, 15 bp, Homo sapiens
ccttaagcttcttga

SEQ ID NO: 2156 - DNA, 15 bp, Homo sapiens
tccttaagcttcttg

SEQ ID NO: 2157 - DNA, 15 bp, Homo sapiens
ctccttaagcttctt

SEQ ID NO: 2158 - DNA, 15 bp, Homo sapiens
tctccttaagcttct

SEQ ID NO: 2159 - DNA, 15 bp, Homo sapiens
ctctccttaagcttc

SEQ ID NO: 2160 - DNA, 15 bp, Homo sapiens
tctctccttaagctt

SEQ ID NO: 2161 - DNA, 15 bp, Homo sapiens
atctctccttaagct

SEQ ID NO: 2162 - DNA, 15 bp, Homo sapiens
catctctccttaagc

SEQ ID NO: 2163 - DNA, 15 bp, Homo sapiens
ccatctctccttaag

SEQ ID NO: 2164 - DNA, 15 bp, Homo sapiens
cccatctctccttaa

SEQ ID NO: 2165 - DNA, 15 bp, Homo sapiens
ccccatctctcctta

SEQ ID NO: 2166 - DNA, 15 bp, Homo sapiens
gccccatctctcctt

SEQ ID NO: 2167 - DNA, 15 bp, Homo sapiens
agccccatctctcct

SEQ ID NO: 2168 - DNA, 15 bp, Homo sapiens
gagccccatctctcc

SEQ ID NO: 2169 - DNA, 15 bp, Homo sapiens
ggagccccatctctc

SEQ ID NO: 2170 - DNA, 15 bp, Homo sapiens
tggagccccatctct

SEQ ID NO: 2171 - DNA, 15 bp, Homo sapiens
ttggagccccatctc

SEQ ID NO: 2172 - DNA, 15 bp, Homo sapiens
gttggagccccatct

SEQ ID NO: 2173 - DNA, 15 bp, Homo sapiens
cgttggagccccatc

SEQ ID NO: 2174 - DNA, 15 bp, Homo sapiens
ccgttggagccccat

SEQ ID NO: 2175 - DNA, 15 bp, Homo sapiens
accgttggagcccca

SEQ ID NO: 2176 - DNA, 15 bp, Homo sapiens
taccgttggagcccc

SEQ ID NO: 2177 - DNA, 15 bp, Homo sapiens
ctaccgttggagccc

SEQ ID NO: 2178 - DNA, 15 bp, Homo sapiens
cctaccgttggagcc

SEQ ID NO: 2179 - DNA, 15 bp, Homo sapiens
acctaccgttggagc

SEQ ID NO: 2180 - DNA, 15 bp, Homo sapiens
cacctaccgttggag

SEQ ID NO: 2181 - DNA, 15 bp, Homo sapiens
gcacctaccgttgga

SEQ ID NO: 2182 - DNA, 15 bp, Homo sapiens
tgcacctaccgttgg

SEQ ID NO: 2183 - DNA, 15 bp, Homo sapiens
ctgcacctaccgttg

SEQ ID NO: 2184 - DNA, 15 bp, Homo sapiens
cctgcacctaccgtt

SEQ ID NO: 2185 - DNA, 15 bp, Homo sapiens
ccctgcacctaccgt

SEQ ID NO: 2186 - DNA, 15 bp, Homo sapiens
gccctgcacctaccg

SEQ ID NO: 2187 - DNA, 15 bp, Homo sapiens
cgccctgcacctacc

SEQ ID NO: 2188 - DNA, 15 bp, Homo sapiens
gcgccctgcacctac

SEQ ID NO: 2189 - DNA, 15 bp, Homo sapiens
agcgccctgcaccta

SEQ ID NO: 2190 - DNA, 15 bp, Homo sapiens
gagcgccctgcacct

SEQ ID NO: 2191 - DNA, 15 bp, Homo sapiens
ggagcgccctgcacc

SEQ ID NO: 2192 - DNA, 15 bp, Homo sapiens
cggagcgccctgcac

SEQ ID NO: 2193 - DNA, 15 bp, Homo sapiens
gcggagcgccctgca

SEQ ID NO: 2194 - DNA, 15 bp, Homo sapiens
agcggagcgccctgc

SEQ ID NO: 2195 - DNA, 15 bp, Homo sapiens
cagcggagcgccctg

SEQ ID NO: 2196 - DNA, 15 bp, Homo sapiens
gcagcggagcgccct

SEQ ID NO: 2197 - DNA, 15 bp, Homo sapiens
tgcagcggagcgccc

SEQ ID NO: 2198 - DNA, 15 bp, Homo sapiens
ctgcagcggagcgcc

SEQ ID NO: 2199 - DNA, 15 bp, Homo sapiens
cctgcagcggagcgc

SEQ ID NO: 2200 - DNA, 15 bp, Homo sapiens
ccctgcagcggagcg

SEQ ID NO: 2201 - DNA, 15 bp, Homo sapiens
cccctgcagcggagc

SEQ ID NO: 2202 - DNA, 15 bp, Homo sapiens
gcccctgcagcggag

SEQ ID NO: 2203 - DNA, 15 bp, Homo sapiens
ggcccctgcagcgga

SEQ ID NO: 2204 - DNA, 15 bp, Homo sapiens
gggcccctgcagcgg

SEQ ID NO: 2205 - DNA, 15 bp, Homo sapiens
cgggcccctgcagcg

SEQ ID NO: 2206 - DNA, 15 bp, Homo sapiens
ccgggcccctgcagc

SEQ ID NO: 2207 - DNA, 15 bp, Homo sapiens
gccgggcccctgcag

SEQ ID NO: 2208 - DNA, 15 bp, Homo sapiens
cgccgggcccctgca

SEQ ID NO: 2209 - DNA, 15 bp, Homo sapiens
gcgccgggcccctgc

SEQ ID NO: 2210 - DNA, 15 bp, Homo sapiens
cgcgccgggcccctg

SEQ ID NO: 2211 - DNA, 15 bp, Homo sapiens
ccgcgccgggcccct

SEQ ID NO: 2212 - DNA, 15 bp, Homo sapiens
gccgcgccgggcccc

SEQ ID NO: 2213 - DNA, 15 bp, Homo sapiens
ggccgcgccgggccc

SEQ ID NO: 2214 - DNA, 15 bp, Homo sapiens
cggccgcgccgggcc

SEQ ID NO: 2215 - DNA, 15 bp, Homo sapiens
ccggccgcgccgggc

SEQ ID NO: 2216 - DNA, 15 bp, Homo sapiens
cccggccgcgccggg

SEQ ID NO: 2217 - DNA, 15 bp, Homo sapiens
tcccggccgcgccgg

SEQ ID NO: 2218 - DNA, 15 bp, Homo sapiens
ctcccggccgcgccg

SEQ ID NO: 2219 - DNA, 15 bp, Homo sapiens
tctcccggccgcgcc

SEQ ID NO: 2220 - DNA, 15 bp, Homo sapiens
ctctcccggccgcgc

SEQ ID NO: 2221 - DNA, 15 bp, Homo sapiens
gctctcccggccgcg

SEQ ID NO: 2222 - DNA, 15 bp, Homo sapiens
ggctctcccggccgc

SEQ ID NO: 2223 - DNA, 15 bp, Homo sapiens
tggctctcccggccg

SEQ ID NO: 2224 - DNA, 15 bp, Homo sapiens
ctggctctcccggcc

SEQ ID NO: 2225 - DNA, 15 bp, Homo sapiens
cctggctctcccggc

SEQ ID NO: 2226 - DNA, 15 bp, Homo sapiens
ccctggctctcccgg

SEQ ID NO: 2227 - DNA, 15 bp, Homo sapiens
tccctggctctcccg

SEQ ID NO: 2228 - DNA, 15 bp, Homo sapiens
ttccctggctctccc

SEQ ID NO: 2229 - DNA, 15 bp, Homo sapiens
cttccctggctctcc

SEQ ID NO: 2230 - DNA, 15 bp, Homo sapiens
tcttccctggctctc

SEQ ID NO: 2231 - DNA, 15 bp, Homo sapiens
atcttccctggctct

SEQ ID NO: 2232 - DNA, 15 bp, Homo sapiens
catcttccctggctc

SEQ ID NO: 2233 - DNA, 15 bp, Homo sapiens
ccatcttccctggct

SEQ ID NO: 2234 - DNA, 15 bp, Homo sapiens
gccatcttccctggc

SEQ ID NO: 2235 - DNA, 15 bp, Homo sapiens
agccatcttccctgg

SEQ ID NO: 2236 - DNA, 15 bp, Homo sapiens
cagccatcttccctg

SEQ ID NO: 2237 - DNA, 15 bp, Homo sapiens
tcagccatcttccct

SEQ ID NO: 2238 - DNA, 15 bp, Homo sapiens
gtcagccatcttccc

SEQ ID NO: 2239 - DNA, 15 bp, Homo sapiens
ggtcagccatcttcc

SEQ ID NO: 2240 - DNA, 15 bp, Homo sapiens
cggtcagccatcttc

SEQ ID NO: 2241 - DNA, 15 bp, Homo sapiens
ccggtcagccatctt

SEQ ID NO: 2242 - DNA, 15 bp, Homo sapiens
cccggtcagccatct

SEQ ID NO: 2243 - DNA, 15 bp, Homo sapiens
gcccggtcagccatc

SEQ ID NO: 2244 - DNA, 15 bp, Homo sapiens
agcccggtcagccat

SEQ ID NO: 2245 - DNA, 15 bp, Homo sapiens
gagcccggtcagcca

SEQ ID NO: 2246 - DNA, 15 bp, Homo sapiens
ggagcccggtcagcc

SEQ ID NO: 2247 - DNA, 15 bp, Homo sapiens
tggagcccggtcagc

SEQ ID NO: 2248 - DNA, 15 bp, Homo sapiens
gtggagcccggtcag

SEQ ID NO: 2249 - DNA, 15 bp, Homo sapiens
ggtggagcccggtca

SEQ ID NO: 2250 - DNA, 15 bp, Homo sapiens
aggtggagcccggtc

SEQ ID NO: 2251 - DNA, 15 bp, Homo sapiens
gaggtggagcccggt

SEQ ID NO: 2252 - DNA, 15 bp, Homo sapiens
cgaggtggagcccgg

SEQ ID NO: 2253 - DNA, 15 bp, Homo sapiens
acgaggtggagcccg

SEQ ID NO: 2254 - DNA, 15 bp, Homo sapiens
cacgaggtggagccc

SEQ ID NO: 2255 - DNA, 15 bp, Homo sapiens
ccacgaggtggagcc

SEQ ID NO: 2256 - DNA, 15 bp, Homo sapiens
cccacgaggtggagc

SEQ ID NO: 2257 - DNA, 15 bp, Homo sapiens
gcccacgaggtggag

SEQ ID NO: 2258 - DNA, 15 bp, Homo sapiens
agcccacgaggtgga

SEQ ID NO: 2259 - DNA, 15 bp, Homo sapiens
aagcccacgaggtgg

SEQ ID NO: 2260 - DNA, 15 bp, Homo sapiens
gaagcccacgaggtg

SEQ ID NO: 2261 - DNA, 15 bp, Homo sapiens
cgaagcccacgaggt

SEQ ID NO: 2262 - DNA, 15 bp, Homo sapiens
ccgaagcccacgagg

SEQ ID NO: 2263 - DNA, 15 bp, Homo sapiens
gccgaagcccacgag

SEQ ID NO: 2264 - DNA, 15 bp, Homo sapiens
agccgaagcccacga

SEQ ID NO: 2265 - DNA, 15 bp, Homo sapiens
gagccgaagcccacg

SEQ ID NO: 2266 - DNA, 15 bp, Homo sapiens
ggagccgaagcccac

SEQ ID NO: 2267 - DNA, 15 bp, Homo sapiens
cggagccgaagccca

SEQ ID NO: 2268 - DNA, 15 bp, Homo sapiens
gcggagccgaagccc

SEQ ID NO: 2269 - DNA, 15 bp, Homo sapiens
cgcggagccgaagcc

SEQ ID NO: 2270 - DNA, 15 bp, Homo sapiens
gcgcggagccgaagc

SEQ ID NO: 2271 - DNA, 15 bp, Homo sapiens
ggcgcggagccgaag

SEQ ID NO: 2272 - DNA, 15 bp, Homo sapiens
gggcgcggagccgaa

SEQ ID NO: 2273 - DNA, 15 bp, Homo sapiens
cgggcgcggagccga

SEQ ID NO: 2274 - DNA, 15 bp, Homo sapiens
gcgggcgcggagccg

SEQ ID NO: 2275 - DNA, 15 bp, Homo sapiens
ggcgggcgcggagcc

SEQ ID NO: 2276 - DNA, 15 bp, Homo sapiens
cggcgggcgcggagc

SEQ ID NO: 2277 - DNA, 15 bp, Homo sapiens
tcggcgggcgcggag

SEQ ID NO: 2278 - DNA, 15 bp, Homo sapiens
gtcggcgggcgcgga

SEQ ID NO: 2279 - DNA, 15 bp, Homo sapiens
tgtcggcgggcgcgg

SEQ ID NO: 2280 - DNA, 15 bp, Homo sapiens
ctgtcggcgggcgcg

SEQ ID NO: 2281 - DNA, 15 bp, Homo sapiens
gctgtcggcgggcgc

SEQ ID NO: 2282 - DNA, 15 bp, Homo sapiens
agctgtcggcgggcg

SEQ ID NO: 2283 - DNA, 15 bp, Homo sapiens
cagctgtcggcgggc

SEQ ID NO: 2284 - DNA, 15 bp, Homo sapiens
gcagctgtcggcggg

SEQ ID NO: 2285 - DNA, 15 bp, Homo sapiens
cgcagctgtcggcgg

SEQ ID NO: 2286 - DNA, 15 bp, Homo sapiens
ccgcagctgtcggcg

SEQ ID NO: 2287 - DNA, 15 bp, Homo sapiens
cccgcagctgtcggc

SEQ ID NO: 2288 - DNA, 15 bp, Homo sapiens
gcccgcagctgtcgg

SEQ ID NO: 2289 - DNA, 15 bp, Homo sapiens
cgcccgcagctgtcg

SEQ ID NO: 2290 - DNA, 15 bp, Homo sapiens
ccgcccgcagctgtc

SEQ ID NO: 2291 - DNA, 15 bp, Homo sapiens
tccgcccgcagctgt

SEQ ID NO: 2292 - DNA, 15 bp, Homo sapiens
ctccgcccgcagctg

SEQ ID NO: 2293 - DNA, 15 bp, Homo sapiens
cctccgcccgcagct

SEQ ID NO: 2294 - DNA, 15 bp, Homo sapiens
ccctccgcccgcagc

SEQ ID NO: 2295 - DNA, 15 bp, Homo sapiens
accctccgcccgcag

SEQ ID NO: 2296 - DNA, 15 bp, Homo sapiens
gaccctccgcccgca

SEQ ID NO: 2297 - DNA, 15 bp, Homo sapiens
cgaccctccgcccgc

SEQ ID NO: 2298 - DNA, 15 bp, Homo sapiens
ccgaccctccgcccg

SEQ ID NO: 2299 - DNA, 15 bp, Homo sapiens
cccgaccctccgccc

SEQ ID NO: 2300 - DNA, 15 bp, Homo sapiens
gcccgaccctccgcc

SEQ ID NO: 2301 - DNA, 15 bp, Homo sapiens
ggcccgaccctccgc

SEQ ID NO: 2302 - DNA, 15 bp, Homo sapiens
tggcccgaccctccg

SEQ ID NO: 2303 - DNA, 15 bp, Homo sapiens
ctggcccgaccctcc

SEQ ID NO: 2304 - DNA, 15 bp, Homo sapiens
gctggcccgaccctc

SEQ ID NO: 2305 - DNA, 15 bp, Homo sapiens
cgctggcccgaccct

SEQ ID NO: 2306 - DNA, 15 bp, Homo sapiens
gcgctggcccgaccc

SEQ ID NO: 2307 - DNA, 15 bp, Homo sapiens
cgcgctggcccgacc

SEQ ID NO: 2308 - DNA, 15 bp, Homo sapiens
gcgcgctggcccgac

SEQ ID NO: 2309 - DNA, 15 bp, Homo sapiens
ggcgcgctggcccga

SEQ ID NO: 2310 - DNA, 15 bp, Homo sapiens
cggcgcgctggcccg

SEQ ID NO: 2311 - DNA, 15 bp, Homo sapiens
ccggcgcgctggccc

SEQ ID NO: 2312 - DNA, 15 bp, Homo sapiens
gccggcgcgctggcc

SEQ ID NO: 2313 - DNA, 15 bp, Homo sapiens
ggccggcgcgctggc

SEQ ID NO: 2314 - DNA, 15 bp, Homo sapiens
gggccggcgcgctgg

SEQ ID NO: 2315 - DNA, 15 bp, Homo sapiens
ggggccggcgcgctg

SEQ ID NO: 2316 - DNA, 15 bp, Homo sapiens
cggggccggcgcgct

SEQ ID NO: 2317 - DNA, 15 bp, Homo sapiens
gcggggccggcgcgc

SEQ ID NO: 2318 - DNA, 15 bp, Homo sapiens
cgcggggccggcgcg

SEQ ID NO: 2319 - DNA, 15 bp, Homo sapiens
ccgcggggccggcgc

SEQ ID NO: 2320 - DNA, 15 bp, Homo sapiens
cccgcggggccggcg

SEQ ID NO: 2321 - DNA, 15 bp, Homo sapiens
tcccgcggggccggc

SEQ ID NO: 2322 - DNA, 15 bp, Homo sapiens
ctcccgcggggccgg

SEQ ID NO: 2323 - DNA, 15 bp, Homo sapiens
tctcccgcggggccg

SEQ ID NO: 2324 - DNA, 15 bp, Homo sapiens
ctctcccgcggggcc

SEQ ID NO: 2325 - DNA, 15 bp, Homo sapiens
tctctcccgcggggc

SEQ ID NO: 2326 - DNA, 15 bp, Homo sapiens
ttctctcccgcgggg

SEQ ID NO: 2327 - DNA, 15 bp, Homo sapiens
tttctctcccgcggg

SEQ ID NO: 2328 - DNA, 15 bp, Homo sapiens
ctttctctcccgcgg

SEQ ID NO: 2329 - DNA, 15 bp, Homo sapiens
cctttctctcccgcg

SEQ ID NO: 2330 - DNA, 15 bp, Homo sapiens
ccctttctctcccgc

SEQ ID NO: 2331 - DNA, 15 bp, Homo sapiens
cccctttctctcccg

SEQ ID NO: 2332 - DNA, 15 bp, Homo sapiens
gcccctttctctccc

SEQ ID NO: 2333 - DNA, 15 bp, Homo sapiens
agcccctttctctcc

SEQ ID NO: 2334 - DNA, 15 bp, Homo sapiens
cagcccctttctctc

SEQ ID NO: 2335 - DNA, 15 bp, Homo sapiens
gcagcccctttctct

SEQ ID NO: 2336 - DNA, 15 bp, Homo sapiens
cgcagcccctttctc

SEQ ID NO: 2337 - DNA, 15 bp, Homo sapiens
ccgcagcccctttct

SEQ ID NO: 2338 - DNA, 15 bp, Homo sapiens
accgcagcccctttc

SEQ ID NO: 2339 - DNA, 15 bp, Homo sapiens
gaccgcagccccttt

SEQ ID NO: 2340 - DNA, 15 bp, Homo sapiens
ggaccgcagcccctt

SEQ ID NO: 2341 - DNA, 15 bp, Homo sapiens
aggaccgcagcccct

SEQ ID NO: 2342 - DNA, 15 bp, Homo sapiens
gaggaccgcagcccc

SEQ ID NO: 2343 - DNA, 15 bp, Homo sapiens
cgaggaccgcagccc

SEQ ID NO: 2344 - DNA, 15 bp, Homo sapiens
gcgaggaccgcagcc

SEQ ID NO: 2345 - DNA, 15 bp, Homo sapiens
ggcgaggaccgcagc

SEQ ID NO: 2346 - DNA, 15 bp, Homo sapiens
aggcgaggaccgcag

SEQ ID NO: 2347 - DNA, 15 bp, Homo sapiens
gaggcgaggaccgca

SEQ ID NO: 2348 - DNA, 15 bp, Homo sapiens
cgaggcgaggaccgc

SEQ ID NO: 2349 - DNA, 15 bp, Homo sapiens
gcgaggcgaggaccg

SEQ ID NO: 2350 - DNA, 15 bp, Homo sapiens
ggcgaggcgaggacc

SEQ ID NO: 2351 - DNA, 15 bp, Homo sapiens
aggcgaggcgaggac

SEQ ID NO: 2352 - DNA, 15 bp, Homo sapiens
aaggcgaggcgagga

SEQ ID NO: 2353 - DNA, 15 bp, Homo sapiens
gaaggcgaggcgagg

SEQ ID NO: 2354 - DNA, 15 bp, Homo sapiens
ggaaggcgaggcgag

SEQ ID NO: 2355 - DNA, 15 bp, Homo sapiens
gggaaggcgaggcga

SEQ ID NO: 2356 - DNA, 15 bp, Homo sapiens
agggaaggcgaggcg

SEQ ID NO: 2357 - DNA, 15 bp, Homo sapiens
cagggaaggcgaggc

SEQ ID NO: 2358 - DNA, 15 bp, Homo sapiens
ccagggaaggcgagg

SEQ ID NO: 2359 - DNA, 15 bp, Homo sapiens
tccagggaaggcgag

SEQ ID NO: 2360 - DNA, 15 bp, Homo sapiens
gtccagggaaggcga

SEQ ID NO: 2361 - DNA, 15 bp, Homo sapiens
ggtccagggaaggcg

SEQ ID NO: 2362 - DNA, 15 bp, Homo sapiens
aggtccagggaaggc

SEQ ID NO: 2363 - DNA, 15 bp, Homo sapiens
gaggtccagggaagg

SEQ ID NO: 2364 - DNA, 15 bp, Homo sapiens
agaggtccagggaag

SEQ ID NO: 2365 - DNA, 15 bp, Homo sapiens
aagaggtccagggaa

SEQ ID NO: 2366 - DNA, 15 bp, Homo sapiens
gaagaggtccaggga

SEQ ID NO: 2367 - DNA, 15 bp, Homo sapiens
cgaagaggtccaggg

SEQ ID NO: 2368 - DNA, 15 bp, Homo sapiens
gcgaagaggtccagg

SEQ ID NO: 2369 - DNA, 15 bp, Homo sapiens
agcgaagaggtccag

SEQ ID NO: 2370 - DNA, 15 bp, Homo sapiens
aagcgaagaggtcca

SEQ ID NO: 2371 - DNA, 15 bp, Homo sapiens
gaagcgaagaggtcc

SEQ ID NO: 2372 - DNA, 15 bp, Homo sapiens
agaagcgaagaggtc

SEQ ID NO: 2373 - DNA, 15 bp, Homo sapiens
gagaagcgaagaggt

SEQ ID NO: 2374 - DNA, 15 bp, Homo sapiens
cgagaagcgaagagg

SEQ ID NO: 2375 - DNA, 15 bp, Homo sapiens
ccgagaagcgaagag

SEQ ID NO: 2376 - DNA, 15 bp, Homo sapiens
cccgagaagcgaaga

SEQ ID NO: 2377 - DNA, 15 bp, Homo sapiens
gcccgagaagcgaag

SEQ ID NO: 2378 - DNA, 15 bp, Homo sapiens
ggcccgagaagcgaa

SEQ ID NO: 2379 - DNA, 15 bp, Homo sapiens
gggcccgagaagcga

SEQ ID NO: 2380 - DNA, 15 bp, Homo sapiens
agggcccgagaagcg

SEQ ID NO: 2381 - DNA, 15 bp, Homo sapiens
gagggcccgagaagc

SEQ ID NO: 2382 - DNA, 15 bp, Homo sapiens
cgagggcccgagaag

SEQ ID NO: 2383 - DNA, 15 bp, Homo sapiens
tcgagggcccgagaa

SEQ ID NO: 2384 - DNA, 15 bp, Homo sapiens
gtcgagggcccgaga

SEQ ID NO: 2385 - DNA, 15 bp, Homo sapiens
ggtcgagggcccgag

SEQ ID NO: 2386 - DNA, 15 bp, Homo sapiens
aggtcgagggcccga

SEQ ID NO: 2387 - DNA, 15 bp, Homo sapiens
aaggtcgagggcccg

SEQ ID NO: 2388 - DNA, 15 bp, Homo sapiens
aaaggtcgagggccc

SEQ ID NO: 2389 - DNA, 15 bp, Homo sapiens
aaaaggtcgagggcc

SEQ ID NO: 2390 - DNA, 15 bp, Homo sapiens
gaaaaggtcgagggc

SEQ ID NO: 2391 - DNA, 15 bp, Homo sapiens
cgaaaaggtcgaggg

SEQ ID NO: 2392 - DNA, 15 bp, Homo sapiens
ccgaaaaggtcgagg

SEQ ID NO: 2393 - DNA, 15 bp, Homo sapiens
gccgaaaaggtcgag

SEQ ID NO: 2394 - DNA, 15 bp, Homo sapiens
cgccgaaaaggtcga

SEQ ID NO: 2395 - DNA, 15 bp, Homo sapiens
gcgccgaaaaggtcg

SEQ ID NO: 2396 - DNA, 15 bp, Homo sapiens
cgcgccgaaaaggtc

SEQ ID NO: 2397 - DNA, 15 bp, Homo sapiens
gcgcgccgaaaaggt

SEQ ID NO: 2398 - DNA, 15 bp, Homo sapiens
tgcgcgccgaaaagg

SEQ ID NO: 2399 - DNA, 15 bp, Homo sapiens
ttgcgcgccgaaaag

SEQ ID NO: 2400 - DNA, 15 bp, Homo sapiens
cttgcgcgccgaaaa

SEQ ID NO: 2401 - DNA, 15 bp, Homo sapiens
ccttgcgcgccgaaa

SEQ ID NO: 2402 - DNA, 15 bp, Homo sapiens
gccttgcgcgccgaa

SEQ ID NO: 2403 - DNA, 15 bp, Homo sapiens
agccttgcgcgccga

SEQ ID NO: 2404 - DNA, 15 bp, Homo sapiens
gagccttgcgcgccg

SEQ ID NO: 2405 - DNA, 15 bp, Homo sapiens
cgagccttgcgcgcc

SEQ ID NO: 2406 - DNA, 15 bp, Homo sapiens
ccgagccttgcgcgc

SEQ ID NO: 2407 - DNA, 15 bp, Homo sapiens
tccgagccttgcgcg

SEQ ID NO: 2408 - DNA, 15 bp, Homo sapiens
ctccgagccttgcgc

SEQ ID NO: 2409 - DNA, 15 bp, Homo sapiens
cctccgagccttgcg

SEQ ID NO: 2410 - DNA, 15 bp, Homo sapiens
gcctccgagccttgc

SEQ ID NO: 2411 - DNA, 15 bp, Homo sapiens
agcctccgagccttg

SEQ ID NO: 2412 - DNA, 15 bp, Homo sapiens
aagcctccgagcctt

SEQ ID NO: 2413 - DNA, 15 bp, Homo sapiens
gaagcctccgagcct

SEQ ID NO: 2414 - DNA, 15 bp, Homo sapiens
agaagcctccgagcc

SEQ ID NO: 2415 - DNA, 15 bp, Homo sapiens
gagaagcctccgagc

SEQ ID NO: 2416 - DNA, 15 bp, Homo sapiens
agagaagcctccgag

SEQ ID NO: 2417 - DNA, 15 bp, Homo sapiens
gagagaagcctccga

SEQ ID NO: 2418 - DNA, 15 bp, Homo sapiens
ggagagaagcctccg

SEQ ID NO: 2419 - DNA, 15 bp, Homo sapiens
tggagagaagcctcc

SEQ ID NO: 2420 - DNA, 15 bp, Homo sapiens
ctggagagaagcctc

SEQ ID NO: 2421 - DNA, 15 bp, Homo sapiens
gctggagagaagcct

SEQ ID NO: 2422 - DNA, 15 bp, Homo sapiens
tgctggagagaagcc

SEQ ID NO: 2423 - DNA, 15 bp, Homo sapiens
ctgctggagagaagc

SEQ ID NO: 2424 - DNA, 15 bp, Homo sapiens
gctgctggagagaag

SEQ ID NO: 2425 - DNA, 15 bp, Homo sapiens
tgctgctggagagaa

SEQ ID NO: 2426 - DNA, 15 bp, Homo sapiens
ctgctgctggagaga

SEQ ID NO: 2427 - DNA, 15 bp, Homo sapiens
gctgctgctggagag

SEQ ID NO: 2428 - DNA, 15 bp, Homo sapiens
ggctgctgctggaga

SEQ ID NO: 2429 - DNA, 15 bp, Homo sapiens
cggctgctgctggag

SEQ ID NO: 2430 - DNA, 15 bp, Homo sapiens
ccggctgctgctgga

SEQ ID NO: 2431 - DNA, 15 bp, Homo sapiens
gccggctgctgctgg

SEQ ID NO: 2432 - DNA, 15 bp, Homo sapiens
ggccggctgctgctg

SEQ ID NO: 2433 - DNA, 15 bp, Homo sapiens
gggccggctgctgct

SEQ ID NO: 2434 - DNA, 15 bp, Homo sapiens
ggggccggctgctgc

SEQ ID NO: 2435 - DNA, 15 bp, Homo sapiens
cggggccggctgctg

SEQ ID NO: 2436 - DNA, 15 bp, Homo sapiens
ccggggccggctgct

SEQ ID NO: 2437 - DNA, 15 bp, Homo sapiens
accggggccggctgc

SEQ ID NO: 2438 - DNA, 15 bp, Homo sapiens
caccggggccggctg

SEQ ID NO: 2439 - DNA, 15 bp, Homo sapiens
ccaccggggccggct

SEQ ID NO: 2440 - DNA, 15 bp, Homo sapiens
tccaccggggccggc

SEQ ID NO: 2441 - DNA, 15 bp, Homo sapiens
ctccaccggggccgg

SEQ ID NO: 2442 - DNA, 15 bp, Homo sapiens
cctccaccggggccg

SEQ ID NO: 2443 - DNA, 15 bp, Homo sapiens
ccctccaccggggcc

SEQ ID NO: 2444 - DNA, 15 bp, Homo sapiens
tccctccaccggggc

SEQ ID NO: 2445 - DNA, 15 bp, Homo sapiens
ctccctccaccgggg

SEQ ID NO: 2446 - DNA, 15 bp, Homo sapiens
cctccctccaccggg

SEQ ID NO: 2447 - DNA, 15 bp, Homo sapiens
ccctccctccaccgg

SEQ ID NO: 2448 - DNA, 15 bp, Homo sapiens
tccctccctccaccg

SEQ ID NO: 2449 - DNA, 15 bp, Homo sapiens
gtccctccctccacc

SEQ ID NO: 2450 - DNA, 15 bp, Homo sapiens
cgtccctccctccac

SEQ ID NO: 2451 - DNA, 15 bp, Homo sapiens
acgtccctccctcca

SEQ ID NO: 2452 - DNA, 15 bp, Homo sapiens
cacgtccctccctcc

SEQ ID NO: 2453 - DNA, 15 bp, Homo sapiens
ccacgtccctccctc

SEQ ID NO: 2454 - DNA, 15 bp, Homo sapiens
gccacgtccctccct

SEQ ID NO: 2455 - DNA, 15 bp, Homo sapiens
agccacgtccctccc

SEQ ID NO: 2456 - DNA, 15 bp, Homo sapiens
aagccacgtccctcc

SEQ ID NO: 2457 - DNA, 15 bp, Homo sapiens
gaagccacgtccctc

SEQ ID NO: 2458 - DNA, 15 bp, Homo sapiens
agaagccacgtccct

SEQ ID NO: 2459 - DNA, 15 bp, Homo sapiens
cagaagccacgtccc

SEQ ID NO: 2460 - DNA, 15 bp, Homo sapiens
gcagaagccacgtcc

SEQ ID NO: 2461 - DNA, 15 bp, Homo sapiens
tgcagaagccacgtc

SEQ ID NO: 2462 - DNA, 15 bp, Homo sapiens
ctgcagaagccacgt

SEQ ID NO: 2463 - DNA, 15 bp, Homo sapiens
gctgcagaagccacg

SEQ ID NO: 2464 - DNA, 15 bp, Homo sapiens
agctgcagaagccac

SEQ ID NO: 2465 - DNA, 15 bp, Homo sapiens
tagctgcagaagcca

SEQ ID NO: 2466 - DNA, 15 bp, Homo sapiens
ctagctgcagaagcc

SEQ ID NO: 2467 - DNA, 15 bp, Homo sapiens
cctagctgcagaagc

SEQ ID NO: 2468 - DNA, 15 bp, Homo sapiens
acctagctgcagaag

SEQ ID NO: 2469 - DNA, 15 bp, Homo sapiens
aacctagctgcagaa

SEQ ID NO: 2470 - DNA, 15 bp, Homo sapiens
caacctagctgcaga

SEQ ID NO: 2471 - DNA, 15 bp, Homo sapiens
tcaacctagctgcag

SEQ ID NO: 2472 - DNA, 15 bp, Homo sapiens
ctcaacctagctgca

SEQ ID NO: 2473 - DNA, 15 bp, Homo sapiens
gctcaacctagctgc

SEQ ID NO: 2474 - DNA, 15 bp, Homo sapiens
ggctcaacctagctg

SEQ ID NO: 2475 - DNA, 15 bp, Homo sapiens
gggctcaacctagct

SEQ ID NO: 2476 - DNA, 15 bp, Homo sapiens
cgggctcaacctagc

SEQ ID NO: 2477 - DNA, 15 bp, Homo sapiens
ccgggctcaacctag

SEQ ID NO: 2478 - DNA, 15 bp, Homo sapiens
gccgggctcaaccta

SEQ ID NO: 2479 - DNA, 15 bp, Homo sapiens
tgccgggctcaacct

SEQ ID NO: 2480 - DNA, 15 bp, Homo sapiens
ttgccgggctcaacc

SEQ ID NO: 2481 - DNA, 15 bp, Homo sapiens
cttgccgggctcaac

SEQ ID NO: 2482 - DNA, 15 bp, Homo sapiens
tcttgccgggctcaa

SEQ ID NO: 2483 - DNA, 15 bp, Homo sapiens
gtcttgccgggctca

SEQ ID NO: 2484 - DNA, 15 bp, Homo sapiens
cgtcttgccgggctc

SEQ ID NO: 2485 - DNA, 15 bp, Homo sapiens
acgtcttgccgggct

SEQ ID NO: 2486 - DNA, 15 bp, Homo sapiens
aacgtcttgccgggc

SEQ ID NO: 2487 - DNA, 15 bp, Homo sapiens
aaacgtcttgccggg

SEQ ID NO: 2488 - DNA, 15 bp, Homo sapiens
aaaacgtcttgccgg

SEQ ID NO: 2489 - DNA, 15 bp, Homo sapiens
gaaaacgtcttgccg

SEQ ID NO: 2490 - DNA, 15 bp, Homo sapiens
agaaaacgtcttgcc

SEQ ID NO: 2491 - DNA, 15 bp, Homo sapiens
gagaaaacgtcttgc

SEQ ID NO: 2492 - DNA, 15 bp, Homo sapiens
cgagaaaacgtcttg

SEQ ID NO: 2493 - DNA, 15 bp, Homo sapiens
acgagaaaacgtctt

SEQ ID NO: 2494 - DNA, 15 bp, Homo sapiens
gacgagaaaacgtct

SEQ ID NO: 2495 - DNA, 15 bp, Homo sapiens
ggacgagaaaacgtc

SEQ ID NO: 2496 - DNA, 15 bp, Homo sapiens
gggacgagaaaacgt

SEQ ID NO: 2497 - DNA, 15 bp, Homo sapiens
ggggacgagaaaacg

SEQ ID NO: 2498 - DNA, 15 bp, Homo sapiens
aggggacgagaaaac

SEQ ID NO: 2499 - DNA, 15 bp, Homo sapiens
caggggacgagaaaa

SEQ ID NO: 2500 - DNA, 15 bp, Homo sapiens
gcaggggacgagaaa

SEQ ID NO: 2501 - DNA, 15 bp, Homo sapiens
ggcaggggacgagaa

SEQ ID NO: 2502 - DNA, 15 bp, Homo sapiens
cggcaggggacgaga

SEQ ID NO: 2503 - DNA, 15 bp, Homo sapiens
tcggcaggggacgag

SEQ ID NO: 2504 - DNA, 15 bp, Homo sapiens
atcggcaggggacga

SEQ ID NO: 2505 - DNA, 15 bp, Homo sapiens
aatcggcaggggacg

SEQ ID NO: 2506 - DNA, 15 bp, Homo sapiens
aaatcggcaggggac

SEQ ID NO: 2507 - DNA, 15 bp, Homo sapiens
taaatcggcagggga

SEQ ID NO: 2508 - DNA, 15 bp, Homo sapiens
ataaatcggcagggg

SEQ ID NO: 2509 - DNA, 15 bp, Homo sapiens
cataaatcggcaggg

SEQ ID NO: 2510 - DNA, 15 bp, Homo sapiens
tcataaatcggcagg

SEQ ID NO: 2511 - DNA, 15 bp, Homo sapiens
ctcataaatcggcag

SEQ ID NO: 2512 - DNA, 15 bp, Homo sapiens
cctcataaatcggca

SEQ ID NO: 2513 - DNA, 15 bp, Homo sapiens
tcctcataaatcggc

SEQ ID NO: 2514 - DNA, 15 bp, Homo sapiens
ctcctcataaatcgg

SEQ ID NO: 2515 - DNA, 15 bp, Homo sapiens
actcctcataaatcg

SEQ ID NO: 2516 - DNA, 15 bp, Homo sapiens
gactcctcataaatc

SEQ ID NO: 2517 - DNA, 15 bp, Homo sapiens
cgactcctcataaat

SEQ ID NO: 2518 - DNA, 15 bp, Homo sapiens
tcgactcctcataaa

SEQ ID NO: 2519 - DNA, 15 bp, Homo sapiens
ctcgactcctcataa

SEQ ID NO: 2520 - DNA, 15 bp, Homo sapiens
cctcgactcctcata

SEQ ID NO: 2521 - DNA, 15 bp, Homo sapiens
acctcgactcctcat

SEQ ID NO: 2522 - DNA, 15 bp, Homo sapiens
gacctcgactcctca

SEQ ID NO: 2523 - DNA, 15 bp, Homo sapiens
cgacctcgactcctc

SEQ ID NO: 2524 - DNA, 15 bp, Homo sapiens
acgacctcgactcct

SEQ ID NO: 2525 - DNA, 15 bp, Homo sapiens
aacgacctcgactcc

SEQ ID NO: 2526 - DNA, 15 bp, Homo sapiens
caacgacctcgactc

SEQ ID NO: 2527 - DNA, 15 bp, Homo sapiens
ccaacgacctcgact

SEQ ID NO: 2528 - DNA, 15 bp, Homo sapiens
tccaacgacctcgac

SEQ ID NO: 2529 - DNA, 15 bp, Homo sapiens
ttccaacgacctcga

SEQ ID NO: 2530 - DNA, 15 bp, Homo sapiens
cttccaacgacctcg

SEQ ID NO: 2531 - DNA, 15 bp, Homo sapiens
ccttccaacgacctc

SEQ ID NO: 2532 - DNA, 15 bp, Homo sapiens
gccttccaacgacct

SEQ ID NO: 2533 - DNA, 15 bp, Homo sapiens
ggccttccaacgacc

SEQ ID NO: 2534 - DNA, 15 bp, Homo sapiens
aggccttccaacgac

SEQ ID NO: 2535 - DNA, 15 bp, Homo sapiens
gaggccttccaacga

SEQ ID NO: 2536 - DNA, 15 bp, Homo sapiens
agaggccttccaacg

SEQ ID NO: 2537 - DNA, 15 bp, Homo sapiens
cagaggccttccaac

SEQ ID NO: 2538 - DNA, 15 bp, Homo sapiens
tcagaggccttccaa

SEQ ID NO: 2539 - DNA, 15 bp, Homo sapiens
gtcagaggccttcca

SEQ ID NO: 2540 - DNA, 15 bp, Homo sapiens
ggtcagaggccttcc

SEQ ID NO: 2541 - DNA, 15 bp, Homo sapiens
cggtcagaggccttc

SEQ ID NO: 2542 - DNA, 15 bp, Homo sapiens
acggtcagaggcctt

SEQ ID NO: 2543 - DNA, 15 bp, Homo sapiens
aacggtcagaggcct

SEQ ID NO: 2544 - DNA, 15 bp, Homo sapiens
gaacggtcagaggcc

SEQ ID NO: 2545 - DNA, 15 bp, Homo sapiens
agaacggtcagaggc

SEQ ID NO: 2546 - DNA, 15 bp, Homo sapiens
aagaacggtcagagg

SEQ ID NO: 2547 - DNA, 15 bp, Homo sapiens
caagaacggtcagag

SEQ ID NO: 2548 - DNA, 15 bp, Homo sapiens
acaagaacggtcaga

SEQ ID NO: 2549 - DNA, 15 bp, Homo sapiens
gacaagaacggtcag

SEQ ID NO: 2550 - DNA, 15 bp, Homo sapiens
ggacaagaacggtca

SEQ ID NO: 2551 - DNA, 15 bp, Homo sapiens
aggacaagaacggtc

SEQ ID NO: 2552 - DNA, 15 bp, Homo sapiens
taggacaagaacggt

SEQ ID NO: 2553 - DNA, 15 bp, Homo sapiens
gtaggacaagaacgg

SEQ ID NO: 2554 - DNA, 15 bp, Homo sapiens
ggtaggacaagaacg

SEQ ID NO: 2555 - DNA, 15 bp, Homo sapiens
gggtaggacaagaac

SEQ ID NO: 2556 - DNA, 15 bp, Homo sapiens
tgggtaggacaagaa

SEQ ID NO: 2557 - DNA, 15 bp, Homo sapiens
ttgggtaggacaaga

SEQ ID NO: 2558 - DNA, 15 bp, Homo sapiens
tttgggtaggacaag

SEQ ID NO: 2559 - DNA, 15 bp, Homo sapiens
ctttgggtaggacaa

SEQ ID NO: 2560 - DNA, 15 bp, Homo sapiens
actttgggtaggaca

SEQ ID NO: 2561 - DNA, 15 bp, Homo sapiens
aactttgggtaggac

SEQ ID NO: 2562 - DNA, 15 bp, Homo sapiens
taactttgggtagga

SEQ ID NO: 2563 - DNA, 15 bp, Homo sapiens
gtaactttgggtagg

SEQ ID NO: 2564 - DNA, 15 bp, Homo sapiens
tgtaactttgggtag

SEQ ID NO: 2565 - DNA, 15 bp, Homo sapiens
gtgtaactttgggta

SEQ ID NO: 2566 - DNA, 15 bp, Homo sapiens
tgtgtaactttgggt

SEQ ID NO: 2567 - DNA, 15 bp, Homo sapiens
atgtgtaactttggg

SEQ ID NO: 2568 - DNA, 15 bp, Homo sapiens
gatgtgtaactttgg

SEQ ID NO: 2569 - DNA, 15 bp, Homo sapiens
agatgtgtaactttg

SEQ ID NO: 2570 - DNA, 15 bp, Homo sapiens
cagatgtgtaacttt

SEQ ID NO: 2571 - DNA, 15 bp, Homo sapiens
ccagatgtgtaactt

SEQ ID NO: 2572 - DNA, 15 bp, Homo sapiens
gccagatgtgtaact

SEQ ID NO: 2573 - DNA, 15 bp, Homo sapiens
tgccagatgtgtaac

SEQ ID NO: 2574 - DNA, 15 bp, Homo sapiens
ctgccagatgtgtaa

SEQ ID NO: 2575 - DNA, 15 bp, Homo sapiens
tctgccagatgtgta

SEQ ID NO: 2576 - DNA, 15 bp, Homo sapiens
ttctgccagatgtgt

SEQ ID NO: 2577 - DNA, 15 bp, Homo sapiens
cttctgccagatgtg

SEQ ID NO: 2578 - DNA, 15 bp, Homo sapiens
acttctgccagatgt

SEQ ID NO: 2579 - DNA, 15 bp, Homo sapiens
cacttctgccagatg

SEQ ID NO: 2580 - DNA, 15 bp, Homo sapiens
tcacttctgccagat

SEQ ID NO: 2581 - DNA, 15 bp, Homo sapiens
atcacttctgccaga

SEQ ID NO: 2582 - DNA, 15 bp, Homo sapiens
catcacttctgccag

SEQ ID NO: 2583 - DNA, 15 bp, Homo sapiens
tcatcacttctgcca

SEQ ID NO: 2584 - DNA, 15 bp, Homo sapiens
gtcatcacttctgcc

SEQ ID NO: 2585 - DNA, 15 bp, Homo sapiens
tgtcatcacttctgc

SEQ ID NO: 2586 - DNA, 15 bp, Homo sapiens
atgtcatcacttctg

SEQ ID NO: 2587 - DNA, 15 bp, Homo sapiens
gatgtcatcacttct

SEQ ID NO: 2588 - DNA, 15 bp, Homo sapiens
cgatgtcatcacttc

SEQ ID NO: 2589 - DNA, 15 bp, Homo sapiens
gcgatgtcatcactt

SEQ ID NO: 2590 - DNA, 15 bp, Homo sapiens
agcgatgtcatcact

SEQ ID NO: 2591 - DNA, 15 bp, Homo sapiens
cagcgatgtcatcac

SEQ ID NO: 2592 - DNA, 15 bp, Homo sapiens
tcagcgatgtcatca

SEQ ID NO: 2593 - DNA, 15 bp, Homo sapiens
ttcagcgatgtcatc

SEQ ID NO: 2594 - DNA, 15 bp, Homo sapiens
tttcagcgatgtcat

SEQ ID NO: 2595 - DNA, 15 bp, Homo sapiens
gtttcagcgatgtca

SEQ ID NO: 2596 - DNA, 15 bp, Homo sapiens
ggtttcagcgatgtc

SEQ ID NO: 2597 - DNA, 15 bp, Homo sapiens
tggtttcagcgatgt

SEQ ID NO: 2598 - DNA, 15 bp, Homo sapiens
gtggtttcagcgatg

SEQ ID NO: 2599 - DNA, 15 bp, Homo sapiens
agtggtttcagcgat

SEQ ID NO: 2600 - DNA, 15 bp, Homo sapiens
gagtggtttcagcga

SEQ ID NO: 2601 - DNA, 15 bp, Homo sapiens
ggagtggtttcagcg

SEQ ID NO: 2602 - DNA, 15 bp, Homo sapiens
aggagtggtttcagc

SEQ ID NO: 2603 - DNA, 15 bp, Homo sapiens
taggagtggtttcag

SEQ ID NO: 2604 - DNA, 15 bp, Homo sapiens
ctaggagtggtttca

SEQ ID NO: 2605 - DNA, 15 bp, Homo sapiens
cctaggagtggtttc

SEQ ID NO: 2606 - DNA, 15 bp, Homo sapiens
acctaggagtggttt

SEQ ID NO: 2607 - DNA, 15 bp, Homo sapiens
aacctaggagtggtt

SEQ ID NO: 2608 - DNA, 15 bp, Homo sapiens
gaacctaggagtggt

SEQ ID NO: 2609 - DNA, 15 bp, Homo sapiens
tgaacctaggagtgg

SEQ ID NO: 2610 - DNA, 15 bp, Homo sapiens
ctgaacctaggagtg

SEQ ID NO: 2611 - DNA, 15 bp, Homo sapiens
cctgaacctaggagt

SEQ ID NO: 2612 - DNA, 15 bp, Homo sapiens
tcctgaacctaggag

SEQ ID NO: 2613 - DNA, 15 bp, Homo sapiens
ctcctgaacctagga

SEQ ID NO: 2614 - DNA, 15 bp, Homo sapiens
gctcctgaacctagg

SEQ ID NO: 2615 - DNA, 15 bp, Homo sapiens
ggctcctgaacctag

SEQ ID NO: 2616 - DNA, 15 bp, Homo sapiens
gggctcctgaaccta

SEQ ID NO: 2617 - DNA, 15 bp, Homo sapiens
cgggctcctgaacct

SEQ ID NO: 2618 - DNA, 15 bp, Homo sapiens
tcgggctcctgaacc

SEQ ID NO: 2619 - DNA, 15 bp, Homo sapiens
ttcgggctcctgaac

SEQ ID NO: 2620 - DNA, 15 bp, Homo sapiens
cttcgggctcctgaa

SEQ ID NO: 2621 - DNA, 15 bp, Homo sapiens
acttcgggctcctga

SEQ ID NO: 2622 - DNA, 15 bp, Homo sapiens
cacttcgggctcctg

SEQ ID NO: 2623 - DNA, 15 bp, Homo sapiens
tcacttcgggctcct

SEQ ID NO: 2624 - DNA, 15 bp, Homo sapiens
atcacttcgggctcc

SEQ ID NO: 2625 - DNA, 15 bp, Homo sapiens
aatcacttcgggctc

SEQ ID NO: 2626 - DNA, 15 bp, Homo sapiens
aaatcacttcgggct

SEQ ID NO: 2627 - DNA, 15 bp, Homo sapiens
gaaatcacttcgggc

SEQ ID NO: 2628 - DNA, 15 bp, Homo sapiens
tgaaatcacttcggg

SEQ ID NO: 2629 - DNA, 15 bp, Homo sapiens
gtgaaatcacttcgg

SEQ ID NO: 2630 - DNA, 15 bp, Homo sapiens
cgtgaaatcacttcg

SEQ ID NO: 2631 - DNA, 15 bp, Homo sapiens
gcgtgaaatcacttc

SEQ ID NO: 2632 - DNA, 15 bp, Homo sapiens
agcgtgaaatcactt

SEQ ID NO: 2633 - DNA, 15 bp, Homo sapiens
aagcgtgaaatcact

SEQ ID NO: 2634 - DNA, 15 bp, Homo sapiens
taagcgtgaaatcac

SEQ ID NO: 2635 - DNA, 15 bp, Homo sapiens
ctaagcgtgaaatca

SEQ ID NO: 2636 - DNA, 15 bp, Homo sapiens
cctaagcgtgaaatc

SEQ ID NO: 2637 - DNA, 15 bp, Homo sapiens
ccctaagcgtgaaat

SEQ ID NO: 2638 - DNA, 15 bp, Homo sapiens
gccctaagcgtgaaa

SEQ ID NO: 2639 - DNA, 15 bp, Homo sapiens
agccctaagcgtgaa

SEQ ID NO: 2640 - DNA, 15 bp, Homo sapiens
tagccctaagcgtga

SEQ ID NO: 2641 - DNA, 15 bp, Homo sapiens
ctagccctaagcgtg

SEQ ID NO: 2642 - DNA, 15 bp, Homo sapiens
tctagccctaagcgt

SEQ ID NO: 2643 - DNA, 15 bp, Homo sapiens
gtctagccctaagcg

SEQ ID NO: 2644 - DNA, 15 bp, Homo sapiens
ggtctagccctaagc

SEQ ID NO: 2645 - DNA, 15 bp, Homo sapiens
aggtctagccctaag

SEQ ID NO: 2646 - DNA, 15 bp, Homo sapiens
gaggtctagccctaa

SEQ ID NO: 2647 - DNA, 15 bp, Homo sapiens
tgaggtctagcccta

SEQ ID NO: 2648 - DNA, 15 bp, Homo sapiens
ctgaggtctagccct

SEQ ID NO: 2649 - DNA, 15 bp, Homo sapiens
cctgaggtctagccc

SEQ ID NO: 2650 - DNA, 15 bp, Homo sapiens
gcctgaggtctagcc

SEQ ID NO: 2651 - DNA, 15 bp, Homo sapiens
ggcctgaggtctagc

SEQ ID NO: 2652 - DNA, 15 bp, Homo sapiens
tggcctgaggtctag

SEQ ID NO: 2653 - DNA, 15 bp, Homo sapiens
atggcctgaggtcta

SEQ ID NO: 2654 - DNA, 15 bp, Homo sapiens
aatggcctgaggtct

SEQ ID NO: 2655 - DNA, 15 bp, Homo sapiens
caatggcctgaggtc

SEQ ID NO: 2656 - DNA, 15 bp, Homo sapiens
tcaatggcctgaggt

SEQ ID NO: 2657 - DNA, 15 bp, Homo sapiens
atcaatggcctgagg

SEQ ID NO: 2658 - DNA, 15 bp, Homo sapiens
aatcaatggcctgag

SEQ ID NO: 2659 - DNA, 15 bp, Homo sapiens
taatcaatggcctga

SEQ ID NO: 2660 - DNA, 15 bp, Homo sapiens
gtaatcaatggcctg

SEQ ID NO: 2661 - DNA, 15 bp, Homo sapiens
tgtaatcaatggcct

SEQ ID NO: 2662 - DNA, 15 bp, Homo sapiens
ttgtaatcaatggcc

SEQ ID NO: 2663 - DNA, 15 bp, Homo sapiens
tttgtaatcaatggc

SEQ ID NO: 2664 - DNA, 15 bp, Homo sapiens
ctttgtaatcaatgg

SEQ ID NO: 2665 - DNA, 15 bp, Homo sapiens
tctttgtaatcaatg

SEQ ID NO: 2666 - DNA, 15 bp, Homo sapiens
ctctttgtaatcaat

SEQ ID NO: 2667 - DNA, 15 bp, Homo sapiens
actctttgtaatcaa

SEQ ID NO: 2668 - DNA, 15 bp, Homo sapiens
cactctttgtaatca

SEQ ID NO: 2669 - DNA, 15 bp, Homo sapiens
gcactctttgtaatc

SEQ ID NO: 2670 - DNA, 15 bp, Homo sapiens
tgcactctttgtaat

SEQ ID NO: 2671 - DNA, 15 bp, Homo sapiens
atgcactctttgtaa

SEQ ID NO: 2672 - DNA, 15 bp, Homo sapiens
catgcactctttgta

SEQ ID NO: 2673 - DNA, 15 bp, Homo sapiens
gcatgcactctttgt

SEQ ID NO: 2674 - DNA, 15 bp, Homo sapiens
agcatgcactctttg

SEQ ID NO: 2675 - DNA, 15 bp, Homo sapiens
aagcatgcactcttt

SEQ ID NO: 2676 - DNA, 15 bp, Homo sapiens
gaagcatgcactctt

SEQ ID NO: 2677 - DNA, 15 bp, Homo sapiens
ggaagcatgcactct

SEQ ID NO: 2678 - DNA, 15 bp, Homo sapiens
aggaagcatgcactc

SEQ ID NO: 2679 - DNA, 15 bp, Homo sapiens
aaggaagcatgcact

SEQ ID NO: 2680 - DNA, 15 bp, Homo sapiens
caaggaagcatgcac

SEQ ID NO: 2681 - DNA, 15 bp, Homo sapiens
tcaaggaagcatgca

SEQ ID NO: 2682 - DNA, 15 bp, Homo sapiens
ctcaaggaagcatgc

SEQ ID NO: 2683 - DNA, 15 bp, Homo sapiens
tctcaaggaagcatg

SEQ ID NO: 2684 - DNA, 15 bp, Homo sapiens
atctcaaggaagcat

SEQ ID NO: 2685 - DNA, 15 bp, Homo sapiens
tatctcaaggaagca

SEQ ID NO: 2686 - DNA, 15 bp, Homo sapiens
atatctcaaggaagc

SEQ ID NO: 2687 - DNA, 15 bp, Homo sapiens
gatatctcaaggaag

SEQ ID NO: 2688 - DNA, 15 bp, Homo sapiens
agatatctcaaggaa

SEQ ID NO: 2689 - DNA, 15 bp, Homo sapiens
aagatatctcaagga

SEQ ID NO: 2690 - DNA, 15 bp, Homo sapiens
gaagatatctcaagg

SEQ ID NO: 2691 - DNA, 15 bp, Homo sapiens
cgaagatatctcaag

SEQ ID NO: 2692 - DNA, 15 bp, Homo sapiens
acgaagatatctcaa

SEQ ID NO: 2693 - DNA, 15 bp, Homo sapiens
cacgaagatatctca

SEQ ID NO: 2694 - DNA, 15 bp, Homo sapiens
ccacgaagatatctc

SEQ ID NO: 2695 - DNA, 15 bp, Homo sapiens
accacgaagatatct

SEQ ID NO: 2696 - DNA, 15 bp, Homo sapiens
taccacgaagatatc

SEQ ID NO: 2697 - DNA, 15 bp, Homo sapiens
ataccacgaagatat

SEQ ID NO: 2698 - DNA, 15 bp, Homo sapiens
cataccacgaagata

SEQ ID NO: 2699 - DNA, 15 bp, Homo sapiens
gcataccacgaagat

SEQ ID NO: 2700 - DNA, 15 bp, Homo sapiens
ggcataccacgaaga

SEQ ID NO: 2701 - DNA, 15 bp, Homo sapiens
gggcataccacgaag

SEQ ID NO: 2702 - DNA, 15 bp, Homo sapiens
agggcataccacgaa

SEQ ID NO: 2703 - DNA, 15 bp, Homo sapiens
gagggcataccacga

SEQ ID NO: 2704 - DNA, 15 bp, Homo sapiens
agagggcataccacg

SEQ ID NO: 2705 - DNA, 15 bp, Homo sapiens
cagagggcataccac

SEQ ID NO: 2706 - DNA, 15 bp, Homo sapiens
gcagagggcatacca

SEQ ID NO: 2707 - DNA, 15 bp, Homo sapiens
agcagagggcatacc

SEQ ID NO: 2708 - DNA, 15 bp, Homo sapiens
tagcagagggcatac

SEQ ID NO: 2709 - DNA, 15 bp, Homo sapiens
ttagcagagggcata

SEQ ID NO: 2710 - DNA, 15 bp, Homo sapiens
tttagcagagggcat

SEQ ID NO: 2711 - DNA, 15 bp, Homo sapiens
ttttagcagagggca

SEQ ID NO: 2712 - DNA, 15 bp, Homo sapiens
tttttagcagagggc

SEQ ID NO: 2713 - DNA, 15 bp, Homo sapiens
ttttttagcagaggg

SEQ ID NO: 2714 - DNA, 15 bp, Homo sapiens
tttttttagcagagg

SEQ ID NO: 2715 - DNA, 15 bp, Homo sapiens
atttttttagcagag

SEQ ID NO: 2716 - DNA, 15 bp, Homo sapiens
gatttttttagcaga

SEQ ID NO: 2717 - DNA, 15 bp, Homo sapiens
cgatttttttagcag

SEQ ID NO: 2718 - DNA, 15 bp, Homo sapiens
ccgatttttttagca

SEQ ID NO: 2719 - DNA, 15 bp, Homo sapiens
tccgatttttttagc

SEQ ID NO: 2720 - DNA, 15 bp, Homo sapiens
atccgatttttttag

SEQ ID NO: 2721 - DNA, 15 bp, Homo sapiens
tatccgattttttta

SEQ ID NO: 2722 - DNA, 15 bp, Homo sapiens
atatccgattttttt

SEQ ID NO: 2723 - DNA, 15 bp, Homo sapiens
aatatccgatttttt

SEQ ID NO: 2724 - DNA, 15 bp, Homo sapiens
gaatatccgattttt

SEQ ID NO: 2725 - DNA, 15 bp, Homo sapiens
agaatatccgatttt

SEQ ID NO: 2726 - DNA, 15 bp, Homo sapiens
aagaatatccgattt

SEQ ID NO: 2727 - DNA, 15 bp, Homo sapiens
taagaatatccgatt

SEQ ID NO: 2728 - DNA, 15 bp, Homo sapiens
ataagaatatccgat

SEQ ID NO: 2729 - DNA, 15 bp, Homo sapiens
tataagaatatccga

SEQ ID NO: 2730 - DNA, 15 bp, Homo sapiens
ctataagaatatccg

SEQ ID NO: 2731 - DNA, 15 bp, Homo sapiens
gctataagaatatcc

SEQ ID NO: 2732 - DNA, 15 bp, Homo sapiens
agctataagaatatc

SEQ ID NO: 2733 - DNA, 15 bp, Homo sapiens
tagctataagaatat

SEQ ID NO: 2734 - DNA, 15 bp, Homo sapiens
ctagctataagaata

SEQ ID NO: 2735 - DNA, 15 bp, Homo sapiens
cctagctataagaat

SEQ ID NO: 2736 - DNA, 15 bp, Homo sapiens
acctagctataagaa

SEQ ID NO: 2737 - DNA, 15 bp, Homo sapiens
gacctagctataaga

SEQ ID NO: 2738 - DNA, 15 bp, Homo sapiens
agacctagctataag

SEQ ID NO: 2739 - DNA, 15 bp, Homo sapiens
cagacctagctataa

SEQ ID NO: 2740 - DNA, 15 bp, Homo sapiens
acagacctagctata

SEQ ID NO: 2741 - DNA, 15 bp, Homo sapiens
cacagacctagctat

SEQ ID NO: 2742 - DNA, 15 bp, Homo sapiens
acacagacctagcta

SEQ ID NO: 2743 - DNA, 15 bp, Homo sapiens
aacacagacctagct

SEQ ID NO: 2744 - DNA, 15 bp, Homo sapiens
aaacacagacctagc

SEQ ID NO: 2745 - DNA, 15 bp, Homo sapiens
aaaacacagacctag

SEQ ID NO: 2746 - DNA, 15 bp, Homo sapiens
taaaacacagaccta

SEQ ID NO: 2747 - DNA, 15 bp, Homo sapiens
ttaaaacacagacct

SEQ ID NO: 2748 - DNA, 15 bp, Homo sapiens
tttaaaacacagacc

SEQ ID NO: 2749 - DNA, 15 bp, Homo sapiens
ctttaaaacacagac

SEQ ID NO: 2750 - DNA, 15 bp, Homo sapiens
tctttaaaacacaga

SEQ ID NO: 2751 - DNA, 15 bp, Homo sapiens
atctttaaaacacag

SEQ ID NO: 2752 - DNA, 15 bp, Homo sapiens
tatctttaaaacaca

SEQ ID NO: 2753 - DNA, 15 bp, Homo sapiens
atatctttaaaacac

SEQ ID NO: 2754 - DNA, 15 bp, Homo sapiens
aatatctttaaaaca

SEQ ID NO: 2755 - DNA, 15 bp, Homo sapiens
caatatctttaaaac

SEQ ID NO: 2756 - DNA, 15 bp, Homo sapiens
tcaatatctttaaaa

SEQ ID NO: 2757 - DNA, 15 bp, Homo sapiens
atcaatatctttaaa

SEQ ID NO: 2758 - DNA, 15 bp, Homo sapiens
catcaatatctttaa

SEQ ID NO: 2759 - DNA, 15 bp, Homo sapiens
gcatcaatatcttta

SEQ ID NO: 2760 - DNA, 15 bp, Homo sapiens
agcatcaatatcttt

SEQ ID NO: 2761 - DNA, 15 bp, Homo sapiens
aagcatcaatatctt

SEQ ID NO: 2762 - DNA, 15 bp, Homo sapiens
taagcatcaatatct

SEQ ID NO: 2763 - DNA, 15 bp, Homo sapiens
ctaagcatcaatatc

SEQ ID NO: 2764 - DNA, 15 bp, Homo sapiens
tctaagcatcaatat

SEQ ID NO: 2765 - DNA, 15 bp, Homo sapiens
ttctaagcatcaata

SEQ ID NO: 2766 - DNA, 15 bp, Homo sapiens
attctaagcatcaat

SEQ ID NO: 2767 - DNA, 15 bp, Homo sapiens
aattctaagcatcaa

SEQ ID NO: 2768 - DNA, 15 bp, Homo sapiens
caattctaagcatca

SEQ ID NO: 2769 - DNA, 15 bp, Homo sapiens
acaattctaagcatc

SEQ ID NO: 2770 - DNA, 15 bp, Homo sapiens
tacaattctaagcat

SEQ ID NO: 2771 - DNA, 15 bp, Homo sapiens
ctacaattctaagca

SEQ ID NO: 2772 - DNA, 15 bp, Homo sapiens
gctacaattctaagc

SEQ ID NO: 2773 - DNA, 15 bp, Homo sapiens
tgctacaattctaag

SEQ ID NO: 2774 - DNA, 15 bp, Homo sapiens
ctgctacaattctaa

SEQ ID NO: 2775 - DNA, 15 bp, Homo sapiens
actgctacaattcta

SEQ ID NO: 2776 - DNA, 15 bp, Homo sapiens
aactgctacaattct

SEQ ID NO: 2777 - DNA, 15 bp, Homo sapiens
gaactgctacaattc

SEQ ID NO: 2778 - DNA, 15 bp, Homo sapiens
agaactgctacaatt

SEQ ID NO: 2779 - DNA, 15 bp, Homo sapiens
aagaactgctacaat

SEQ ID NO: 2780 - DNA, 15 bp, Homo sapiens
aaagaactgctacaa

SEQ ID NO: 2781 - DNA, 15 bp, Homo sapiens
aaaagaactgctaca

SEQ ID NO: 2782 - DNA, 15 bp, Homo sapiens
aaaaagaactgctac

SEQ ID NO: 2783 - DNA, 15 bp, Homo sapiens
taaaaagaactgcta

SEQ ID NO: 2784 - DNA, 15 bp, Homo sapiens
ctaaaaagaactgct

SEQ ID NO: 2785 - DNA, 15 bp, Homo sapiens
tctaaaaagaactgc

SEQ ID NO: 2786 - DNA, 15 bp, Homo sapiens
ttctaaaaagaactg

SEQ ID NO: 2787 - DNA, 15 bp, Homo sapiens
tttctaaaaagaact

SEQ ID NO: 2788 - DNA, 15 bp, Homo sapiens
ttttctaaaaagaac

SEQ ID NO: 2789 - DNA, 15 bp, Homo sapiens
tttttctaaaaagaa

SEQ ID NO: 2790 - DNA, 15 bp, Homo sapiens
gtttttctaaaaaga

SEQ ID NO: 2791 - DNA, 15 bp, Homo sapiens
cgtttttctaaaaag

SEQ ID NO: 2792 - DNA, 15 bp, Homo sapiens
tcgtttttctaaaaa

SEQ ID NO: 2793 - DNA, 15 bp, Homo sapiens
ttcgtttttctaaaa

SEQ ID NO: 2794 - DNA, 15 bp, Homo sapiens
cttcgtttttctaaa

SEQ ID NO: 2795 - DNA, 15 bp, Homo sapiens
acttcgtttttctaa

SEQ ID NO: 2796 - DNA, 15 bp, Homo sapiens
cacttcgtttttcta

SEQ ID NO: 2797 - DNA, 15 bp, Homo sapiens
gcacttcgtttttct

SEQ ID NO: 2798 - DNA, 15 bp, Homo sapiens
agcacttcgtttttc

SEQ ID NO: 2799 - DNA, 15 bp, Homo sapiens
tagcacttcgttttt

SEQ ID NO: 2800 - DNA, 15 bp, Homo sapiens
ttagcacttcgtttt

SEQ ID NO: 2801 - DNA, 15 bp, Homo sapiens
tttagcacttcgttt

SEQ ID NO: 2802 - DNA, 15 bp, Homo sapiens
ttttagcacttcgtt

SEQ ID NO: 2803 - DNA, 15 bp, Homo sapiens
attttagcacttcgt

SEQ ID NO: 2804 - DNA, 15 bp, Homo sapiens
cattttagcacttcg

SEQ ID NO: 2805 - DNA, 15 bp, Homo sapiens
acattttagcacttc

SEQ ID NO: 2806 - DNA, 15 bp, Homo sapiens
gacattttagcactt

SEQ ID NO: 2807 - DNA, 15 bp, Homo sapiens
agacattttagcact

SEQ ID NO: 2808 - DNA, 15 bp, Homo sapiens
gagacattttagcac

SEQ ID NO: 2809 - DNA, 15 bp, Homo sapiens
agagacattttagca

SEQ ID NO: 2810 - DNA, 15 bp, Homo sapiens
gagagacattttagc

SEQ ID NO: 2811 - DNA, 15 bp, Homo sapiens
agagagacattttag

SEQ ID NO: 2812 - DNA, 15 bp, Homo sapiens
gagagagacatttta

SEQ ID NO: 2813 - DNA, 15 bp, Homo sapiens
agagagagacatttt

SEQ ID NO: 2814 - DNA, 15 bp, Homo sapiens
aagagagagacattt

SEQ ID NO: 2815 - DNA, 15 bp, Homo sapiens
aaagagagagacatt

SEQ ID NO: 2816 - DNA, 15 bp, Homo sapiens
aaaagagagagacat

SEQ ID NO: 2817 - DNA, 15 bp, Homo sapiens
aaaaagagagagaca

SEQ ID NO: 2818 - DNA, 15 bp, Homo sapiens
aaaaaagagagagac

SEQ ID NO: 2819 - DNA, 15 bp, Homo sapiens
aaaaaaagagagaga

SEQ ID NO: 2820 - DNA, 15 bp, Homo sapiens
aaaaaaaagagagag

SEQ ID NO: 2821 - DNA, 15 bp, Homo sapiens
aaaaaaaaagagaga

SEQ ID NO: 2822 - DNA, 15 bp, Homo sapiens
aaaaaaaaaagagag

SEQ ID NO: 2823 - DNA, 15 bp, Homo sapiens
aaaaaaaaaaagaga

SEQ ID NO: 2824 - DNA, 15 bp, Homo sapiens
taaaaaaaaaaagag

SEQ ID NO: 2825 - DNA, 15 bp, Homo sapiens
ttaaaaaaaaaaaga

SEQ ID NO: 2826 - DNA, 15 bp, Homo sapiens
gttaaaaaaaaaaag

SEQ ID NO: 2827 - DNA, 15 bp, Homo sapiens
ggttaaaaaaaaaaa

SEQ ID NO: 2828 - DNA, 15 bp, Homo sapiens
aggttaaaaaaaaaa

SEQ ID NO: 2829 - DNA, 15 bp, Homo sapiens
gaggttaaaaaaaaa

SEQ ID NO: 2830 - DNA, 15 bp, Homo sapiens
ggaggttaaaaaaaa

SEQ ID NO: 2831 - DNA, 15 bp, Homo sapiens
gggaggttaaaaaaa

SEQ ID NO: 2832 - DNA, 15 bp, Homo sapiens
agggaggttaaaaaa

SEQ ID NO: 2833 - DNA, 15 bp, Homo sapiens
gagggaggttaaaaa

SEQ ID NO: 2834 - DNA, 15 bp, Homo sapiens
agagggaggttaaaa

SEQ ID NO: 2835 - DNA, 15 bp, Homo sapiens
aagagggaggttaaa

SEQ ID NO: 2836 - DNA, 15 bp, Homo sapiens
caagagggaggttaa

SEQ ID NO: 2837 - DNA, 15 bp, Homo sapiens
tcaagagggaggtta

SEQ ID NO: 2838 - DNA, 15 bp, Homo sapiens
gtcaagagggaggtt

SEQ ID NO: 2839 - DNA, 15 bp, Homo sapiens
tgtcaagagggaggt

SEQ ID NO: 2840 - DNA, 15 bp, Homo sapiens
gtgtcaagagggagg

SEQ ID NO: 2841 - DNA, 15 bp, Homo sapiens
tgtgtcaagagggag

SEQ ID NO: 2842 - DNA, 15 bp, Homo sapiens
atgtgtcaagaggga

SEQ ID NO: 2843 - DNA, 15 bp, Homo sapiens
aatgtgtcaagaggg

SEQ ID NO: 2844 - DNA, 15 bp, Homo sapiens
caatgtgtcaagagg

SEQ ID NO: 2845 - DNA, 15 bp, Homo sapiens
gcaatgtgtcaagag

SEQ ID NO: 2846 - DNA, 15 bp, Homo sapiens
agcaatgtgtcaaga

SEQ ID NO: 2847 - DNA, 15 bp, Homo sapiens
aagcaatgtgtcaag

SEQ ID NO: 2848 - DNA, 15 bp, Homo sapiens
caagcaatgtgtcaa

SEQ ID NO: 2849 - DNA, 15 bp, Homo sapiens
tcaagcaatgtgtca

SEQ ID NO: 2850 - DNA, 15 bp, Homo sapiens
gtcaagcaatgtgtc

SEQ ID NO: 2851 - DNA, 15 bp, Homo sapiens
cgtcaagcaatgtgt

SEQ ID NO: 2852 - DNA, 15 bp, Homo sapiens
tcgtcaagcaatgtg

SEQ ID NO: 2853 - DNA, 15 bp, Homo sapiens
ttcgtcaagcaatgt

SEQ ID NO: 2854 - DNA, 15 bp, Homo sapiens
attcgtcaagcaatg

SEQ ID NO: 2855 - DNA, 15 bp, Homo sapiens
aattcgtcaagcaat

SEQ ID NO: 2856 - DNA, 15 bp, Homo sapiens
aaattcgtcaagcaa

SEQ ID NO: 2857 - DNA, 15 bp, Homo sapiens
gaaattcgtcaagca

SEQ ID NO: 2858 - DNA, 15 bp, Homo sapiens
agaaattcgtcaagc

SEQ ID NO: 2859 - DNA, 15 bp, Homo sapiens
tagaaattcgtcaag

SEQ ID NO: 2860 - DNA, 15 bp, Homo sapiens
gtagaaattcgtcaa

SEQ ID NO: 2861 - DNA, 15 bp, Homo sapiens
tgtagaaattcgtca

SEQ ID NO: 2862 - DNA, 15 bp, Homo sapiens
atgtagaaattcgtc

SEQ ID NO: 2863 - DNA, 15 bp, Homo sapiens
aatgtagaaattcgt

SEQ ID NO: 2864 - DNA, 15 bp, Homo sapiens
gaatgtagaaattcg

SEQ ID NO: 2865 - DNA, 15 bp, Homo sapiens
agaatgtagaaattc

SEQ ID NO: 2866 - DNA, 15 bp, Homo sapiens
tagaatgtagaaatt

SEQ ID NO: 2867 - DNA, 15 bp, Homo sapiens
gtagaatgtagaaat

SEQ ID NO: 2868 - DNA, 15 bp, Homo sapiens
tgtagaatgtagaaa

SEQ ID NO: 2869 - DNA, 15 bp, Homo sapiens
ctgtagaatgtagaa

SEQ ID NO: 2870 - DNA, 15 bp, Homo sapiens
tctgtagaatgtaga

SEQ ID NO: 2871 - DNA, 15 bp, Homo sapiens
ctctgtagaatgtag

SEQ ID NO: 2872 - DNA, 15 bp, Homo sapiens
actctgtagaatgta

SEQ ID NO: 2873 - DNA, 15 bp, Homo sapiens
aactctgtagaatgt

SEQ ID NO: 2874 - DNA, 15 bp, Homo sapiens
taactctgtagaatg

SEQ ID NO: 2875 - DNA, 15 bp, Homo sapiens
gtaactctgtagaat

SEQ ID NO: 2876 - DNA, 15 bp, Homo sapiens
ggtaactctgtagaa

SEQ ID NO: 2877 - DNA, 15 bp, Homo sapiens
cggtaactctgtaga

SEQ ID NO: 2878 - DNA, 15 bp, Homo sapiens
ccggtaactctgtag

SEQ ID NO: 2879 - DNA, 15 bp, Homo sapiens
gccggtaactctgta

SEQ ID NO: 2880 - DNA, 15 bp, Homo sapiens
agccggtaactctgt

SEQ ID NO: 2881 - DNA, 15 bp, Homo sapiens
cagccggtaactctg

SEQ ID NO: 2882 - DNA, 15 bp, Homo sapiens
tcagccggtaactct

SEQ ID NO: 2883 - DNA, 15 bp, Homo sapiens
ttcagccggtaactc

SEQ ID NO: 2884 - DNA, 15 bp, Homo sapiens
cttcagccggtaact

SEQ ID NO: 2885 - DNA, 15 bp, Homo sapiens
tcttcagccggtaac

SEQ ID NO: 2886 - DNA, 15 bp, Homo sapiens
ttcttcagccggtaa

SEQ ID NO: 2887 - DNA, 15 bp, Homo sapiens
cttcttcagccggta

SEQ ID NO: 2888 - DNA, 15 bp, Homo sapiens
ccttcttcagccggt

SEQ ID NO: 2889 - DNA, 15 bp, Homo sapiens
accttcttcagccgg

SEQ ID NO: 2890 - DNA, 15 bp, Homo sapiens
taccttcttcagccg

SEQ ID NO: 2891 - DNA, 15 bp, Homo sapiens
ttaccttcttcagcc

SEQ ID NO: 2892 - DNA, 15 bp, Homo sapiens
attaccttcttcagc

SEQ ID NO: 2893 - DNA, 15 bp, Homo sapiens
gattaccttcttcag

SEQ ID NO: 2894 - DNA, 15 bp, Homo sapiens
agattaccttcttca

SEQ ID NO: 2895 - DNA, 15 bp, Homo sapiens
aagattaccttcttc

SEQ ID NO: 2896 - DNA, 15 bp, Homo sapiens
taagattaccttctt

SEQ ID NO: 2897 - DNA, 15 bp, Homo sapiens
ttaagattaccttct

SEQ ID NO: 2898 - DNA, 15 bp, Homo sapiens
gttaagattaccttc

SEQ ID NO: 2899 - DNA, 15 bp, Homo sapiens
tgttaagattacctt

SEQ ID NO: 2900 - DNA, 15 bp, Homo sapiens
atgttaagattacct

SEQ ID NO: 2901 - DNA, 15 bp, Homo sapiens
catgttaagattacc

SEQ ID NO: 2902 - DNA, 15 bp, Homo sapiens
gcatgttaagattac

SEQ ID NO: 2903 - DNA, 15 bp, Homo sapiens
agcatgttaagatta

SEQ ID NO: 2904 - DNA, 15 bp, Homo sapiens
cagcatgttaagatt

SEQ ID NO: 2905 - DNA, 15 bp, Homo sapiens
acagcatgttaagat

SEQ ID NO: 2906 - DNA, 15 bp, Homo sapiens
aacagcatgttaaga

SEQ ID NO: 2907 - DNA, 15 bp, Homo sapiens
aaacagcatgttaag

SEQ ID NO: 2908 - DNA, 15 bp, Homo sapiens
gaaacagcatgttaa

SEQ ID NO: 2909 - DNA, 15 bp, Homo sapiens
agaaacagcatgtta

SEQ ID NO: 2910 - DNA, 15 bp, Homo sapiens
cagaaacagcatgtt

SEQ ID NO: 2911 - DNA, 15 bp, Homo sapiens
acagaaacagcatgt

SEQ ID NO: 2912 - DNA, 15 bp, Homo sapiens
aacagaaacagcatg

SEQ ID NO: 2913 - DNA, 15 bp, Homo sapiens
aaacagaaacagcat

SEQ ID NO: 2914 - DNA, 15 bp, Homo sapiens
aaaacagaaacagca

SEQ ID NO: 2915 - DNA, 15 bp, Homo sapiens
aaaaacagaaacagc

SEQ ID NO: 2916 - DNA, 15 bp, Homo sapiens
aaaaaacagaaacag

SEQ ID NO: 2917 - DNA, 15 bp, Homo sapiens
aaaaaaacagaaaca

SEQ ID NO: 2918 - DNA, 15 bp, Homo sapiens
aaaaaaaacagaaac

SEQ ID NO: 2919 - DNA, 15 bp, Homo sapiens
gaaaaaaaacagaaa

SEQ ID NO: 2920 - DNA, 15 bp, Homo sapiens
ggaaaaaaaacagaa

SEQ ID NO: 2921 - DNA, 15 bp, Homo sapiens
aggaaaaaaaacaga

SEQ ID NO: 2922 - DNA, 15 bp, Homo sapiens
gaggaaaaaaaacag

SEQ ID NO: 2923 - DNA, 15 bp, Homo sapiens
agaggaaaaaaaaca

SEQ ID NO: 2924 - DNA, 15 bp, Homo sapiens
cagaggaaaaaaaac

SEQ ID NO: 2925 - DNA, 15 bp, Homo sapiens
acagaggaaaaaaaa

SEQ ID NO: 2926 - DNA, 15 bp, Homo sapiens
aacagaggaaaaaaa

SEQ ID NO: 2927 - DNA, 15 bp, Homo sapiens
caacagaggaaaaaa

SEQ ID NO: 2928 - DNA, 15 bp, Homo sapiens
ccaacagaggaaaaa

SEQ ID NO: 2929 - DNA, 15 bp, Homo sapiens
accaacagaggaaaa

SEQ ID NO: 2930 - DNA, 15 bp, Homo sapiens
caccaacagaggaaa

SEQ ID NO: 2931 - DNA, 15 bp, Homo sapiens
acaccaacagaggaa

SEQ ID NO: 2932 - DNA, 15 bp, Homo sapiens
cacaccaacagagga

SEQ ID NO: 2933 - DNA, 15 bp, Homo sapiens
gcacaccaacagagg

SEQ ID NO: 2934 - DNA, 15 bp, Homo sapiens
agcacaccaacagag

SEQ ID NO: 2935 - DNA, 15 bp, Homo sapiens
cagcacaccaacaga

SEQ ID NO: 2936 - DNA, 15 bp, Homo sapiens
tcagcacaccaacag

SEQ ID NO: 2937 - DNA, 15 bp, Homo sapiens
atcagcacaccaaca

SEQ ID NO: 2938 - DNA, 15 bp, Homo sapiens
catcagcacaccaac

SEQ ID NO: 2939 - DNA, 15 bp, Homo sapiens
ccatcagcacaccaa

SEQ ID NO: 2940 - DNA, 15 bp, Homo sapiens
accatcagcacacca

SEQ ID NO: 2941 - DNA, 15 bp, Homo sapiens
taccatcagcacacc

SEQ ID NO: 2942 - DNA, 15 bp, Homo sapiens
ttaccatcagcacac

SEQ ID NO: 2943 - DNA, 15 bp, Homo sapiens
cttaccatcagcaca

SEQ ID NO: 2944 - DNA, 15 bp, Homo sapiens
tcttaccatcagcac

SEQ ID NO: 2945 - DNA, 15 bp, Homo sapiens
atcttaccatcagca

SEQ ID NO: 2946 - DNA, 15 bp, Homo sapiens
catcttaccatcagc

SEQ ID NO: 2947 - DNA, 15 bp, Homo sapiens
tcatcttaccatcag

SEQ ID NO: 2948 - DNA, 15 bp, Homo sapiens
gtcatcttaccatca

SEQ ID NO: 2949 - DNA, 15 bp, Homo sapiens
tgtcatcttaccatc

SEQ ID NO: 2950 - DNA, 15 bp, Homo sapiens
ctgtcatcttaccat

SEQ ID NO: 2951 - DNA, 15 bp, Homo sapiens
actgtcatcttacca

SEQ ID NO: 2952 - DNA, 15 bp, Homo sapiens
aactgtcatcttacc

SEQ ID NO: 2953 - DNA, 15 bp, Homo sapiens
taactgtcatcttac

SEQ ID NO: 2954 - DNA, 15 bp, Homo sapiens
ttaactgtcatctta

SEQ ID NO: 2955 - DNA, 15 bp, Homo sapiens
tttaactgtcatctt

SEQ ID NO: 2956 - DNA, 15 bp, Homo sapiens
ttttaactgtcatct

SEQ ID NO: 2957 - DNA, 15 bp, Homo sapiens
gttttaactgtcatc

SEQ ID NO: 2958 - DNA, 15 bp, Homo sapiens
tgttttaactgtcat

SEQ ID NO: 2959 - DNA, 15 bp, Homo sapiens
gtgttttaactgtca

SEQ ID NO: 2960 - DNA, 15 bp, Homo sapiens
tgtgttttaactgtc

SEQ ID NO: 2961 - DNA, 15 bp, Homo sapiens
atgtgttttaactgt

SEQ ID NO: 2962 - DNA, 15 bp, Homo sapiens
catgtgttttaactg

SEQ ID NO: 2963 - DNA, 15 bp, Homo sapiens
acatgtgttttaact

SEQ ID NO: 2964 - DNA, 15 bp, Homo sapiens
cacatgtgttttaac

SEQ ID NO: 2965 - DNA, 15 bp, Homo sapiens
acacatgtgttttaa

SEQ ID NO: 2966 - DNA, 15 bp, Homo sapiens
aacacatgtgtttta

SEQ ID NO: 2967 - DNA, 15 bp, Homo sapiens
aaacacatgtgtttt

SEQ ID NO: 2968 - DNA, 15 bp, Homo sapiens
caaacacatgtgttt

SEQ ID NO: 2969 - DNA, 15 bp, Homo sapiens
acaaacacatgtgtt

SEQ ID NO: 2970 - DNA, 15 bp, Homo sapiens
aacaaacacatgtgt

SEQ ID NO: 2971 - DNA, 15 bp, Homo sapiens
aaacaaacacatgtg

SEQ ID NO: 2972 - DNA, 15 bp, Homo sapiens
gaaacaaacacatgt

SEQ ID NO: 2973 - DNA, 15 bp, Homo sapiens
agaaacaaacacatg

SEQ ID NO: 2974 - DNA, 15 bp, Homo sapiens
aagaaacaaacacat

SEQ ID NO: 2975 - DNA, 15 bp, Homo sapiens
taagaaacaaacaca

SEQ ID NO: 2976 - DNA, 15 bp, Homo sapiens
gtaagaaacaaacac

SEQ ID NO: 2977 - DNA, 15 bp, Homo sapiens
tgtaagaaacaaaca

SEQ ID NO: 2978 - DNA, 15 bp, Homo sapiens
ctgtaagaaacaaac

SEQ ID NO: 2979 - DNA, 15 bp, Homo sapiens
cctgtaagaaacaaa

SEQ ID NO: 2980 - DNA, 15 bp, Homo sapiens
tcctgtaagaaacaa

SEQ ID NO: 2981 - DNA, 15 bp, Homo sapiens
ttcctgtaagaaaca

SEQ ID NO: 2982 - DNA, 15 bp, Homo sapiens
tttcctgtaagaaac

SEQ ID NO: 2983 - DNA, 15 bp, Homo sapiens
ttttcctgtaagaaa

SEQ ID NO: 2984 - DNA, 15 bp, Homo sapiens
tttttcctgtaagaa

SEQ ID NO: 2985 - DNA, 15 bp, Homo sapiens
gtttttcctgtaaga

SEQ ID NO: 2986 - DNA, 15 bp, Homo sapiens
ggtttttcctgtaag

SEQ ID NO: 2987 - DNA, 15 bp, Homo sapiens
aggtttttcctgtaa

SEQ ID NO: 2988 - DNA, 15 bp, Homo sapiens
aaggtttttcctgta

SEQ ID NO: 2989 - DNA, 15 bp, Homo sapiens
caaggtttttcctgt

SEQ ID NO: 2990 - DNA, 15 bp, Homo sapiens
gcaaggtttttcctg

SEQ ID NO: 2991 - DNA, 15 bp, Homo sapiens
agcaaggtttttcct

SEQ ID NO: 2992 - DNA, 15 bp, Homo sapiens
cagcaaggtttttcc

SEQ ID NO: 2993 - DNA, 15 bp, Homo sapiens
ccagcaaggtttttc

SEQ ID NO: 2994 - DNA, 15 bp, Homo sapiens
tccagcaaggttttt

SEQ ID NO: 2995 - DNA, 15 bp, Homo sapiens
ttccagcaaggtttt

SEQ ID NO: 2996 - DNA, 15 bp, Homo sapiens
gttccagcaaggttt

SEQ ID NO: 2997 - DNA, 15 bp, Homo sapiens
agttccagcaaggtt

SEQ ID NO: 2998 - DNA, 15 bp, Homo sapiens
aagttccagcaaggt

SEQ ID NO: 2999 - DNA, 15 bp, Homo sapiens
caagttccagcaagg

SEQ ID NO: 3000 - DNA, 15 bp, Homo sapiens
acaagttccagcaag

SEQ ID NO: 3001 - DNA, 15 bp, Homo sapiens
cacaagttccagcaa

SEQ ID NO: 3002 - DNA, 15 bp, Homo sapiens
tcacaagttccagca

SEQ ID NO: 3003 - DNA, 15 bp, Homo sapiens
atcacaagttccagc

SEQ ID NO: 3004 - DNA, 15 bp, Homo sapiens
aatcacaagttccag

SEQ ID NO: 3005 - DNA, 15 bp, Homo sapiens
caatcacaagttcca

SEQ ID NO: 3006 - DNA, 15 bp, Homo sapiens
tcaatcacaagttcc

SEQ ID NO: 3007 - DNA, 15 bp, Homo sapiens
ctcaatcacaagttc

SEQ ID NO: 3008 - DNA, 15 bp, Homo sapiens
gctcaatcacaagtt

SEQ ID NO: 3009 - DNA, 15 bp, Homo sapiens
tgctcaatcacaagt

SEQ ID NO: 3010 - DNA, 15 bp, Homo sapiens
ctgctcaatcacaag

SEQ ID NO: 3011 - DNA, 15 bp, Homo sapiens
actgctcaatcacaa

SEQ ID NO: 3012 - DNA, 15 bp, Homo sapiens
aactgctcaatcaca

SEQ ID NO: 3013 - DNA, 15 bp, Homo sapiens
aaactgctcaatcac

SEQ ID NO: 3014 - DNA, 15 bp, Homo sapiens
caaactgctcaatca

SEQ ID NO: 3015 - DNA, 15 bp, Homo sapiens
tcaaactgctcaatc

SEQ ID NO: 3016 - DNA, 15 bp, Homo sapiens
ttcaaactgctcaat

SEQ ID NO: 3017 - DNA, 15 bp, Homo sapiens
cttcaaactgctcaa

SEQ ID NO: 3018 - DNA, 15 bp, Homo sapiens
tcttcaaactgctca

SEQ ID NO: 3019 - DNA, 15 bp, Homo sapiens
gtcttcaaactgctc

SEQ ID NO: 3020 - DNA, 15 bp, Homo sapiens
agtcttcaaactgct

SEQ ID NO: 3021 - DNA, 15 bp, Homo sapiens
aagtcttcaaactgc

SEQ ID NO: 3022 - DNA, 15 bp, Homo sapiens
caagtcttcaaactg

SEQ ID NO: 3023 - DNA, 15 bp, Homo sapiens
gcaagtcttcaaact

SEQ ID NO: 3024 - DNA, 15 bp, Homo sapiens
agcaagtcttcaaac

SEQ ID NO: 3025 - DNA, 15 bp, Homo sapiens
tagcaagtcttcaaa

SEQ ID NO: 3026 - DNA, 15 bp, Homo sapiens
ctagcaagtcttcaa

SEQ ID NO: 3027 - DNA, 15 bp, Homo sapiens
actagcaagtcttca

SEQ ID NO: 3028 - DNA, 15 bp, Homo sapiens
aactagcaagtcttc

SEQ ID NO: 3029 - DNA, 15 bp, Homo sapiens
taactagcaagtctt

SEQ ID NO: 3030 - DNA, 15 bp, Homo sapiens
ctaactagcaagtct

SEQ ID NO: 3031 - DNA, 15 bp, Homo sapiens
cctaactagcaagtc

SEQ ID NO: 3032 - DNA, 15 bp, Homo sapiens
tcctaactagcaagt

SEQ ID NO: 3033 - DNA, 15 bp, Homo sapiens
atcctaactagcaag

SEQ ID NO: 3034 - DNA, 15 bp, Homo sapiens
aatcctaactagcaa

SEQ ID NO: 3035 - DNA, 15 bp, Homo sapiens
aaatcctaactagca

SEQ ID NO: 3036 - DNA, 15 bp, Homo sapiens
aaaatcctaactagc

SEQ ID NO: 3037 - DNA, 15 bp, Homo sapiens
taaaatcctaactag

SEQ ID NO: 3038 - DNA, 15 bp, Homo sapiens
ataaaatcctaacta

SEQ ID NO: 3039 - DNA, 15 bp, Homo sapiens
aataaaatcctaact

SEQ ID NO: 3040 - DNA, 15 bp, Homo sapiens
taataaaatcctaac

SEQ ID NO: 3041 - DNA, 15 bp, Homo sapiens
gtaataaaatcctaa

SEQ ID NO: 3042 - DNA, 15 bp, Homo sapiens
agtaataaaatccta

SEQ ID NO: 3043 - DNA, 15 bp, Homo sapiens
cagtaataaaatcct

SEQ ID NO: 3044 - DNA, 15 bp, Homo sapiens
ccagtaataaaatcc

SEQ ID NO: 3045 - DNA, 15 bp, Homo sapiens
gccagtaataaaatc

SEQ ID NO: 3046 - DNA, 15 bp, Homo sapiens
tgccagtaataaaat

SEQ ID NO: 3047 - DNA, 15 bp, Homo sapiens
ctgccagtaataaaa

SEQ ID NO: 3048 - DNA, 15 bp, Homo sapiens
gctgccagtaataaa

SEQ ID NO: 3049 - DNA, 15 bp, Homo sapiens
tgctgccagtaataa

SEQ ID NO: 3050 - DNA, 15 bp, Homo sapiens
atgctgccagtaata

SEQ ID NO: 3051 - DNA, 15 bp, Homo sapiens
catgctgccagtaat

SEQ ID NO: 3052 - DNA, 15 bp, Homo sapiens
acatgctgccagtaa

SEQ ID NO: 3053 - DNA, 15 bp, Homo sapiens
tacatgctgccagta

SEQ ID NO: 3054 - DNA, 15 bp, Homo sapiens
atacatgctgccagt

SEQ ID NO: 3055 - DNA, 15 bp, Homo sapiens
tatacatgctgccag

SEQ ID NO: 3056 - DNA, 15 bp, Homo sapiens
atatacatgctgcca

SEQ ID NO: 3057 - DNA, 15 bp, Homo sapiens
gatatacatgctgcc

SEQ ID NO: 3058 - DNA, 15 bp, Homo sapiens
agatatacatgctgc

SEQ ID NO: 3059 - DNA, 15 bp, Homo sapiens
aagatatacatgctg

SEQ ID NO: 3060 - DNA, 15 bp, Homo sapiens
aaagatatacatgct

SEQ ID NO: 3061 - DNA, 15 bp, Homo sapiens
aaaagatatacatgc

SEQ ID NO: 3062 - DNA, 15 bp, Homo sapiens
caaaagatatacatg

SEQ ID NO: 3063 - DNA, 15 bp, Homo sapiens
acaaaagatatacat

SEQ ID NO: 3064 - DNA, 15 bp, Homo sapiens
tacaaaagatataca

SEQ ID NO: 3065 - DNA, 15 bp, Homo sapiens
ttacaaaagatatac

SEQ ID NO: 3066 - DNA, 15 bp, Homo sapiens
cttacaaaagatata

SEQ ID NO: 3067 - DNA, 15 bp, Homo sapiens
acttacaaaagatat

SEQ ID NO: 3068 - DNA, 15 bp, Homo sapiens
tacttacaaaagata

SEQ ID NO: 3069 - DNA, 15 bp, Homo sapiens
atacttacaaaagat

SEQ ID NO: 3070 - DNA, 15 bp, Homo sapiens
tatacttacaaaaga

SEQ ID NO: 3071 - DNA, 15 bp, Homo sapiens
ttatacttacaaaag

SEQ ID NO: 3072 - DNA, 15 bp, Homo sapiens
tttatacttacaaaa

SEQ ID NO: 3073 - DNA, 15 bp, Homo sapiens
ttttatacttacaaa

SEQ ID NO: 3074 - DNA, 15 bp, Homo sapiens
tttttatacttacaa

SEQ ID NO: 3075 - DNA, 15 bp, Homo sapiens
ttttttatacttaca

SEQ ID NO: 3076 - DNA, 15 bp, Homo sapiens
tttttttatacttac

SEQ ID NO: 3077 - DNA, 15 bp, Homo sapiens
atttttttatactta

SEQ ID NO: 3078 - DNA, 15 bp, Homo sapiens
aatttttttatactt

SEQ ID NO: 3079 - DNA, 15 bp, Homo sapiens
aaatttttttatact

SEQ ID NO: 3080 - DNA, 15 bp, Homo sapiens
taaatttttttatac

SEQ ID NO: 3081 - DNA, 15 bp, Homo sapiens
ataaatttttttata

SEQ ID NO: 3082 - DNA, 15 bp, Homo sapiens
aataaatttttttat

SEQ ID NO: 3083 - DNA, 15 bp, Homo sapiens
aaataaattttttta

SEQ ID NO: 3084 - DNA, 15 bp, Homo sapiens
aaaataaattttttt

SEQ ID NO: 3085 - DNA, 15 bp, Homo sapiens
gaaaataaatttttt

SEQ ID NO: 3086 - DNA, 15 bp, Homo sapiens
agaaaataaattttt

SEQ ID NO: 3087 - DNA, 15 bp, Homo sapiens
aagaaaataaatttt

SEQ ID NO: 3088 - DNA, 15 bp, Homo sapiens
aaagaaaataaattt

SEQ ID NO: 3089 - DNA, 15 bp, Homo sapiens
gaaagaaaataaatt

SEQ ID NO: 3090 - DNA, 15 bp, Homo sapiens
ggaaagaaaataaat

SEQ ID NO: 3091 - DNA, 15 bp, Homo sapiens
gggaaagaaaataaa

SEQ ID NO: 3092 - DNA, 15 bp, Homo sapiens
ggggaaagaaaataa

SEQ ID NO: 3093 - DNA, 15 bp, Homo sapiens
gggggaaagaaaata

SEQ ID NO: 3094 - DNA, 15 bp, Homo sapiens
ggggggaaagaaaat

SEQ ID NO: 3095 - DNA, 15 bp, Homo sapiens
tggggggaaagaaaa

SEQ ID NO: 3096 - DNA, 15 bp, Homo sapiens
ttggggggaaagaaa

SEQ ID NO: 3097 - DNA, 15 bp, Homo sapiens
tttggggggaaagaa

SEQ ID NO: 3098 - DNA, 15 bp, Homo sapiens
ttttggggggaaaga

SEQ ID NO: 3099 - DNA, 15 bp, Homo sapiens
cttttggggggaaag

SEQ ID NO: 3100 - DNA, 15 bp, Homo sapiens
gcttttggggggaaa

SEQ ID NO: 3101 - DNA, 15 bp, Homo sapiens
agcttttggggggaa

SEQ ID NO: 3102 - DNA, 15 bp, Homo sapiens
cagcttttgggggga

SEQ ID NO: 3103 - DNA, 15 bp, Homo sapiens
tcagcttttgggggg

SEQ ID NO: 3104 - DNA, 15 bp, Homo sapiens
ttcagcttttggggg

SEQ ID NO: 3105 - DNA, 15 bp, Homo sapiens
tttcagcttttgggg

SEQ ID NO: 3106 - DNA, 15 bp, Homo sapiens
ctttcagcttttggg

SEQ ID NO: 3107 - DNA, 15 bp, Homo sapiens
actttcagcttttgg

SEQ ID NO: 3108 - DNA, 15 bp, Homo sapiens
tactttcagcttttg

SEQ ID NO: 3109 - DNA, 15 bp, Homo sapiens
atactttcagctttt

SEQ ID NO: 3110 - DNA, 15 bp, Homo sapiens
aatactttcagcttt

SEQ ID NO: 3111 - DNA, 15 bp, Homo sapiens
gaatactttcagctt

SEQ ID NO: 3112 - DNA, 15 bp, Homo sapiens
ggaatactttcagct

SEQ ID NO: 3113 - DNA, 15 bp, Homo sapiens
tggaatactttcagc

SEQ ID NO: 3114 - DNA, 15 bp, Homo sapiens
atggaatactttcag

SEQ ID NO: 3115 - DNA, 15 bp, Homo sapiens
tatggaatactttca

SEQ ID NO: 3116 - DNA, 15 bp, Homo sapiens
ctatggaatactttc

SEQ ID NO: 3117 - DNA, 15 bp, Homo sapiens
tctatggaatacttt

SEQ ID NO: 3118 - DNA, 15 bp, Homo sapiens
atctatggaatactt

SEQ ID NO: 3119 - DNA, 15 bp, Homo sapiens
tatctatggaatact

SEQ ID NO: 3120 - DNA, 15 bp, Homo sapiens
ttatctatggaatac

SEQ ID NO: 3121 - DNA, 15 bp, Homo sapiens
tttatctatggaata

SEQ ID NO: 3122 - DNA, 15 bp, Homo sapiens
atttatctatggaat

SEQ ID NO: 3123 - DNA, 15 bp, Homo sapiens
gatttatctatggaa

SEQ ID NO: 3124 - DNA, 15 bp, Homo sapiens
tgatttatctatgga

SEQ ID NO: 3125 - DNA, 15 bp, Homo sapiens
ctgatttatctatgg

SEQ ID NO: 3126 - DNA, 15 bp, Homo sapiens
tctgatttatctatg

SEQ ID NO: 3127 - DNA, 15 bp, Homo sapiens
ttctgatttatctat

SEQ ID NO: 3128 - DNA, 15 bp, Homo sapiens
tttctgatttatcta

SEQ ID NO: 3129 - DNA, 15 bp, Homo sapiens
ttttctgatttatct

SEQ ID NO: 3130 - DNA, 15 bp, Homo sapiens
gttttctgatttatc

SEQ ID NO: 3131 - DNA, 15 bp, Homo sapiens
tgttttctgatttat

SEQ ID NO: 3132 - DNA, 15 bp, Homo sapiens
ttgttttctgattta

SEQ ID NO: 3133 - DNA, 15 bp, Homo sapiens
tttgttttctgattt

SEQ ID NO: 3134 - DNA, 15 bp, Homo sapiens
atttgttttctgatt

SEQ ID NO: 3135 - DNA, 15 bp, Homo sapiens
catttgttttctgat

SEQ ID NO: 3136 - DNA, 15 bp, Homo sapiens
tcatttgttttctga

SEQ ID NO: 3137 - DNA, 15 bp, Homo sapiens
atcatttgttttctg

SEQ ID NO: 3138 - DNA, 15 bp, Homo sapiens
catcatttgttttct

SEQ ID NO: 3139 - DNA, 15 bp, Homo sapiens
acatcatttgttttc

SEQ ID NO: 3140 - DNA, 15 bp, Homo sapiens
gacatcatttgtttt

SEQ ID NO: 3141 - DNA, 15 bp, Homo sapiens
ggacatcatttgttt

SEQ ID NO: 3142 - DNA, 15 bp, Homo sapiens
tggacatcatttgtt

SEQ ID NO: 3143 - DNA, 15 bp, Homo sapiens
atggacatcatttgt

SEQ ID NO: 3144 - DNA, 15 bp, Homo sapiens
aatggacatcatttg

SEQ ID NO: 3145 - DNA, 15 bp, Homo sapiens
caatggacatcattt

SEQ ID NO: 3146 - DNA, 15 bp, Homo sapiens
ccaatggacatcatt

SEQ ID NO: 3147 - DNA, 15 bp, Homo sapiens
cccaatggacatcat

SEQ ID NO: 3148 - DNA, 15 bp, Homo sapiens
acccaatggacatca

SEQ ID NO: 3149 - DNA, 15 bp, Homo sapiens
cacccaatggacatc

SEQ ID NO: 3150 - DNA, 15 bp, Homo sapiens
tcacccaatggacat

SEQ ID NO: 3151 - DNA, 15 bp, Homo sapiens
ttcacccaatggaca

SEQ ID NO: 3152 - DNA, 15 bp, Homo sapiens
tttcacccaatggac

SEQ ID NO: 3153 - DNA, 15 bp, Homo sapiens
ttttcacccaatgga

SEQ ID NO: 3154 - DNA, 15 bp, Homo sapiens
gttttcacccaatgg

SEQ ID NO: 3155 - DNA, 15 bp, Homo sapiens
tgttttcacccaatg

SEQ ID NO: 3156 - DNA, 15 bp, Homo sapiens
atgttttcacccaat

SEQ ID NO: 3157 - DNA, 15 bp, Homo sapiens
tatgttttcacccaa

SEQ ID NO: 3158 - DNA, 15 bp, Homo sapiens
atatgttttcaccca

SEQ ID NO: 3159 - DNA, 15 bp, Homo sapiens
aatatgttttcaccc

SEQ ID NO: 3160 - DNA, 15 bp, Homo sapiens
aaatatgttttcacc

SEQ ID NO: 3161 - DNA, 15 bp, Homo sapiens
caaatatgttttcac

SEQ ID NO: 3162 - DNA, 15 bp, Homo sapiens
ccaaatatgttttca

SEQ ID NO: 3163 - DNA, 15 bp, Homo sapiens
tccaaatatgttttc

SEQ ID NO: 3164 - DNA, 15 bp, Homo sapiens
ctccaaatatgtttt

SEQ ID NO: 3165 - DNA, 15 bp, Homo sapiens
actccaaatatgttt

SEQ ID NO: 3166 - DNA, 15 bp, Homo sapiens
aactccaaatatgtt

SEQ ID NO: 3167 - DNA, 15 bp, Homo sapiens
caactccaaatatgt

SEQ ID NO: 3168 - DNA, 15 bp, Homo sapiens
gcaactccaaatatg

SEQ ID NO: 3169 - DNA, 15 bp, Homo sapiens
tgcaactccaaatat

SEQ ID NO: 3170 - DNA, 15 bp, Homo sapiens
ttgcaactccaaata

SEQ ID NO: 3171 - DNA, 15 bp, Homo sapiens
cttgcaactccaaat

SEQ ID NO: 3172 - DNA, 15 bp, Homo sapiens
gcttgcaactccaaa

SEQ ID NO: 3173 - DNA, 15 bp, Homo sapiens
agcttgcaactccaa

SEQ ID NO: 3174 - DNA, 15 bp, Homo sapiens
cagcttgcaactcca

SEQ ID NO: 3175 - DNA, 15 bp, Homo sapiens
acagcttgcaactcc

SEQ ID NO: 3176 - DNA, 15 bp, Homo sapiens
cacagcttgcaactc

SEQ ID NO: 3177 - DNA, 15 bp, Homo sapiens
acacagcttgcaact

SEQ ID NO: 3178 - DNA, 15 bp, Homo sapiens
gacacagcttgcaac

SEQ ID NO: 3179 - DNA, 15 bp, Homo sapiens
agacacagcttgcaa

SEQ ID NO: 3180 - DNA, 15 bp, Homo sapiens
gagacacagcttgca

SEQ ID NO: 3181 - DNA, 15 bp, Homo sapiens
agagacacagcttgc

SEQ ID NO: 3182 - DNA, 15 bp, Homo sapiens
tagagacacagcttg

SEQ ID NO: 3183 - DNA, 15 bp, Homo sapiens
atagagacacagctt

SEQ ID NO: 3184 - DNA, 15 bp, Homo sapiens
catagagacacagct

SEQ ID NO: 3185 - DNA, 15 bp, Homo sapiens
acatagagacacagc

SEQ ID NO: 3186 - DNA, 15 bp, Homo sapiens
aacatagagacacag

SEQ ID NO: 3187 - DNA, 15 bp, Homo sapiens
aaacatagagacaca

SEQ ID NO: 3188 - DNA, 15 bp, Homo sapiens
taaacatagagacac

SEQ ID NO: 3189 - DNA, 15 bp, Homo sapiens
ttaaacatagagaca

SEQ ID NO: 3190 - DNA, 15 bp, Homo sapiens
tttaaacatagagac

SEQ ID NO: 3191 - DNA, 15 bp, Homo sapiens
ttttaaacatagaga

SEQ ID NO: 3192 - DNA, 15 bp, Homo sapiens
tttttaaacatagag

SEQ ID NO: 3193 - DNA, 15 bp, Homo sapiens
gtttttaaacataga

SEQ ID NO: 3194 - DNA, 15 bp, Homo sapiens
tgtttttaaacatag

SEQ ID NO: 3195 - DNA, 15 bp, Homo sapiens
ttgtttttaaacata

SEQ ID NO: 3196 - DNA, 15 bp, Homo sapiens
attgtttttaaacat

SEQ ID NO: 3197 - DNA, 15 bp, Homo sapiens
gattgtttttaaaca

SEQ ID NO: 3198 - DNA, 15 bp, Homo sapiens
agattgtttttaaac

SEQ ID NO: 3199 - DNA, 15 bp, Homo sapiens
cagattgtttttaaa

SEQ ID NO: 3200 - DNA, 15 bp, Homo sapiens
ccagattgtttttaa

SEQ ID NO: 3201 - DNA, 15 bp, Homo sapiens
cccagattgttttta

SEQ ID NO: 3202 - DNA, 15 bp, Homo sapiens
gcccagattgttttt

SEQ ID NO: 3203 - DNA, 15 bp, Homo sapiens
tgcccagattgtttt

SEQ ID NO: 3204 - DNA, 15 bp, Homo sapiens
atgcccagattgttt

SEQ ID NO: 3205 - DNA, 15 bp, Homo sapiens
aatgcccagattgtt

SEQ ID NO: 3206 - DNA, 15 bp, Homo sapiens
aaatgcccagattgt

SEQ ID NO: 3207 - DNA, 15 bp, Homo sapiens
aaaatgcccagattg

SEQ ID NO: 3208 - DNA, 15 bp, Homo sapiens
taaaatgcccagatt

SEQ ID NO: 3209 - DNA, 15 bp, Homo sapiens
ttaaaatgcccagat

SEQ ID NO: 3210 - DNA, 15 bp, Homo sapiens
tttaaaatgcccaga

SEQ ID NO: 3211 - DNA, 15 bp, Homo sapiens
ttttaaaatgcccag

SEQ ID NO: 3212 - DNA, 15 bp, Homo sapiens
attttaaaatgccca

SEQ ID NO: 3213 - DNA, 15 bp, Homo sapiens
aattttaaaatgccc

SEQ ID NO: 3214 - DNA, 15 bp, Homo sapiens
taattttaaaatgcc

SEQ ID NO: 3215 - DNA, 15 bp, Homo sapiens
gtaattttaaaatgc

SEQ ID NO: 3216 - DNA, 15 bp, Homo sapiens
tgtaattttaaaatg

SEQ ID NO: 3217 - DNA, 15 bp, Homo sapiens
ttgtaattttaaaat

SEQ ID NO: 3218 - DNA, 15 bp, Homo sapiens
tttgtaattttaaaa

SEQ ID NO: 3219 - DNA, 15 bp, Homo sapiens
ttttgtaattttaaa

SEQ ID NO: 3220 - DNA, 15 bp, Homo sapiens
gttttgtaattttaa

SEQ ID NO: 3221 - DNA, 15 bp, Homo sapiens
tgttttgtaatttta

SEQ ID NO: 3222 - DNA, 15 bp, Homo sapiens
ttgttttgtaatttt

SEQ ID NO: 3223 - DNA, 15 bp, Homo sapiens
tttgttttgtaattt

SEQ ID NO: 3224 - DNA, 15 bp, Homo sapiens
ttttgttttgtaatt

SEQ ID NO: 3225 - DNA, 15 bp, Homo sapiens
gttttgttttgtaat

SEQ ID NO: 3226 - DNA, 15 bp, Homo sapiens
tgttttgttttgtaa

SEQ ID NO: 3227 - DNA, 15 bp, Homo sapiens
gtgttttgttttgta

SEQ ID NO: 3228 - DNA, 15 bp, Homo sapiens
agtgttttgttttgt

SEQ ID NO: 3229 - DNA, 15 bp, Homo sapiens
aagtgttttgttttg

SEQ ID NO: 3230 - DNA, 15 bp, Homo sapiens
caagtgttttgtttt

SEQ ID NO: 3231 - DNA, 15 bp, Homo sapiens
tcaagtgttttgttt

SEQ ID NO: 3232 - DNA, 15 bp, Homo sapiens
ttcaagtgttttgtt

SEQ ID NO: 3233 - DNA, 15 bp, Homo sapiens
cttcaagtgttttgt

SEQ ID NO: 3234 - DNA, 15 bp, Homo sapiens
gcttcaagtgttttg

SEQ ID NO: 3235 - DNA, 15 bp, Homo sapiens
ggcttcaagtgtttt

SEQ ID NO: 3236 - DNA, 15 bp, Homo sapiens
tggcttcaagtgttt

SEQ ID NO: 3237 - DNA, 15 bp, Homo sapiens
atggcttcaagtgtt

SEQ ID NO: 3238 - DNA, 15 bp, Homo sapiens
aatggcttcaagtgt

SEQ ID NO: 3239 - DNA, 15 bp, Homo sapiens
caatggcttcaagtg

SEQ ID NO: 3240 - DNA, 15 bp, Homo sapiens
ccaatggcttcaagt

SEQ ID NO: 3241 - DNA, 15 bp, Homo sapiens
accaatggcttcaag

SEQ ID NO: 3242 - DNA, 15 bp, Homo sapiens
taccaatggcttcaa

SEQ ID NO: 3243 - DNA, 15 bp, Homo sapiens
ataccaatggcttca

SEQ ID NO: 3244 - DNA, 15 bp, Homo sapiens
aataccaatggcttc

SEQ ID NO: 3245 - DNA, 15 bp, Homo sapiens
gaataccaatggctt

SEQ ID NO: 3246 - DNA, 15 bp, Homo sapiens
tgaataccaatggct

SEQ ID NO: 3247 - DNA, 15 bp, Homo sapiens
ctgaataccaatggc

SEQ ID NO: 3248 - DNA, 15 bp, Homo sapiens
tctgaataccaatgg

SEQ ID NO: 3249 - DNA, 15 bp, Homo sapiens
ttctgaataccaatg

SEQ ID NO: 3250 - DNA, 15 bp, Homo sapiens
tttctgaataccaat

SEQ ID NO: 3251 - DNA, 15 bp, Homo sapiens
ttttctgaataccaa

SEQ ID NO: 3252 - DNA, 15 bp, Homo sapiens
attttctgaatacca

SEQ ID NO: 3253 - DNA, 15 bp, Homo sapiens
tattttctgaatacc

SEQ ID NO: 3254 - DNA, 15 bp, Homo sapiens
ctattttctgaatac

SEQ ID NO: 3255 - DNA, 15 bp, Homo sapiens
tctattttctgaata

SEQ ID NO: 3256 - DNA, 15 bp, Homo sapiens
atctattttctgaat

SEQ ID NO: 3257 - DNA, 15 bp, Homo sapiens
catctattttctgaa

SEQ ID NO: 3258 - DNA, 15 bp, Homo sapiens
gcatctattttctga

SEQ ID NO: 3259 - DNA, 15 bp, Homo sapiens
ggcatctattttctg

SEQ ID NO: 3260 - DNA, 15 bp, Homo sapiens
aggcatctattttct

SEQ ID NO: 3261 - DNA, 15 bp, Homo sapiens
caggcatctattttc

SEQ ID NO: 3262 - DNA, 15 bp, Homo sapiens
tcaggcatctatttt

SEQ ID NO: 3263 - DNA, 15 bp, Homo sapiens
gtcaggcatctattt

SEQ ID NO: 3264 - DNA, 15 bp, Homo sapiens
tgtcaggcatctatt

SEQ ID NO: 3265 - DNA, 15 bp, Homo sapiens
atgtcaggcatctat

SEQ ID NO: 3266 - DNA, 15 bp, Homo sapiens
aatgtcaggcatcta

SEQ ID NO: 3267 - DNA, 15 bp, Homo sapiens
aaatgtcaggcatct

SEQ ID NO: 3268 - DNA, 15 bp, Homo sapiens
taaatgtcaggcatc

SEQ ID NO: 3269 - DNA, 15 bp, Homo sapiens
gtaaatgtcaggcat

SEQ ID NO: 3270 - DNA, 15 bp, Homo sapiens
tgtaaatgtcaggca

SEQ ID NO: 3271 - DNA, 15 bp, Homo sapiens
ctgtaaatgtcaggc

SEQ ID NO: 3272 - DNA, 15 bp, Homo sapiens
actgtaaatgtcagg

SEQ ID NO: 3273 - DNA, 15 bp, Homo sapiens
cactgtaaatgtcag

SEQ ID NO: 3274 - DNA, 15 bp, Homo sapiens
acactgtaaatgtca

SEQ ID NO: 3275 - DNA, 15 bp, Homo sapiens
cacactgtaaatgtc

SEQ ID NO: 3276 - DNA, 15 bp, Homo sapiens
ccacactgtaaatgt

SEQ ID NO: 3277 - DNA, 15 bp, Homo sapiens
accacactgtaaatg

SEQ ID NO: 3278 - DNA, 15 bp, Homo sapiens
aaccacactgtaaat

SEQ ID NO: 3279 - DNA, 15 bp, Homo sapiens
taaccacactgtaaa

SEQ ID NO: 3280 - DNA, 15 bp, Homo sapiens
ctaaccacactgtaa

SEQ ID NO: 3281 - DNA, 15 bp, Homo sapiens
cctaaccacactgta

SEQ ID NO: 3282 - DNA, 15 bp, Homo sapiens
tcctaaccacactgt

SEQ ID NO: 3283 - DNA, 15 bp, Homo sapiens
ctcctaaccacactg

SEQ ID NO: 3284 - DNA, 15 bp, Homo sapiens
actcctaaccacact

SEQ ID NO: 3285 - DNA, 15 bp, Homo sapiens
aactcctaaccacac

SEQ ID NO: 3286 - DNA, 15 bp, Homo sapiens
caactcctaaccaca

SEQ ID NO: 3287 - DNA, 15 bp, Homo sapiens
acaactcctaaccac

SEQ ID NO: 3288 - DNA, 15 bp, Homo sapiens
gacaactcctaacca

SEQ ID NO: 3289 - DNA, 15 bp, Homo sapiens
ggacaactcctaacc

SEQ ID NO: 3290 - DNA, 15 bp, Homo sapiens
gggacaactcctaac

SEQ ID NO: 3291 - DNA, 15 bp, Homo sapiens
tgggacaactcctaa

SEQ ID NO: 3292 - DNA, 15 bp, Homo sapiens
ctgggacaactccta

SEQ ID NO: 3293 - DNA, 15 bp, Homo sapiens
tctgggacaactcct

SEQ ID NO: 3294 - DNA, 15 bp, Homo sapiens
ctctgggacaactcc

SEQ ID NO: 3295 - DNA, 15 bp, Homo sapiens
actctgggacaactc

SEQ ID NO: 3296 - DNA, 15 bp, Homo sapiens
cactctgggacaact

SEQ ID NO: 3297 - DNA, 15 bp, Homo sapiens
acactctgggacaac

SEQ ID NO: 3298 - DNA, 15 bp, Homo sapiens
cacactctgggacaa

SEQ ID NO: 3299 - DNA, 15 bp, Homo sapiens
ccacactctgggaca

SEQ ID NO: 3300 - DNA, 15 bp, Homo sapiens
gccacactctgggac

SEQ ID NO: 3301 - DNA, 15 bp, Homo sapiens
tgccacactctggga

SEQ ID NO: 3302 - DNA, 15 bp, Homo sapiens
atgccacactctggg

SEQ ID NO: 3303 - DNA, 15 bp, Homo sapiens
catgccacactctgg

SEQ ID NO: 3304 - DNA, 15 bp, Homo sapiens
ccatgccacactctg

SEQ ID NO: 3305 - DNA, 15 bp, Homo sapiens
accatgccacactct

SEQ ID NO: 3306 - DNA, 15 bp, Homo sapiens
gaccatgccacactc

SEQ ID NO: 3307 - DNA, 15 bp, Homo sapiens
agaccatgccacact

SEQ ID NO: 3308 - DNA, 15 bp, Homo sapiens
aagaccatgccacac

SEQ ID NO: 3309 - DNA, 15 bp, Homo sapiens
taagaccatgccaca

SEQ ID NO: 3310 - DNA, 15 bp, Homo sapiens
ctaagaccatgccac

SEQ ID NO: 3311 - DNA, 15 bp, Homo sapiens
tctaagaccatgcca

SEQ ID NO: 3312 - DNA, 15 bp, Homo sapiens
ttctaagaccatgcc

SEQ ID NO: 3313 - DNA, 15 bp, Homo sapiens
tttctaagaccatgc

SEQ ID NO: 3314 - DNA, 15 bp, Homo sapiens
atttctaagaccatg

SEQ ID NO: 3315 - DNA, 15 bp, Homo sapiens
aatttctaagaccat

SEQ ID NO: 3316 - DNA, 15 bp, Homo sapiens
gaatttctaagacca

SEQ ID NO: 3317 - DNA, 15 bp, Homo sapiens
agaatttctaagacc

SEQ ID NO: 3318 - DNA, 15 bp, Homo sapiens
aagaatttctaagac

SEQ ID NO: 3319 - DNA, 15 bp, Homo sapiens
caagaatttctaaga

SEQ ID NO: 3320 - DNA, 15 bp, Homo sapiens
acaagaatttctaag

SEQ ID NO: 3321 - DNA, 15 bp, Homo sapiens
cacaagaatttctaa

SEQ ID NO: 3322 - DNA, 15 bp, Homo sapiens
ccacaagaatttcta

SEQ ID NO: 3323 - DNA, 15 bp, Homo sapiens
accacaagaatttct

SEQ ID NO: 3324 - DNA, 15 bp, Homo sapiens
aaccacaagaatttc

SEQ ID NO: 3325 - DNA, 15 bp, Homo sapiens
aaaccacaagaattt

SEQ ID NO: 3326 - DNA, 15 bp, Homo sapiens
taaaccacaagaatt

SEQ ID NO: 3327 - DNA, 15 bp, Homo sapiens
ataaaccacaagaat

SEQ ID NO: 3328 - DNA, 15 bp, Homo sapiens
gataaaccacaagaa

SEQ ID NO: 3329 - DNA, 15 bp, Homo sapiens
tgataaaccacaaga

SEQ ID NO: 3330 - DNA, 15 bp, Homo sapiens
ctgataaaccacaag

SEQ ID NO: 3331 - DNA, 15 bp, Homo sapiens
gctgataaaccacaa

SEQ ID NO: 3332 - DNA, 15 bp, Homo sapiens
agctgataaaccaca

SEQ ID NO: 3333 - DNA, 15 bp, Homo sapiens
aagctgataaaccac

SEQ ID NO: 3334 - DNA, 15 bp, Homo sapiens
aaagctgataaacca

SEQ ID NO: 3335 - DNA, 15 bp, Homo sapiens
aaaagctgataaacc

SEQ ID NO: 3336 - DNA, 15 bp, Homo sapiens
taaaagctgataaac

SEQ ID NO: 3337 - DNA, 15 bp, Homo sapiens
ttaaaagctgataaa

SEQ ID NO: 3338 - DNA, 15 bp, Homo sapiens
attaaaagctgataa

SEQ ID NO: 3339 - DNA, 15 bp, Homo sapiens
tattaaaagctgata

SEQ ID NO: 3340 - DNA, 15 bp, Homo sapiens
atattaaaagctgat

SEQ ID NO: 3341 - DNA, 15 bp, Homo sapiens
gatattaaaagctga

SEQ ID NO: 3342 - DNA, 15 bp, Homo sapiens
tgatattaaaagctg

SEQ ID NO: 3343 - DNA, 15 bp, Homo sapiens
ttgatattaaaagct

SEQ ID NO: 3344 - DNA, 15 bp, Homo sapiens
tttgatattaaaagc

SEQ ID NO: 3345 - DNA, 15 bp, Homo sapiens
ttttgatattaaaag

SEQ ID NO: 3346 - DNA, 15 bp, Homo sapiens
tttttgatattaaaa

SEQ ID NO: 3347 - DNA, 15 bp, Homo sapiens
ctttttgatattaaa

SEQ ID NO: 3348 - DNA, 15 bp, Homo sapiens
actttttgatattaa

SEQ ID NO: 3349 - DNA, 15 bp, Homo sapiens
aactttttgatatta

SEQ ID NO: 3350 - DNA, 15 bp, Homo sapiens
gaactttttgatatt

SEQ ID NO: 3351 - DNA, 15 bp, Homo sapiens
agaactttttgatat

SEQ ID NO: 3352 - DNA, 15 bp, Homo sapiens
aagaactttttgata

SEQ ID NO: 3353 - DNA, 15 bp, Homo sapiens
aaagaactttttgat

SEQ ID NO: 3354 - DNA, 15 bp, Homo sapiens
aaaagaactttttga

SEQ ID NO: 3355 - DNA, 15 bp, Homo sapiens
gaaaagaactttttg

SEQ ID NO: 3356 - DNA, 15 bp, Homo sapiens
agaaaagaacttttt

SEQ ID NO: 3357 - DNA, 15 bp, Homo sapiens
cagaaaagaactttt

SEQ ID NO: 3358 - DNA, 15 bp, Homo sapiens
ccagaaaagaacttt

SEQ ID NO: 3359 - DNA, 15 bp, Homo sapiens
cccagaaaagaactt

SEQ ID NO: 3360 - DNA, 15 bp, Homo sapiens
tcccagaaaagaact

SEQ ID NO: 3361 - DNA, 15 bp, Homo sapiens
ttcccagaaaagaac

SEQ ID NO: 3362 - DNA, 15 bp, Homo sapiens
cttcccagaaaagaa

SEQ ID NO: 3363 - DNA, 15 bp, Homo sapiens
gcttcccagaaaaga

SEQ ID NO: 3364 - DNA, 15 bp, Homo sapiens
ggcttcccagaaaag

SEQ ID NO: 3365 - DNA, 15 bp, Homo sapiens
aggcttcccagaaaa

SEQ ID NO: 3366 - DNA, 15 bp, Homo sapiens
aaggcttcccagaaa

SEQ ID NO: 3367 - DNA, 15 bp, Homo sapiens
aaaggcttcccagaa

SEQ ID NO: 3368 - DNA, 15 bp, Homo sapiens
taaaggcttcccaga

SEQ ID NO: 3369 - DNA, 15 bp, Homo sapiens
ttaaaggcttcccag

SEQ ID NO: 3370 - DNA, 15 bp, Homo sapiens
attaaaggcttccca

SEQ ID NO: 3371 - DNA, 15 bp, Homo sapiens
cattaaaggcttccc

SEQ ID NO: 3372 - DNA, 15 bp, Homo sapiens
acattaaaggcttcc

SEQ ID NO: 3373 - DNA, 15 bp, Homo sapiens
aacattaaaggcttc

SEQ ID NO: 3374 - DNA, 15 bp, Homo sapiens
aaacattaaaggctt

SEQ ID NO: 3375 - DNA, 15 bp, Homo sapiens
aaaacattaaaggct

SEQ ID NO: 3376 - DNA, 15 bp, Homo sapiens
caaaacattaaaggc

SEQ ID NO: 3377 - DNA, 15 bp, Homo sapiens
ccaaaacattaaagg

SEQ ID NO: 3378 - DNA, 15 bp, Homo sapiens
cccaaaacattaaag

SEQ ID NO: 3379 - DNA, 15 bp, Homo sapiens
acccaaaacattaaa

SEQ ID NO: 3380 - DNA, 15 bp, Homo sapiens
aacccaaaacattaa

SEQ ID NO: 3381 - DNA, 15 bp, Homo sapiens
gaacccaaaacatta

SEQ ID NO: 3382 - DNA, 15 bp, Homo sapiens
agaacccaaaacatt

SEQ ID NO: 3383 - DNA, 15 bp, Homo sapiens
aagaacccaaaacat

SEQ ID NO: 3384 - DNA, 15 bp, Homo sapiens
gaagaacccaaaaca

SEQ ID NO: 3385 - DNA, 15 bp, Homo sapiens
ggaagaacccaaaac

SEQ ID NO: 3386 - DNA, 15 bp, Homo sapiens
tggaagaacccaaaa

SEQ ID NO: 3387 - DNA, 15 bp, Homo sapiens
atggaagaacccaaa

SEQ ID NO: 3388 - DNA, 15 bp, Homo sapiens
aatggaagaacccaa

SEQ ID NO: 3389 - DNA, 15 bp, Homo sapiens
caatggaagaaccca

SEQ ID NO: 3390 - DNA, 15 bp, Homo sapiens
acaatggaagaaccc

SEQ ID NO: 3391 - DNA, 15 bp, Homo sapiens
aacaatggaagaacc

SEQ ID NO: 3392 - DNA, 15 bp, Homo sapiens
taacaatggaagaac

SEQ ID NO: 3393 - DNA, 15 bp, Homo sapiens
ataacaatggaagaa

SEQ ID NO: 3394 - DNA, 15 bp, Homo sapiens
gataacaatggaaga

SEQ ID NO: 3395 - DNA, 15 bp, Homo sapiens
cgataacaatggaag

SEQ ID NO: 3396 - DNA, 15 bp, Homo sapiens
acgataacaatggaa

SEQ ID NO: 3397 - DNA, 15 bp, Homo sapiens
cacgataacaatgga

SEQ ID NO: 3398 - DNA, 15 bp, Homo sapiens
acacgataacaatgg

SEQ ID NO: 3399 - DNA, 15 bp, Homo sapiens
aacacgataacaatg

SEQ ID NO: 3400 - DNA, 15 bp, Homo sapiens
caacacgataacaat

SEQ ID NO: 3401 - DNA, 15 bp, Homo sapiens
acaacacgataacaa

SEQ ID NO: 3402 - DNA, 15 bp, Homo sapiens
tacaacacgataaca

SEQ ID NO: 3403 - DNA, 15 bp, Homo sapiens
ttacaacacgataac

SEQ ID NO: 3404 - DNA, 15 bp, Homo sapiens
cttacaacacgataa

SEQ ID NO: 3405 - DNA, 15 bp, Homo sapiens
tcttacaacacgata

SEQ ID NO: 3406 - DNA, 15 bp, Homo sapiens
atcttacaacacgat

SEQ ID NO: 3407 - DNA, 15 bp, Homo sapiens
gatcttacaacacga

SEQ ID NO: 3408 - DNA, 15 bp, Homo sapiens
tgatcttacaacacg

SEQ ID NO: 3409 - DNA, 15 bp, Homo sapiens
atgatcttacaacac

SEQ ID NO: 3410 - DNA, 15 bp, Homo sapiens
tatgatcttacaaca

SEQ ID NO: 3411 - DNA, 15 bp, Homo sapiens
gtatgatcttacaac

SEQ ID NO: 3412 - DNA, 15 bp, Homo sapiens
agtatgatcttacaa

SEQ ID NO: 3413 - DNA, 15 bp, Homo sapiens
tagtatgatcttaca

SEQ ID NO: 3414 - DNA, 15 bp, Homo sapiens
ttagtatgatcttac

SEQ ID NO: 3415 - DNA, 15 bp, Homo sapiens
cttagtatgatctta

SEQ ID NO: 3416 - DNA, 15 bp, Homo sapiens
tcttagtatgatctt

SEQ ID NO: 3417 - DNA, 15 bp, Homo sapiens
atcttagtatgatct

SEQ ID NO: 3418 - DNA, 15 bp, Homo sapiens
catcttagtatgatc

SEQ ID NO: 3419 - DNA, 15 bp, Homo sapiens
tcatcttagtatgat

SEQ ID NO: 3420 - DNA, 15 bp, Homo sapiens
atcatcttagtatga

SEQ ID NO: 3421 - DNA, 15 bp, Homo sapiens
catcatcttagtatg

SEQ ID NO: 3422 - DNA, 15 bp, Homo sapiens
acatcatcttagtat

SEQ ID NO: 3423 - DNA, 15 bp, Homo sapiens
aacatcatcttagta

SEQ ID NO: 3424 - DNA, 15 bp, Homo sapiens
caacatcatcttagt

SEQ ID NO: 3425 - DNA, 15 bp, Homo sapiens
ccaacatcatcttag

SEQ ID NO: 3426 - DNA, 15 bp, Homo sapiens
tccaacatcatctta

SEQ ID NO: 3427 - DNA, 15 bp, Homo sapiens
gtccaacatcatctt

SEQ ID NO: 3428 - DNA, 15 bp, Homo sapiens
agtccaacatcatct

SEQ ID NO: 3429 - DNA, 15 bp, Homo sapiens
gagtccaacatcatc

SEQ ID NO: 3430 - DNA, 15 bp, Homo sapiens
agagtccaacatcat

SEQ ID NO: 3431 - DNA, 15 bp, Homo sapiens
aagagtccaacatca

SEQ ID NO: 3432 - DNA, 15 bp, Homo sapiens
aaagagtccaacatc

SEQ ID NO: 3433 - DNA, 15 bp, Homo sapiens
caaagagtccaacat

SEQ ID NO: 3434 - DNA, 15 bp, Homo sapiens
acaaagagtccaaca

SEQ ID NO: 3435 - DNA, 15 bp, Homo sapiens
tacaaagagtccaac

SEQ ID NO: 3436 - DNA, 15 bp, Homo sapiens
ctacaaagagtccaa

SEQ ID NO: 3437 - DNA, 15 bp, Homo sapiens
actacaaagagtcca

SEQ ID NO: 3438 - DNA, 15 bp, Homo sapiens
gactacaaagagtcc

SEQ ID NO: 3439 - DNA, 15 bp, Homo sapiens
agactacaaagagtc

SEQ ID NO: 3440 - DNA, 15 bp, Homo sapiens
cagactacaaagagt

SEQ ID NO: 3441 - DNA, 15 bp, Homo sapiens
acagactacaaagag

SEQ ID NO: 3442 - DNA, 15 bp, Homo sapiens
tacagactacaaaga

SEQ ID NO: 3443 - DNA, 15 bp, Homo sapiens
ttacagactacaaag

SEQ ID NO: 3444 - DNA, 15 bp, Homo sapiens
tttacagactacaaa

SEQ ID NO: 3445 - DNA, 15 bp, Homo sapiens
atttacagactacaa

SEQ ID NO: 3446 - DNA, 15 bp, Homo sapiens
tatttacagactaca

SEQ ID NO: 3447 - DNA, 15 bp, Homo sapiens
ctatttacagactac

SEQ ID NO: 3448 - DNA, 15 bp, Homo sapiens
tctatttacagacta

SEQ ID NO: 3449 - DNA, 15 bp, Homo sapiens
ttctatttacagact

SEQ ID NO: 3450 - DNA, 15 bp, Homo sapiens
gttctatttacagac

SEQ ID NO: 3451 - DNA, 15 bp, Homo sapiens
agttctatttacaga

SEQ ID NO: 3452 - DNA, 15 bp, Homo sapiens
aagttctatttacag

SEQ ID NO: 3453 - DNA, 15 bp, Homo sapiens
taagttctatttaca

SEQ ID NO: 3454 - DNA, 15 bp, Homo sapiens
gtaagttctatttac

SEQ ID NO: 3455 - DNA, 15 bp, Homo sapiens
tgtaagttctattta

SEQ ID NO: 3456 - DNA, 15 bp, Homo sapiens
ttgtaagttctattt

SEQ ID NO: 3457 - DNA, 15 bp, Homo sapiens
tttgtaagttctatt

SEQ ID NO: 3458 - DNA, 15 bp, Homo sapiens
ttttgtaagttctat

SEQ ID NO: 3459 - DNA, 15 bp, Homo sapiens
cttttgtaagttcta

SEQ ID NO: 3460 - DNA, 15 bp, Homo sapiens
ccttttgtaagttct

SEQ ID NO: 3461 - DNA, 15 bp, Homo sapiens
tccttttgtaagttc

SEQ ID NO: 3462 - DNA, 15 bp, Homo sapiens
ttccttttgtaagtt

SEQ ID NO: 3463 - DNA, 15 bp, Homo sapiens
attccttttgtaagt

SEQ ID NO: 3464 - DNA, 15 bp, Homo sapiens
tattccttttgtaag

SEQ ID NO: 3465 - DNA, 15 bp, Homo sapiens
atattccttttgtaa

SEQ ID NO: 3466 - DNA, 15 bp, Homo sapiens
aatattccttttgta

SEQ ID NO: 3467 - DNA, 15 bp, Homo sapiens
gaatattccttttgt

SEQ ID NO: 3468 - DNA, 15 bp, Homo sapiens
ggaatattccttttg

SEQ ID NO: 3469 - DNA, 15 bp, Homo sapiens
tggaatattcctttt

SEQ ID NO: 3470 - DNA, 15 bp, Homo sapiens
ctggaatattccttt

SEQ ID NO: 3471 - DNA, 15 bp, Homo sapiens
actggaatattcctt

SEQ ID NO: 3472 - DNA, 15 bp, Homo sapiens
aactggaatattcct

SEQ ID NO: 3473 - DNA, 15 bp, Homo sapiens
caactggaatattcc

SEQ ID NO: 3474 - DNA, 15 bp, Homo sapiens
gcaactggaatattc

SEQ ID NO: 3475 - DNA, 15 bp, Homo sapiens
agcaactggaatatt

SEQ ID NO: 3476 - DNA, 15 bp, Homo sapiens
aagcaactggaatat

SEQ ID NO: 3477 - DNA, 15 bp, Homo sapiens
aaagcaactggaata

SEQ ID NO: 3478 - DNA, 15 bp, Homo sapiens
gaaagcaactggaat

SEQ ID NO: 3479 - DNA, 15 bp, Homo sapiens
ggaaagcaactggaa

SEQ ID NO: 3480 - DNA, 15 bp, Homo sapiens
gggaaagcaactgga

SEQ ID NO: 3481 - DNA, 15 bp, Homo sapiens
agggaaagcaactgg

SEQ ID NO: 3482 - DNA, 15 bp, Homo sapiens
aagggaaagcaactg

SEQ ID NO: 3483 - DNA, 15 bp, Homo sapiens
gaagggaaagcaact

SEQ ID NO: 3484 - DNA, 15 bp, Homo sapiens
ggaagggaaagcaac

SEQ ID NO: 3485 - DNA, 15 bp, Homo sapiens
aggaagggaaagcaa

SEQ ID NO: 3486 - DNA, 15 bp, Homo sapiens
caggaagggaaagca

SEQ ID NO: 3487 - DNA, 15 bp, Homo sapiens
ccaggaagggaaagc

SEQ ID NO: 3488 - DNA, 15 bp, Homo sapiens
accaggaagggaaag

SEQ ID NO: 3489 - DNA, 15 bp, Homo sapiens
taccaggaagggaaa

SEQ ID NO: 3490 - DNA, 15 bp, Homo sapiens
ttaccaggaagggaa

SEQ ID NO: 3491 - DNA, 15 bp, Homo sapiens
attaccaggaaggga

SEQ ID NO: 3492 - DNA, 15 bp, Homo sapiens
cattaccaggaaggg

SEQ ID NO: 3493 - DNA, 15 bp, Homo sapiens
ccattaccaggaagg

SEQ ID NO: 3494 - DNA, 15 bp, Homo sapiens
gccattaccaggaag

SEQ ID NO: 3495 - DNA, 15 bp, Homo sapiens
tgccattaccaggaa

SEQ ID NO: 3496 - DNA, 15 bp, Homo sapiens
ttgccattaccagga

SEQ ID NO: 3497 - DNA, 15 bp, Homo sapiens
cttgccattaccagg

SEQ ID NO: 3498 - DNA, 15 bp, Homo sapiens
ccttgccattaccag

SEQ ID NO: 3499 - DNA, 15 bp, Homo sapiens
accttgccattacca

SEQ ID NO: 3500 - DNA, 15 bp, Homo sapiens
caccttgccattacc

SEQ ID NO: 3501 - DNA, 15 bp, Homo sapiens
tcaccttgccattac

SEQ ID NO: 3502 - DNA, 15 bp, Homo sapiens
gtcaccttgccatta

SEQ ID NO: 3503 - DNA, 15 bp, Homo sapiens
tgtcaccttgccatt

SEQ ID NO: 3504 - DNA, 15 bp, Homo sapiens
ctgtcaccttgccat

SEQ ID NO: 3505 - DNA, 15 bp, Homo sapiens
actgtcaccttgcca

SEQ ID NO: 3506 - DNA, 15 bp, Homo sapiens
aactgtcaccttgcc

SEQ ID NO: 3507 - DNA, 15 bp, Homo sapiens
caactgtcaccttgc

SEQ ID NO: 3508 - DNA, 15 bp, Homo sapiens
acaactgtcaccttg

SEQ ID NO: 3509 - DNA, 15 bp, Homo sapiens
aacaactgtcacctt

SEQ ID NO: 3510 - DNA, 15 bp, Homo sapiens
gaacaactgtcacct

SEQ ID NO: 3511 - DNA, 15 bp, Homo sapiens
ggaacaactgtcacc

SEQ ID NO: 3512 - DNA, 15 bp, Homo sapiens
aggaacaactgtcac

SEQ ID NO: 3513 - DNA, 15 bp, Homo sapiens
caggaacaactgtca

SEQ ID NO: 3514 - DNA, 15 bp, Homo sapiens
tcaggaacaactgtc

SEQ ID NO: 3515 - DNA, 15 bp, Homo sapiens
gtcaggaacaactgt

SEQ ID NO: 3516 - DNA, 15 bp, Homo sapiens
cgtcaggaacaactg

SEQ ID NO: 3517 - DNA, 15 bp, Homo sapiens
ccgtcaggaacaact

SEQ ID NO: 3518 - DNA, 15 bp, Homo sapiens
accgtcaggaacaac

SEQ ID NO: 3519 - DNA, 15 bp, Homo sapiens
caccgtcaggaacaa

SEQ ID NO: 3520 - DNA, 15 bp, Homo sapiens
tcaccgtcaggaaca

SEQ ID NO: 3521 - DNA, 15 bp, Homo sapiens
gtcaccgtcaggaac

SEQ ID NO: 3522 - DNA, 15 bp, Homo sapiens
tgtcaccgtcaggaa

SEQ ID NO: 3523 - DNA, 15 bp, Homo sapiens
ttgtcaccgtcagga

SEQ ID NO: 3524 - DNA, 15 bp, Homo sapiens
cttgtcaccgtcagg

SEQ ID NO: 3525 - DNA, 15 bp, Homo sapiens
tcttgtcaccgtcag

SEQ ID NO: 3526 - DNA, 15 bp, Homo sapiens
ttcttgtcaccgtca

SEQ ID NO: 3527 - DNA, 15 bp, Homo sapiens
attcttgtcaccgtc

SEQ ID NO: 3528 - DNA, 15 bp, Homo sapiens
cattcttgtcaccgt

SEQ ID NO: 3529 - DNA, 15 bp, Homo sapiens
tcattcttgtcaccg

SEQ ID NO: 3530 - DNA, 15 bp, Homo sapiens
atcattcttgtcacc

SEQ ID NO: 3531 - DNA, 15 bp, Homo sapiens
catcattcttgtcac

SEQ ID NO: 3532 - DNA, 15 bp, Homo sapiens
tcatcattcttgtca

SEQ ID NO: 3533 - DNA, 15 bp, Homo sapiens
gtcatcattcttgtc

SEQ ID NO: 3534 - DNA, 15 bp, Homo sapiens
cgtcatcattcttgt

SEQ ID NO: 3535 - DNA, 15 bp, Homo sapiens
ccgtcatcattcttg

SEQ ID NO: 3536 - DNA, 15 bp, Homo sapiens
gccgtcatcattctt

SEQ ID NO: 3537 - DNA, 15 bp, Homo sapiens
agccgtcatcattct

SEQ ID NO: 3538 - DNA, 15 bp, Homo sapiens
cagccgtcatcattc

SEQ ID NO: 3539 - DNA, 15 bp, Homo sapiens
acagccgtcatcatt

SEQ ID NO: 3540 - DNA, 15 bp, Homo sapiens
cacagccgtcatcat

SEQ ID NO: 3541 - DNA, 15 bp, Homo sapiens
tcacagccgtcatca

SEQ ID NO: 3542 - DNA, 15 bp, Homo sapiens
atcacagccgtcatc

SEQ ID NO: 3543 - DNA, 15 bp, Homo sapiens
catcacagccgtcat

SEQ ID NO: 3544 - DNA, 15 bp, Homo sapiens
ccatcacagccgtca

SEQ ID NO: 3545 - DNA, 15 bp, Homo sapiens
gccatcacagccgtc

SEQ ID NO: 3546 - DNA, 15 bp, Homo sapiens
tgccatcacagccgt

SEQ ID NO: 3547 - DNA, 15 bp, Homo sapiens
gtgccatcacagccg

SEQ ID NO: 3548 - DNA, 15 bp, Homo sapiens
ggtgccatcacagcc

SEQ ID NO: 3549 - DNA, 15 bp, Homo sapiens
gggtgccatcacagc

SEQ ID NO: 3550 - DNA, 15 bp, Homo sapiens
agggtgccatcacag

SEQ ID NO: 3551 - DNA, 15 bp, Homo sapiens
aagggtgccatcaca

SEQ ID NO: 3552 - DNA, 15 bp, Homo sapiens
caagggtgccatcac

SEQ ID NO: 3553 - DNA, 15 bp, Homo sapiens
acaagggtgccatca

SEQ ID NO: 3554 - DNA, 15 bp, Homo sapiens
aacaagggtgccatc

SEQ ID NO: 3555 - DNA, 15 bp, Homo sapiens
caacaagggtgccat

SEQ ID NO: 3556 - DNA, 15 bp, Homo sapiens
tcaacaagggtgcca

SEQ ID NO: 3557 - DNA, 15 bp, Homo sapiens
gtcaacaagggtgcc

SEQ ID NO: 3558 - DNA, 15 bp, Homo sapiens
ggtcaacaagggtgc

SEQ ID NO: 3559 - DNA, 15 bp, Homo sapiens
tggtcaacaagggtg

SEQ ID NO: 3560 - DNA, 15 bp, Homo sapiens
ttggtcaacaagggt

SEQ ID NO: 3561 - DNA, 15 bp, Homo sapiens
tttggtcaacaaggg

SEQ ID NO: 3562 - DNA, 15 bp, Homo sapiens
atttggtcaacaagg

SEQ ID NO: 3563 - DNA, 15 bp, Homo sapiens
aatttggtcaacaag

SEQ ID NO: 3564 - DNA, 15 bp, Homo sapiens
aaatttggtcaacaa

SEQ ID NO: 3565 - DNA, 15 bp, Homo sapiens
caaatttggtcaaca

SEQ ID NO: 3566 - DNA, 15 bp, Homo sapiens
ccaaatttggtcaac

SEQ ID NO: 3567 - DNA, 15 bp, Homo sapiens
accaaatttggtcaa

SEQ ID NO: 3568 - DNA, 15 bp, Homo sapiens
gaccaaatttggtca

SEQ ID NO: 3569 - DNA, 15 bp, Homo sapiens
tgaccaaatttggtc

SEQ ID NO: 3570 - DNA, 15 bp, Homo sapiens
gtgaccaaatttggt

SEQ ID NO: 3571 - DNA, 15 bp, Homo sapiens
agtgaccaaatttgg

SEQ ID NO: 3572 - DNA, 15 bp, Homo sapiens
cagtgaccaaatttg

SEQ ID NO: 3573 - DNA, 15 bp, Homo sapiens
tcagtgaccaaattt

SEQ ID NO: 3574 - DNA, 15 bp, Homo sapiens
gtcagtgaccaaatt

SEQ ID NO: 3575 - DNA, 15 bp, Homo sapiens
ggtcagtgaccaaat

SEQ ID NO: 3576 - DNA, 15 bp, Homo sapiens
aggtcagtgaccaaa

SEQ ID NO: 3577 - DNA, 15 bp, Homo sapiens
aaggtcagtgaccaa

SEQ ID NO: 3578 - DNA, 15 bp, Homo sapiens
aaaggtcagtgacca

SEQ ID NO: 3579 - DNA, 15 bp, Homo sapiens
taaaggtcagtgacc

SEQ ID NO: 3580 - DNA, 15 bp, Homo sapiens
ctaaaggtcagtgac

SEQ ID NO: 3581 - DNA, 15 bp, Homo sapiens
cctaaaggtcagtga

SEQ ID NO: 3582 - DNA, 15 bp, Homo sapiens
ccctaaaggtcagtg

SEQ ID NO: 3583 - DNA, 15 bp, Homo sapiens
accctaaaggtcagt

SEQ ID NO: 3584 - DNA, 15 bp, Homo sapiens
caccctaaaggtcag

SEQ ID NO: 3585 - DNA, 15 bp, Homo sapiens
ccaccctaaaggtca

SEQ ID NO: 3586 - DNA, 15 bp, Homo sapiens
accaccctaaaggtc

SEQ ID NO: 3587 - DNA, 15 bp, Homo sapiens
taccaccctaaaggt

SEQ ID NO: 3588 - DNA, 15 bp, Homo sapiens
ataccaccctaaagg

SEQ ID NO: 3589 - DNA, 15 bp, Homo sapiens
tataccaccctaaag

SEQ ID NO: 3590 - DNA, 15 bp, Homo sapiens
atataccaccctaaa

SEQ ID NO: 3591 - DNA, 15 bp, Homo sapiens
aatataccaccctaa

SEQ ID NO: 3592 - DNA, 15 bp, Homo sapiens
aaatataccacccta

SEQ ID NO: 3593 - DNA, 15 bp, Homo sapiens
taaatataccaccct

SEQ ID NO: 3594 - DNA, 15 bp, Homo sapiens
ataaatataccaccc

SEQ ID NO: 3595 - DNA, 15 bp, Homo sapiens
gataaatataccacc

SEQ ID NO: 3596 - DNA, 15 bp, Homo sapiens
agataaatataccac

SEQ ID NO: 3597 - DNA, 15 bp, Homo sapiens
tagataaatatacca

SEQ ID NO: 3598 - DNA, 15 bp, Homo sapiens
ttagataaatatacc

SEQ ID NO: 3599 - DNA, 15 bp, Homo sapiens
tttagataaatatac

SEQ ID NO: 3600 - DNA, 15 bp, Homo sapiens
atttagataaatata

SEQ ID NO: 3601 - DNA, 15 bp, Homo sapiens
aatttagataaatat

SEQ ID NO: 3602 - DNA, 15 bp, Homo sapiens
caatttagataaata

SEQ ID NO: 3603 - DNA, 15 bp, Homo sapiens
ccaatttagataaat

SEQ ID NO: 3604 - DNA, 15 bp, Homo sapiens
tccaatttagataaa

SEQ ID NO: 3605 - DNA, 15 bp, Homo sapiens
gtccaatttagataa

SEQ ID NO: 3606 - DNA, 15 bp, Homo sapiens
ggtccaatttagata

SEQ ID NO: 3607 - DNA, 15 bp, Homo sapiens
gggtccaatttagat

SEQ ID NO: 3608 - DNA, 15 bp, Homo sapiens
ggggtccaatttaga

SEQ ID NO: 3609 - DNA, 15 bp, Homo sapiens
aggggtccaatttag

SEQ ID NO: 3610 - DNA, 15 bp, Homo sapiens
caggggtccaattta

SEQ ID NO: 3611 - DNA, 15 bp, Homo sapiens
acaggggtccaattt

SEQ ID NO: 3612 - DNA, 15 bp, Homo sapiens
gacaggggtccaatt

SEQ ID NO: 3613 - DNA, 15 bp, Homo sapiens
agacaggggtccaat

SEQ ID NO: 3614 - DNA, 15 bp, Homo sapiens
aagacaggggtccaa

SEQ ID NO: 3615 - DNA, 15 bp, Homo sapiens
taagacaggggtcca

SEQ ID NO: 3616 - DNA, 15 bp, Homo sapiens
ttaagacaggggtcc

SEQ ID NO: 3617 - DNA, 15 bp, Homo sapiens
cttaagacaggggtc

SEQ ID NO: 3618 - DNA, 15 bp, Homo sapiens
acttaagacaggggt

SEQ ID NO: 3619 - DNA, 15 bp, Homo sapiens
cacttaagacagggg

SEQ ID NO: 3620 - DNA, 15 bp, Homo sapiens
tcacttaagacaggg

SEQ ID NO: 3621 - DNA, 15 bp, Homo sapiens
atcacttaagacagg

SEQ ID NO: 3622 - DNA, 15 bp, Homo sapiens
aatcacttaagacag

SEQ ID NO: 3623 - DNA, 15 bp, Homo sapiens
gaatcacttaagaca

SEQ ID NO: 3624 - DNA, 15 bp, Homo sapiens
agaatcacttaagac

SEQ ID NO: 3625 - DNA, 15 bp, Homo sapiens
aagaatcacttaaga

SEQ ID NO: 3626 - DNA, 15 bp, Homo sapiens
taagaatcacttaag

SEQ ID NO: 3627 - DNA, 15 bp, Homo sapiens
ctaagaatcacttaa

SEQ ID NO: 3628 - DNA, 15 bp, Homo sapiens
cctaagaatcactta

SEQ ID NO: 3629 - DNA, 15 bp, Homo sapiens
acctaagaatcactt

SEQ ID NO: 3630 - DNA, 15 bp, Homo sapiens
aacctaagaatcact

SEQ ID NO: 3631 - DNA, 15 bp, Homo sapiens
caacctaagaatcac

SEQ ID NO: 3632 - DNA, 15 bp, Homo sapiens
tcaacctaagaatca

SEQ ID NO: 3633 - DNA, 15 bp, Homo sapiens
ttcaacctaagaatc

SEQ ID NO: 3634 - DNA, 15 bp, Homo sapiens
tttcaacctaagaat

SEQ ID NO: 3635 - DNA, 15 bp, Homo sapiens
ctttcaacctaagaa

SEQ ID NO: 3636 - DNA, 15 bp, Homo sapiens
tctttcaacctaaga

SEQ ID NO: 3637 - DNA, 15 bp, Homo sapiens
ttctttcaacctaag

SEQ ID NO: 3638 - DNA, 15 bp, Homo sapiens
gttctttcaacctaa

SEQ ID NO: 3639 - DNA, 15 bp, Homo sapiens
tgttctttcaaccta

SEQ ID NO: 3640 - DNA, 15 bp, Homo sapiens
ttgttctttcaacct

SEQ ID NO: 3641 - DNA, 15 bp, Homo sapiens
cttgttctttcaacc

SEQ ID NO: 3642 - DNA, 15 bp, Homo sapiens
ccttgttctttcaac

SEQ ID NO: 3643 - DNA, 15 bp, Homo sapiens
accttgttctttcaa

SEQ ID NO: 3644 - DNA, 15 bp, Homo sapiens
aaccttgttctttca

SEQ ID NO: 3645 - DNA, 15 bp, Homo sapiens
aaaccttgttctttc

SEQ ID NO: 3646 - DNA, 15 bp, Homo sapiens
taaaccttgttcttt

SEQ ID NO: 3647 - DNA, 15 bp, Homo sapiens
ctaaaccttgttctt

SEQ ID NO: 3648 - DNA, 15 bp, Homo sapiens
actaaaccttgttct

SEQ ID NO: 3649 - DNA, 15 bp, Homo sapiens
tactaaaccttgttc

SEQ ID NO: 3650 - DNA, 15 bp, Homo sapiens
gtactaaaccttgtt

SEQ ID NO: 3651 - DNA, 15 bp, Homo sapiens
tgtactaaaccttgt

SEQ ID NO: 3652 - DNA, 15 bp, Homo sapiens
ctgtactaaaccttg

SEQ ID NO: 3653 - DNA, 15 bp, Homo sapiens
actgtactaaacctt

SEQ ID NO: 3654 - DNA, 15 bp, Homo sapiens
aactgtactaaacct

SEQ ID NO: 3655 - DNA, 15 bp, Homo sapiens
caactgtactaaacc

SEQ ID NO: 3656 - DNA, 15 bp, Homo sapiens
ccaactgtactaaac

SEQ ID NO: 3657 - DNA, 15 bp, Homo sapiens
accaactgtactaaa

SEQ ID NO: 3658 - DNA, 15 bp, Homo sapiens
aaccaactgtactaa

SEQ ID NO: 3659 - DNA, 15 bp, Homo sapiens
gaaccaactgtacta

SEQ ID NO: 3660 - DNA, 15 bp, Homo sapiens
agaaccaactgtact

SEQ ID NO: 3661 - DNA, 15 bp, Homo sapiens
tagaaccaactgtac

SEQ ID NO: 3662 - DNA, 15 bp, Homo sapiens
ctagaaccaactgta

SEQ ID NO: 3663 - DNA, 15 bp, Homo sapiens
tctagaaccaactgt

SEQ ID NO: 3664 - DNA, 15 bp, Homo sapiens
atctagaaccaactg

SEQ ID NO: 3665 - DNA, 15 bp, Homo sapiens
gatctagaaccaact

SEQ ID NO: 3666 - DNA, 15 bp, Homo sapiens
agatctagaaccaac

SEQ ID NO: 3667 - DNA, 15 bp, Homo sapiens
aagatctagaaccaa

SEQ ID NO: 3668 - DNA, 15 bp, Homo sapiens
taagatctagaacca

SEQ ID NO: 3669 - DNA, 15 bp, Homo sapiens
ttaagatctagaacc

SEQ ID NO: 3670 - DNA, 15 bp, Homo sapiens
tttaagatctagaac

SEQ ID NO: 3671 - DNA, 15 bp, Homo sapiens
ctttaagatctagaa

SEQ ID NO: 3672 - DNA, 15 bp, Homo sapiens
cctttaagatctaga

SEQ ID NO: 3673 - DNA, 15 bp, Homo sapiens
tcctttaagatctag

SEQ ID NO: 3674 - DNA, 15 bp, Homo sapiens
ttcctttaagatcta

SEQ ID NO: 3675 - DNA, 15 bp, Homo sapiens
tttcctttaagatct

SEQ ID NO: 3676 - DNA, 15 bp, Homo sapiens
ttttcctttaagatc

SEQ ID NO: 3677 - DNA, 15 bp, Homo sapiens
tttttcctttaagat

SEQ ID NO: 3678 - DNA, 15 bp, Homo sapiens
ttttttcctttaaga

SEQ ID NO: 3679 - DNA, 15 bp, Homo sapiens
tttttttcctttaag

SEQ ID NO: 3680 - DNA, 15 bp, Homo sapiens
gtttttttcctttaa

SEQ ID NO: 3681 - DNA, 15 bp, Homo sapiens
ggtttttttccttta

SEQ ID NO: 3682 - DNA, 15 bp, Homo sapiens
tggtttttttccttt

SEQ ID NO: 3683 - DNA, 15 bp, Homo sapiens
ctggtttttttcctt

SEQ ID NO: 3684 - DNA, 15 bp, Homo sapiens
gctggtttttttcct

SEQ ID NO: 3685 - DNA, 15 bp, Homo sapiens
tgctggtttttttcc

SEQ ID NO: 3686 - DNA, 15 bp, Homo sapiens
atgctggtttttttc

SEQ ID NO: 3687 - DNA, 15 bp, Homo sapiens
catgctggttttttt

SEQ ID NO: 3688 - DNA, 15 bp, Homo sapiens
ccatgctggtttttt

SEQ ID NO: 3689 - DNA, 15 bp, Homo sapiens
accatgctggttttt

SEQ ID NO: 3690 - DNA, 15 bp, Homo sapiens
caccatgctggtttt

SEQ ID NO: 3691 - DNA, 15 bp, Homo sapiens
acaccatgctggttt

SEQ ID NO: 3692 - DNA, 15 bp, Homo sapiens
aacaccatgctggtt

SEQ ID NO: 3693 - DNA, 15 bp, Homo sapiens
aaacaccatgctggt

SEQ ID NO: 3694 - DNA, 15 bp, Homo sapiens
aaaacaccatgctgg

SEQ ID NO: 3695 - DNA, 15 bp, Homo sapiens
aaaaacaccatgctg

SEQ ID NO: 3696 - DNA, 15 bp, Homo sapiens
aaaaaacaccatgct

SEQ ID NO: 3697 - DNA, 15 bp, Homo sapiens
gaaaaaacaccatgc

SEQ ID NO: 3698 - DNA, 15 bp, Homo sapiens
agaaaaaacaccatg

SEQ ID NO: 3699 - DNA, 15 bp, Homo sapiens
aagaaaaaacaccat

SEQ ID NO: 3700 - DNA, 15 bp, Homo sapiens
caagaaaaaacacca

SEQ ID NO: 3701 - DNA, 15 bp, Homo sapiens
acaagaaaaaacacc

SEQ ID NO: 3702 - DNA, 15 bp, Homo sapiens
aacaagaaaaaacac

SEQ ID NO: 3703 - DNA, 15 bp, Homo sapiens
gaacaagaaaaaaca

SEQ ID NO: 3704 - DNA, 15 bp, Homo sapiens
agaacaagaaaaaac

SEQ ID NO: 3705 - DNA, 15 bp, Homo sapiens
cagaacaagaaaaaa

SEQ ID NO: 3706 - DNA, 15 bp, Homo sapiens
acagaacaagaaaaa

SEQ ID NO: 3707 - DNA, 15 bp, Homo sapiens
cacagaacaagaaaa

SEQ ID NO: 3708 - DNA, 15 bp, Homo sapiens
acacagaacaagaaa

SEQ ID NO: 3709 - DNA, 15 bp, Homo sapiens
cacacagaacaagaa

SEQ ID NO: 3710 - DNA, 15 bp, Homo sapiens
acacacagaacaaga

SEQ ID NO: 3711 - DNA, 15 bp, Homo sapiens
cacacacagaacaag

SEQ ID NO: 3712 - DNA, 15 bp, Homo sapiens
gcacacacagaacaa

SEQ ID NO: 3713 - DNA, 15 bp, Homo sapiens
agcacacacagaaca

SEQ ID NO: 3714 - DNA, 15 bp, Homo sapiens
aagcacacacagaac

SEQ ID NO: 3715 - DNA, 15 bp, Homo sapiens
taagcacacacagaa

SEQ ID NO: 3716 - DNA, 15 bp, Homo sapiens
gtaagcacacacaga

SEQ ID NO: 3717 - DNA, 15 bp, Homo sapiens
ggtaagcacacacag

SEQ ID NO: 3718 - DNA, 15 bp, Homo sapiens
gggtaagcacacaca

SEQ ID NO: 3719 - DNA, 15 bp, Homo sapiens
tgggtaagcacacac

SEQ ID NO: 3720 - DNA, 15 bp, Homo sapiens
gtgggtaagcacaca

SEQ ID NO: 3721 - DNA, 15 bp, Homo sapiens
agtgggtaagcacac

SEQ ID NO: 3722 - DNA, 15 bp, Homo sapiens
aagtgggtaagcaca

SEQ ID NO: 3723 - DNA, 15 bp, Homo sapiens
caagtgggtaagcac

SEQ ID NO: 3724 - DNA, 15 bp, Homo sapiens
tcaagtgggtaagca

SEQ ID NO: 3725 - DNA, 15 bp, Homo sapiens
ctcaagtgggtaagc

SEQ ID NO: 3726 - DNA, 15 bp, Homo sapiens
actcaagtgggtaag

SEQ ID NO: 3727 - DNA, 15 bp, Homo sapiens
cactcaagtgggtaa

SEQ ID NO: 3728 - DNA, 15 bp, Homo sapiens
gcactcaagtgggta

SEQ ID NO: 3729 - DNA, 15 bp, Homo sapiens
agcactcaagtgggt

SEQ ID NO: 3730 - DNA, 15 bp, Homo sapiens
tagcactcaagtggg

SEQ ID NO: 3731 - DNA, 15 bp, Homo sapiens
atagcactcaagtgg

SEQ ID NO: 3732 - DNA, 15 bp, Homo sapiens
tatagcactcaagtg

SEQ ID NO: 3733 - DNA, 15 bp, Homo sapiens
atatagcactcaagt

SEQ ID NO: 3734 - DNA, 15 bp, Homo sapiens
catatagcactcaag

SEQ ID NO: 3735 - DNA, 15 bp, Homo sapiens
ccatatagcactcaa

SEQ ID NO: 3736 - DNA, 15 bp, Homo sapiens
accatatagcactca

SEQ ID NO: 3737 - DNA, 15 bp, Homo sapiens
aaccatatagcactc

SEQ ID NO: 3738 - DNA, 15 bp, Homo sapiens
caaccatatagcact

SEQ ID NO: 3739 - DNA, 15 bp, Homo sapiens
gcaaccatatagcac

SEQ ID NO: 3740 - DNA, 15 bp, Homo sapiens
agcaaccatatagca

SEQ ID NO: 3741 - DNA, 15 bp, Homo sapiens
tagcaaccatatagc

SEQ ID NO: 3742 - DNA, 15 bp, Homo sapiens
ttagcaaccatatag

SEQ ID NO: 3743 - DNA, 15 bp, Homo sapiens
cttagcaaccatata

SEQ ID NO: 3744 - DNA, 15 bp, Homo sapiens
tcttagcaaccatat

SEQ ID NO: 3745 - DNA, 15 bp, Homo sapiens
ttcttagcaaccata

SEQ ID NO: 3746 - DNA, 15 bp, Homo sapiens
tttcttagcaaccat

SEQ ID NO: 3747 - DNA, 15 bp, Homo sapiens
gtttcttagcaacca

SEQ ID NO: 3748 - DNA, 15 bp, Homo sapiens
agtttcttagcaacc

SEQ ID NO: 3749 - DNA, 15 bp, Homo sapiens
tagtttcttagcaac

SEQ ID NO: 3750 - DNA, 15 bp, Homo sapiens
ctagtttcttagcaa

SEQ ID NO: 3751 - DNA, 15 bp, Homo sapiens
actagtttcttagca

SEQ ID NO: 3752 - DNA, 15 bp, Homo sapiens
cactagtttcttagc

SEQ ID NO: 3753 - DNA, 15 bp, Homo sapiens
tcactagtttcttag

SEQ ID NO: 3754 - DNA, 15 bp, Homo sapiens
ttcactagtttctta

SEQ ID NO: 3755 - DNA, 15 bp, Homo sapiens
tttcactagtttctt

SEQ ID NO: 3756 - DNA, 15 bp, Homo sapiens
atttcactagtttct

SEQ ID NO: 3757 - DNA, 15 bp, Homo sapiens
catttcactagtttc

SEQ ID NO: 3758 - DNA, 15 bp, Homo sapiens
gcatttcactagttt

SEQ ID NO: 3759 - DNA, 15 bp, Homo sapiens
tgcatttcactagtt

SEQ ID NO: 3760 - DNA, 15 bp, Homo sapiens
ttgcatttcactagt

SEQ ID NO: 3761 - DNA, 15 bp, Homo sapiens
tttgcatttcactag

SEQ ID NO: 3762 - DNA, 15 bp, Homo sapiens
ctttgcatttcacta

SEQ ID NO: 3763 - DNA, 15 bp, Homo sapiens
tctttgcatttcact

SEQ ID NO: 3764 - DNA, 15 bp, Homo sapiens
ttctttgcatttcac

SEQ ID NO: 3765 - DNA, 15 bp, Homo sapiens
gttctttgcatttca

SEQ ID NO: 3766 - DNA, 15 bp, Homo sapiens
agttctttgcatttc

SEQ ID NO: 3767 - DNA, 15 bp, Homo sapiens
tagttctttgcattt

SEQ ID NO: 3768 - DNA, 15 bp, Homo sapiens
gtagttctttgcatt

SEQ ID NO: 3769 - DNA, 15 bp, Homo sapiens
tgtagttctttgcat

SEQ ID NO: 3770 - DNA, 15 bp, Homo sapiens
ctgtagttctttgca

SEQ ID NO: 3771 - DNA, 15 bp, Homo sapiens
gctgtagttctttgc

SEQ ID NO: 3772 - DNA, 15 bp, Homo sapiens
tgctgtagttctttg

SEQ ID NO: 3773 - DNA, 15 bp, Homo sapiens
ctgctgtagttcttt

SEQ ID NO: 3774 - DNA, 15 bp, Homo sapiens
tctgctgtagttctt

SEQ ID NO: 3775 - DNA, 15 bp, Homo sapiens
ttctgctgtagttct

SEQ ID NO: 3776 - DNA, 15 bp, Homo sapiens
tttctgctgtagttc

SEQ ID NO: 3777 - DNA, 15 bp, Homo sapiens
ttttctgctgtagtt

SEQ ID NO: 3778 - DNA, 15 bp, Homo sapiens
tttttctgctgtagt

SEQ ID NO: 3779 - DNA, 15 bp, Homo sapiens
ctttttctgctgtag

SEQ ID NO: 3780 - DNA, 15 bp, Homo sapiens
cctttttctgctgta

SEQ ID NO: 3781 - DNA, 15 bp, Homo sapiens
ccctttttctgctgt

SEQ ID NO: 3782 - DNA, 15 bp, Homo sapiens
accctttttctgctg

SEQ ID NO: 3783 - DNA, 15 bp, Homo sapiens
caccctttttctgct

SEQ ID NO: 3784 - DNA, 15 bp, Homo sapiens
acaccctttttctgc

SEQ ID NO: 3785 - DNA, 15 bp, Homo sapiens
aacaccctttttctg

SEQ ID NO: 3786 - DNA, 15 bp, Homo sapiens
caacaccctttttct

SEQ ID NO: 3787 - DNA, 15 bp, Homo sapiens
ccaacaccctttttc

SEQ ID NO: 3788 - DNA, 15 bp, Homo sapiens
cccaacacccttttt

SEQ ID NO: 3789 - DNA, 15 bp, Homo sapiens
ccccaacaccctttt

SEQ ID NO: 3790 - DNA, 15 bp, Homo sapiens
accccaacacccttt

SEQ ID NO: 3791 - DNA, 15 bp, Homo sapiens
caccccaacaccctt

SEQ ID NO: 3792 - DNA, 15 bp, Homo sapiens
ccaccccaacaccct

SEQ ID NO: 3793 - DNA, 15 bp, Homo sapiens
gccaccccaacaccc

SEQ ID NO: 3794 - DNA, 15 bp, Homo sapiens
tgccaccccaacacc

SEQ ID NO: 3795 - DNA, 15 bp, Homo sapiens
ttgccaccccaacac

SEQ ID NO: 3796 - DNA, 15 bp, Homo sapiens
cttgccaccccaaca

SEQ ID NO: 3797 - DNA, 15 bp, Homo sapiens
acttgccaccccaac

SEQ ID NO: 3798 - DNA, 15 bp, Homo sapiens
tacttgccaccccaa

SEQ ID NO: 3799 - DNA, 15 bp, Homo sapiens
atacttgccacccca

SEQ ID NO: 3800 - DNA, 15 bp, Homo sapiens
tatacttgccacccc

SEQ ID NO: 3801 - DNA, 15 bp, Homo sapiens
atatacttgccaccc

SEQ ID NO: 3802 - DNA, 15 bp, Homo sapiens
aatatacttgccacc

SEQ ID NO: 3803 - DNA, 15 bp, Homo sapiens
aaatatacttgccac

SEQ ID NO: 3804 - DNA, 15 bp, Homo sapiens
gaaatatacttgcca

SEQ ID NO: 3805 - DNA, 15 bp, Homo sapiens
agaaatatacttgcc

SEQ ID NO: 3806 - DNA, 15 bp, Homo sapiens
tagaaatatacttgc

SEQ ID NO: 3807 - DNA, 15 bp, Homo sapiens
ctagaaatatacttg

SEQ ID NO: 3808 - DNA, 15 bp, Homo sapiens
cctagaaatatactt

SEQ ID NO: 3809 - DNA, 15 bp, Homo sapiens
acctagaaatatact

SEQ ID NO: 3810 - DNA, 15 bp, Homo sapiens
aacctagaaatatac

SEQ ID NO: 3811 - DNA, 15 bp, Homo sapiens
aaacctagaaatata

SEQ ID NO: 3812 - DNA, 15 bp, Homo sapiens
aaaacctagaaatat

SEQ ID NO: 3813 - DNA, 15 bp, Homo sapiens
aaaaacctagaaata

SEQ ID NO: 3814 - DNA, 15 bp, Homo sapiens
taaaaacctagaaat

SEQ ID NO: 3815 - DNA, 15 bp, Homo sapiens
ttaaaaacctagaaa

SEQ ID NO: 3816 - DNA, 15 bp, Homo sapiens
gttaaaaacctagaa

SEQ ID NO: 3817 - DNA, 15 bp, Homo sapiens
agttaaaaacctaga

SEQ ID NO: 3818 - DNA, 15 bp, Homo sapiens
aagttaaaaacctag

SEQ ID NO: 3819 - DNA, 15 bp, Homo sapiens
aaagttaaaaaccta

SEQ ID NO: 3820 - DNA, 15 bp, Homo sapiens
aaaagttaaaaacct

SEQ ID NO: 3821 - DNA, 15 bp, Homo sapiens
aaaaagttaaaaacc

SEQ ID NO: 3822 - DNA, 15 bp, Homo sapiens
aaaaaagttaaaaac

SEQ ID NO: 3823 - DNA, 15 bp, Homo sapiens
aaaaaaagttaaaaa

SEQ ID NO: 3824 - DNA, 15 bp, Homo sapiens
aaaaaaaagttaaaa

SEQ ID NO: 3825 - DNA, 15 bp, Homo sapiens
taaaaaaaagttaaa

SEQ ID NO: 3826 - DNA, 15 bp, Homo sapiens
ttaaaaaaaagttaa

SEQ ID NO: 3827 - DNA, 15 bp, Homo sapiens
tttaaaaaaaagtta

SEQ ID NO: 3828 - DNA, 15 bp, Homo sapiens
atttaaaaaaaagtt

SEQ ID NO: 3829 - DNA, 15 bp, Homo sapiens
catttaaaaaaaagt

SEQ ID NO: 3830 - DNA, 15 bp, Homo sapiens
acatttaaaaaaaag

SEQ ID NO: 3831 - DNA, 15 bp, Homo sapiens
aacatttaaaaaaaa

SEQ ID NO: 3832 - DNA, 15 bp, Homo sapiens
gaacatttaaaaaaa

SEQ ID NO: 3833 - DNA, 15 bp, Homo sapiens
cgaacatttaaaaaa

SEQ ID NO: 3834 - DNA, 15 bp, Homo sapiens
ccgaacatttaaaaa

SEQ ID NO: 3835 - DNA, 15 bp, Homo sapiens
accgaacatttaaaa

SEQ ID NO: 3836 - DNA, 15 bp, Homo sapiens
taccgaacatttaaa

SEQ ID NO: 3837 - DNA, 15 bp, Homo sapiens
ataccgaacatttaa

SEQ ID NO: 3838 - DNA, 15 bp, Homo sapiens
aataccgaacattta

SEQ ID NO: 3839 - DNA, 15 bp, Homo sapiens
taataccgaacattt

SEQ ID NO: 3840 - DNA, 15 bp, Homo sapiens
ttaataccgaacatt

SEQ ID NO: 3841 - DNA, 15 bp, Homo sapiens
attaataccgaacat

SEQ ID NO: 3842 - DNA, 15 bp, Homo sapiens
aattaataccgaaca

SEQ ID NO: 3843 - DNA, 15 bp, Homo sapiens
aaattaataccgaac

SEQ ID NO: 3844 - DNA, 15 bp, Homo sapiens
aaaattaataccgaa

SEQ ID NO: 3845 - DNA, 15 bp, Homo sapiens
aaaaattaataccga

SEQ ID NO: 3846 - DNA, 15 bp, Homo sapiens
aaaaaattaataccg

SEQ ID NO: 3847 - DNA, 15 bp, Homo sapiens
caaaaaattaatacc

SEQ ID NO: 3848 - DNA, 15 bp, Homo sapiens
acaaaaaattaatac

SEQ ID NO: 3849 - DNA, 15 bp, Homo sapiens
aacaaaaaattaata

SEQ ID NO: 3850 - DNA, 15 bp, Homo sapiens
caacaaaaaattaat

SEQ ID NO: 3851 - DNA, 15 bp, Homo sapiens
gcaacaaaaaattaa

SEQ ID NO: 3852 - DNA, 15 bp, Homo sapiens
tgcaacaaaaaatta

SEQ ID NO: 3853 - DNA, 15 bp, Homo sapiens
atgcaacaaaaaatt

SEQ ID NO: 3854 - DNA, 15 bp, Homo sapiens
aatgcaacaaaaaat

SEQ ID NO: 3855 - DNA, 15 bp, Homo sapiens
aaatgcaacaaaaaa

SEQ ID NO: 3856 - DNA, 15 bp, Homo sapiens
aaaatgcaacaaaaa

SEQ ID NO: 3857 - DNA, 15 bp, Homo sapiens
aaaaatgcaacaaaa

SEQ ID NO: 3858 - DNA, 15 bp, Homo sapiens
aaaaaatgcaacaaa

SEQ ID NO: 3859 - DNA, 15 bp, Homo sapiens
aaaaaaatgcaacaa

SEQ ID NO: 3860 - DNA, 15 bp, Homo sapiens
aaaaaaaatgcaaca

SEQ ID NO: 3861 - DNA, 15 bp, Homo sapiens
gaaaaaaaatgcaac

SEQ ID NO: 3862 - DNA, 15 bp, Homo sapiens
agaaaaaaaatgcaa

SEQ ID NO: 3863 - DNA, 15 bp, Homo sapiens
caagaaaaaaaatgc

SEQ ID NO: 3864 - DNA, 15 bp, Homo sapiens
ccaagaaaaaaaatg

SEQ ID NO: 3865 - DNA, 15 bp, Homo sapiens
cccaagaaaaaaaat

SEQ ID NO: 3866 - DNA, 15 bp, Homo sapiens
gcccaagaaaaaaaa

SEQ ID NO: 3867 - DNA, 15 bp, Homo sapiens
tgcccaagaaaaaaa

SEQ ID NO: 3868 - DNA, 15 bp, Homo sapiens
ctgcccaagaaaaaa

SEQ ID NO: 3869 - DNA, 15 bp, Homo sapiens
actgcccaagaaaaa

SEQ ID NO: 3870 - DNA, 15 bp, Homo sapiens
tactgcccaagaaaa

SEQ ID NO: 3871 - DNA, 15 bp, Homo sapiens
ctactgcccaagaaa

SEQ ID NO: 3872 - DNA, 15 bp, Homo sapiens
tctactgcccaagaa

SEQ ID NO: 3873 - DNA, 15 bp, Homo sapiens
atctactgcccaaga

SEQ ID NO: 3874 - DNA, 15 bp, Homo sapiens
aatctactgcccaag

SEQ ID NO: 3875 - DNA, 15 bp, Homo sapiens
caatctactgcccaa

SEQ ID NO: 3876 - DNA, 15 bp, Homo sapiens
gcaatctactgccca

SEQ ID NO: 3877 - DNA, 15 bp, Homo sapiens
agcaatctactgccc

SEQ ID NO: 3878 - DNA, 15 bp, Homo sapiens
aagcaatctactgcc

SEQ ID NO: 3879 - DNA, 15 bp, Homo sapiens
caagcaatctactgc

SEQ ID NO: 3880 - DNA, 15 bp, Homo sapiens
gcaagcaatctactg

SEQ ID NO: 3881 - DNA, 15 bp, Homo sapiens
agcaagcaatctact

SEQ ID NO: 3882 - DNA, 15 bp, Homo sapiens
tagcaagcaatctac

SEQ ID NO: 3883 - DNA, 15 bp, Homo sapiens
ctagcaagcaatcta

SEQ ID NO: 3884 - DNA, 15 bp, Homo sapiens
actagcaagcaatct

SEQ ID NO: 3885 - DNA, 15 bp, Homo sapiens
aactagcaagcaatc

SEQ ID NO: 3886 - DNA, 15 bp, Homo sapiens
aaactagcaagcaat

SEQ ID NO: 3887 - DNA, 15 bp, Homo sapiens
aaaactagcaagcaa

SEQ ID NO: 3888 - DNA, 15 bp, Homo sapiens
gaaaactagcaagca

SEQ ID NO: 3889 - DNA, 15 bp, Homo sapiens
ggaaaactagcaagc

SEQ ID NO: 3890 - DNA, 15 bp, Homo sapiens
aggaaaactagcaag

SEQ ID NO: 3891 - DNA, 15 bp, Homo sapiens
taggaaaactagcaa

SEQ ID NO: 3892 - DNA, 15 bp, Homo sapiens
ttaggaaaactagca

SEQ ID NO: 3893 - DNA, 15 bp, Homo sapiens
tttaggaaaactagc

SEQ ID NO: 3894 - DNA, 15 bp, Homo sapiens
ttttaggaaaactag

SEQ ID NO: 3895 - DNA, 15 bp, Homo sapiens
tttttaggaaaacta

SEQ ID NO: 3896 - DNA, 15 bp, Homo sapiens
atttttaggaaaact

SEQ ID NO: 3897 - DNA, 15 bp, Homo sapiens
catttttaggaaaac

SEQ ID NO: 3898 - DNA, 15 bp, Homo sapiens
ccatttttaggaaaa

SEQ ID NO: 3899 - DNA, 15 bp, Homo sapiens
accatttttaggaaa

SEQ ID NO: 3900 - DNA, 15 bp, Homo sapiens
gaccatttttaggaa

SEQ ID NO: 3901 - DNA, 15 bp, Homo sapiens
tgaccatttttagga

SEQ ID NO: 3902 - DNA, 15 bp, Homo sapiens
ctgaccatttttagg

SEQ ID NO: 3903 - DNA, 15 bp, Homo sapiens
cctgaccatttttag

SEQ ID NO: 3904 - DNA, 15 bp, Homo sapiens
tcctgaccattttta

SEQ ID NO: 3905 - DNA, 15 bp, Homo sapiens
ttcctgaccattttt

SEQ ID NO: 3906 - DNA, 15 bp, Homo sapiens
attcctgaccatttt

SEQ ID NO: 3907 - DNA, 15 bp, Homo sapiens
tattcctgaccattt

SEQ ID NO: 3908 - DNA, 15 bp, Homo sapiens
ctattcctgaccatt

SEQ ID NO: 3909 - DNA, 15 bp, Homo sapiens
cctattcctgaccat

SEQ ID NO: 3910 - DNA, 15 bp, Homo sapiens
tcctattcctgacca

SEQ ID NO: 3911 - DNA, 15 bp, Homo sapiens
gtcctattcctgacc

SEQ ID NO: 3912 - DNA, 15 bp, Homo sapiens
tgtcctattcctgac

SEQ ID NO: 3913 - DNA, 15 bp, Homo sapiens
gtgtcctattcctga

SEQ ID NO: 3914 - DNA, 15 bp, Homo sapiens
tgtgtcctattcctg

SEQ ID NO: 3915 - DNA, 15 bp, Homo sapiens
ctgtgtcctattcct

SEQ ID NO: 3916 - DNA, 15 bp, Homo sapiens
tctgtgtcctattcc

SEQ ID NO: 3917 - DNA, 15 bp, Homo sapiens
atctgtgtcctattc

SEQ ID NO: 3918 - DNA, 15 bp, Homo sapiens
catctgtgtcctatt

SEQ ID NO: 3919 - DNA, 15 bp, Homo sapiens
acatctgtgtcctat

SEQ ID NO: 3920 - DNA, 15 bp, Homo sapiens
aacatctgtgtccta

SEQ ID NO: 3921 - DNA, 15 bp, Homo sapiens
gaacatctgtgtcct

SEQ ID NO: 3922 - DNA, 15 bp, Homo sapiens
ggaacatctgtgtcc

SEQ ID NO: 3923 - DNA, 15 bp, Homo sapiens
aggaacatctgtgtc

SEQ ID NO: 3924 - DNA, 15 bp, Homo sapiens
taggaacatctgtgt

SEQ ID NO: 3925 - DNA, 15 bp, Homo sapiens
ttaggaacatctgtg

SEQ ID NO: 3926 - DNA, 15 bp, Homo sapiens
attaggaacatctgt

SEQ ID NO: 3927 - DNA, 15 bp, Homo sapiens
aattaggaacatctg

SEQ ID NO: 3928 - DNA, 15 bp, Homo sapiens
gaattaggaacatct

SEQ ID NO: 3929 - DNA, 15 bp, Homo sapiens
agaattaggaacatc

SEQ ID NO: 3930 - DNA, 15 bp, Homo sapiens
tagaattaggaacat

SEQ ID NO: 3931 - DNA, 15 bp, Homo sapiens
ttagaattaggaaca

SEQ ID NO: 3932 - DNA, 15 bp, Homo sapiens
attagaattaggaac

SEQ ID NO: 3933 - DNA, 15 bp, Homo sapiens
tattagaattaggaa

SEQ ID NO: 3934 - DNA, 15 bp, Homo sapiens
ctattagaattagga

SEQ ID NO: 3935 - DNA, 15 bp, Homo sapiens
gctattagaattagg

SEQ ID NO: 3936 - DNA, 15 bp, Homo sapiens
tgctattagaattag

SEQ ID NO: 3937 - DNA, 15 bp, Homo sapiens
atgctattagaatta

SEQ ID NO: 3938 - DNA, 15 bp, Homo sapiens
catgctattagaatt

SEQ ID NO: 3939 - DNA, 15 bp, Homo sapiens
tcatgctattagaat

SEQ ID NO: 3940 - DNA, 15 bp, Homo sapiens
ctcatgctattagaa

SEQ ID NO: 3941 - DNA, 15 bp, Homo sapiens
tctcatgctattaga

SEQ ID NO: 3942 - DNA, 15 bp, Homo sapiens
atctcatgctattag

SEQ ID NO: 3943 - DNA, 15 bp, Homo sapiens
catctcatgctatta

SEQ ID NO: 3944 - DNA, 15 bp, Homo sapiens
gcatctcatgctatt

SEQ ID NO: 3945 - DNA, 15 bp, Homo sapiens
ggcatctcatgctat

SEQ ID NO: 3946 - DNA, 15 bp, Homo sapiens
aggcatctcatgcta

SEQ ID NO: 3947 - DNA, 15 bp, Homo sapiens
aaggcatctcatgct

SEQ ID NO: 3948 - DNA, 15 bp, Homo sapiens
aaaggcatctcatgc

SEQ ID NO: 3949 - DNA, 15 bp, Homo sapiens
aaaaggcatctcatg

SEQ ID NO: 3950 - DNA, 15 bp, Homo sapiens
taaaaggcatctcat

SEQ ID NO: 3951 - DNA, 15 bp, Homo sapiens
ataaaaggcatctca

SEQ ID NO: 3952 - DNA, 15 bp, Homo sapiens
aataaaaggcatctc

SEQ ID NO: 3953 - DNA, 15 bp, Homo sapiens
gaataaaaggcatct

SEQ ID NO: 3954 - DNA, 15 bp, Homo sapiens
agaataaaaggcatc

SEQ ID NO: 3955 - DNA, 15 bp, Homo sapiens
aagaataaaaggcat

SEQ ID NO: 3956 - DNA, 15 bp, Homo sapiens
caagaataaaaggca

SEQ ID NO: 3957 - DNA, 15 bp, Homo sapiens
tcaagaataaaaggc

SEQ ID NO: 3958 - DNA, 15 bp, Homo sapiens
ttcaagaataaaagg

SEQ ID NO: 3959 - DNA, 15 bp, Homo sapiens
attcaagaataaaag

SEQ ID NO: 3960 - DNA, 15 bp, Homo sapiens
aattcaagaataaaa

SEQ ID NO: 3961 - DNA, 15 bp, Homo sapiens
taattcaagaataaa

SEQ ID NO: 3962 - DNA, 15 bp, Homo sapiens
gtaattcaagaataa

SEQ ID NO: 3963 - DNA, 15 bp, Homo sapiens
cgtaattcaagaata

SEQ ID NO: 3964 - DNA, 15 bp, Homo sapiens
acgtaattcaagaat

SEQ ID NO: 3965 - DNA, 15 bp, Homo sapiens
aacgtaattcaagaa

SEQ ID NO: 3966 - DNA, 15 bp, Homo sapiens
taacgtaattcaaga

SEQ ID NO: 3967 - DNA, 15 bp, Homo sapiens
ataacgtaattcaag

SEQ ID NO: 3968 - DNA, 15 bp, Homo sapiens
aataacgtaattcaa

SEQ ID NO: 3969 - DNA, 15 bp, Homo sapiens
gaataacgtaattca

SEQ ID NO: 3970 - DNA, 15 bp, Homo sapiens
agaataacgtaattc

SEQ ID NO: 3971 - DNA, 15 bp, Homo sapiens
aagaataacgtaatt

SEQ ID NO: 3972 - DNA, 15 bp, Homo sapiens
taagaataacgtaat

SEQ ID NO: 3973 - DNA, 15 bp, Homo sapiens
gtaagaataacgtaa

SEQ ID NO: 3974 - DNA, 15 bp, Homo sapiens
tgtaagaataacgta

SEQ ID NO: 3975 - DNA, 15 bp, Homo sapiens
ttgtaagaataacgt

SEQ ID NO: 3976 - DNA, 15 bp, Homo sapiens
tttgtaagaataacg

SEQ ID NO: 3977 - DNA, 15 bp, Homo sapiens
ttttgtaagaataac

SEQ ID NO: 3978 - DNA, 15 bp, Homo sapiens
tttttgtaagaataa

SEQ ID NO: 3979 - DNA, 15 bp, Homo sapiens
gtttttgtaagaata

SEQ ID NO: 3980 - DNA, 15 bp, Homo sapiens
ggtttttgtaagaat

SEQ ID NO: 3981 - DNA, 15 bp, Homo sapiens
tggtttttgtaagaa

SEQ ID NO: 3982 - DNA, 15 bp, Homo sapiens
gtggtttttgtaaga

SEQ ID NO: 3983 - DNA, 15 bp, Homo sapiens
cgtggtttttgtaag

SEQ ID NO: 3984 - DNA, 15 bp, Homo sapiens
tcgtggtttttgtaa

SEQ ID NO: 3985 - DNA, 15 bp, Homo sapiens
atcgtggtttttgta

SEQ ID NO: 3986 - DNA, 15 bp, Homo sapiens
tatcgtggtttttgt

SEQ ID NO: 3987 - DNA, 15 bp, Homo sapiens
ttatcgtggtttttg

SEQ ID NO: 3988 - DNA, 15 bp, Homo sapiens
cttatcgtggttttt

SEQ ID NO: 3989 - DNA, 15 bp, Homo sapiens
acttatcgtggtttt

SEQ ID NO: 3990 - DNA, 15 bp, Homo sapiens
cacttatcgtggttt

SEQ ID NO: 3991 - DNA, 15 bp, Homo sapiens
tcacttatcgtggtt

SEQ ID NO: 3992 - DNA, 15 bp, Homo sapiens
ttcacttatcgtggt

SEQ ID NO: 3993 - DNA, 15 bp, Homo sapiens
tttcacttatcgtgg

SEQ ID NO: 3994 - DNA, 15 bp, Homo sapiens
atttcacttatcgtg

SEQ ID NO: 3995 - DNA, 15 bp, Homo sapiens
aatttcacttatcgt

SEQ ID NO: 3996 - DNA, 15 bp, Homo sapiens
gaatttcacttatcg

SEQ ID NO: 3997 - DNA, 15 bp, Homo sapiens
tgaatttcacttatc

SEQ ID NO: 3998 - DNA, 15 bp, Homo sapiens
gtgaatttcacttat

SEQ ID NO: 3999 - DNA, 15 bp, Homo sapiens
ggtgaatttcactta

SEQ ID NO: 4000 - DNA, 15 bp, Homo sapiens
gggtgaatttcactt

SEQ ID NO: 4001 - DNA, 15 bp, Homo sapiens
tgggtgaatttcact

SEQ ID NO: 4002 - DNA, 15 bp, Homo sapiens
ctgggtgaatttcac

SEQ ID NO: 4003 - DNA, 15 bp, Homo sapiens
actgggtgaatttca

SEQ ID NO: 4004 - DNA, 15 bp, Homo sapiens
cactgggtgaatttc

SEQ ID NO: 4005 - DNA, 15 bp, Homo sapiens
gcactgggtgaattt

SEQ ID NO: 4006 - DNA, 15 bp, Homo sapiens
tgcactgggtgaatt

SEQ ID NO: 4007 - DNA, 15 bp, Homo sapiens
ctgcactgggtgaat

SEQ ID NO: 4008 - DNA, 15 bp, Homo sapiens
actgcactgggtgaa

SEQ ID NO: 4009 - DNA, 15 bp, Homo sapiens
tactgcactgggtga

SEQ ID NO: 4010 - DNA, 15 bp, Homo sapiens
gtactgcactgggtg

SEQ ID NO: 4011 - DNA, 15 bp, Homo sapiens
agtactgcactgggt

SEQ ID NO: 4012 - DNA, 15 bp, Homo sapiens
aagtactgcactggg

SEQ ID NO: 4013 - DNA, 15 bp, Homo sapiens
gaagtactgcactgg

SEQ ID NO: 4014 - DNA, 15 bp, Homo sapiens
agaagtactgcactg

SEQ ID NO: 4015 - DNA, 15 bp, Homo sapiens
aagaagtactgcact

SEQ ID NO: 4016 - DNA, 15 bp, Homo sapiens
aaagaagtactgcac

SEQ ID NO: 4017 - DNA, 15 bp, Homo sapiens
gaaagaagtactgca

SEQ ID NO: 4018 - DNA, 15 bp, Homo sapiens
agaaagaagtactgc

SEQ ID NO: 4019 - DNA, 15 bp, Homo sapiens
tagaaagaagtactg

SEQ ID NO: 4020 - DNA, 15 bp, Homo sapiens
ctagaaagaagtact

SEQ ID NO: 4021 - DNA, 15 bp, Homo sapiens
actagaaagaagtac

SEQ ID NO: 4022 - DNA, 15 bp, Homo sapiens
aactagaaagaagta

SEQ ID NO: 4023 - DNA, 15 bp, Homo sapiens
taactagaaagaagt

SEQ ID NO: 4024 - DNA, 15 bp, Homo sapiens
ttaactagaaagaag

SEQ ID NO: 4025 - DNA, 15 bp, Homo sapiens
tttaactagaaagaa

SEQ ID NO: 4026 - DNA, 15 bp, Homo sapiens
ttttaactagaaaga

SEQ ID NO: 4027 - DNA, 15 bp, Homo sapiens
gttttaactagaaag

SEQ ID NO: 4028 - DNA, 15 bp, Homo sapiens
tgttttaactagaaa

SEQ ID NO: 4029 - DNA, 15 bp, Homo sapiens
ttgttttaactagaa

SEQ ID NO: 4030 - DNA, 15 bp, Homo sapiens
tttgttttaactaga

SEQ ID NO: 4031 - DNA, 15 bp, Homo sapiens
ttttgttttaactag

SEQ ID NO: 4032 - DNA, 15 bp, Homo sapiens
attttgttttaacta

SEQ ID NO: 4033 - DNA, 15 bp, Homo sapiens
aattttgttttaact

SEQ ID NO: 4034 - DNA, 15 bp, Homo sapiens
caattttgttttaac

SEQ ID NO: 4035 - DNA, 15 bp, Homo sapiens
tcaattttgttttaa

SEQ ID NO: 4036 - DNA, 15 bp, Homo sapiens
gtcaattttgtttta

SEQ ID NO: 4037 - DNA, 15 bp, Homo sapiens
tgtcaattttgtttt

SEQ ID NO: 4038 - DNA, 15 bp, Homo sapiens
ttgtcaattttgttt

SEQ ID NO: 4039 - DNA, 15 bp, Homo sapiens
tttgtcaattttgtt

SEQ ID NO: 4040 - DNA, 15 bp, Homo sapiens
ttttgtcaattttgt

SEQ ID NO: 4041 - DNA, 15 bp, Homo sapiens
gttttgtcaattttg

SEQ ID NO: 4042 - DNA, 15 bp, Homo sapiens
agttttgtcaatttt

SEQ ID NO: 4043 - DNA, 15 bp, Homo sapiens
aagttttgtcaattt

SEQ ID NO: 4044 - DNA, 15 bp, Homo sapiens
gaagttttgtcaatt

SEQ ID NO: 4045 - DNA, 15 bp, Homo sapiens
tgaagttttgtcaat

SEQ ID NO: 4046 - DNA, 15 bp, Homo sapiens
gtgaagttttgtcaa

SEQ ID NO: 4047 - DNA, 15 bp, Homo sapiens
cgtgaagttttgtca

SEQ ID NO: 4048 - DNA, 15 bp, Homo sapiens
ccgtgaagttttgtc

SEQ ID NO: 4049 - DNA, 15 bp, Homo sapiens
accgtgaagttttgt

SEQ ID NO: 4050 - DNA, 15 bp, Homo sapiens
aaccgtgaagttttg

SEQ ID NO: 4051 - DNA, 15 bp, Homo sapiens
aaaccgtgaagtttt

SEQ ID NO: 4052 - DNA, 15 bp, Homo sapiens
gaaaccgtgaagttt

SEQ ID NO: 4053 - DNA, 15 bp, Homo sapiens
tgaaaccgtgaagtt

SEQ ID NO: 4054 - DNA, 15 bp, Homo sapiens
ctgaaaccgtgaagt

SEQ ID NO: 4055 - DNA, 15 bp, Homo sapiens
actgaaaccgtgaag

SEQ ID NO: 4056 - DNA, 15 bp, Homo sapiens
aactgaaaccgtgaa

SEQ ID NO: 4057 - DNA, 15 bp, Homo sapiens
gaactgaaaccgtga

SEQ ID NO: 4058 - DNA, 15 bp, Homo sapiens
agaactgaaaccgtg

SEQ ID NO: 4059 - DNA, 15 bp, Homo sapiens
aagaactgaaaccgt

SEQ ID NO: 4060 - DNA, 15 bp, Homo sapiens
caagaactgaaaccg

SEQ ID NO: 4061 - DNA, 15 bp, Homo sapiens
acaagaactgaaacc

SEQ ID NO: 4062 - DNA, 15 bp, Homo sapiens
tacaagaactgaaac

SEQ ID NO: 4063 - DNA, 15 bp, Homo sapiens
gtacaagaactgaaa

SEQ ID NO: 4064 - DNA, 15 bp, Homo sapiens
tgtacaagaactgaa

SEQ ID NO: 4065 - DNA, 15 bp, Homo sapiens
atgtacaagaactga

SEQ ID NO: 4066 - DNA, 15 bp, Homo sapiens
tatgtacaagaactg

SEQ ID NO: 4067 - DNA, 15 bp, Homo sapiens
atatgtacaagaact

SEQ ID NO: 4068 - DNA, 15 bp, Homo sapiens
tatatgtacaagaac

SEQ ID NO: 4069 - DNA, 15 bp, Homo sapiens
atatatgtacaagaa

SEQ ID NO: 4070 - DNA, 15 bp, Homo sapiens
catatatgtacaaga

SEQ ID NO: 4071 - DNA, 15 bp, Homo sapiens
acatatatgtacaag

SEQ ID NO: 4072 - DNA, 15 bp, Homo sapiens
tacatatatgtacaa

SEQ ID NO: 4073 - DNA, 15 bp, Homo sapiens
atacatatatgtaca

SEQ ID NO: 4074 - DNA, 15 bp, Homo sapiens
catacatatatgtac

SEQ ID NO: 4075 - DNA, 15 bp, Homo sapiens
gcatacatatatgta

SEQ ID NO: 4076 - DNA, 15 bp, Homo sapiens
tgcatacatatatgt

SEQ ID NO: 4077 - DNA, 15 bp, Homo sapiens
ctgcatacatatatg

SEQ ID NO: 4078 - DNA, 15 bp, Homo sapiens
cctgcatacatatat

SEQ ID NO: 4079 - DNA, 15 bp, Homo sapiens
acctgcatacatata

SEQ ID NO: 4080 - DNA, 15 bp, Homo sapiens
gacctgcatacatat

SEQ ID NO: 4081 - DNA, 15 bp, Homo sapiens
ggacctgcatacata

SEQ ID NO: 4082 - DNA, 15 bp, Homo sapiens
gggacctgcatacat

SEQ ID NO: 4083 - DNA, 15 bp, Homo sapiens
tgggacctgcataca

SEQ ID NO: 4084 - DNA, 15 bp, Homo sapiens
ctgggacctgcatac

SEQ ID NO: 4085 - DNA, 15 bp, Homo sapiens
cctgggacctgcata

SEQ ID NO: 4086 - DNA, 15 bp, Homo sapiens
ccctgggacctgcat

SEQ ID NO: 4087 - DNA, 15 bp, Homo sapiens
tccctgggacctgca

SEQ ID NO: 4088 - DNA, 15 bp, Homo sapiens
atccctgggacctgc

SEQ ID NO: 4089 - DNA, 15 bp, Homo sapiens
gatccctgggacctg

SEQ ID NO: 4090 - DNA, 15 bp, Homo sapiens
tgatccctgggacct

SEQ ID NO: 4091 - DNA, 15 bp, Homo sapiens
ctgatccctgggacc

SEQ ID NO: 4092 - DNA, 15 bp, Homo sapiens
gctgatccctgggac

SEQ ID NO: 4093 - DNA, 15 bp, Homo sapiens
ggctgatccctggga

SEQ ID NO: 4094 - DNA, 15 bp, Homo sapiens
aggctgatccctggg

SEQ ID NO: 4095 - DNA, 15 bp, Homo sapiens
gaggctgatccctgg

SEQ ID NO: 4096 - DNA, 15 bp, Homo sapiens
tgaggctgatccctg

SEQ ID NO: 4097 - DNA, 15 bp, Homo sapiens
ctgaggctgatccct

SEQ ID NO: 4098 - DNA, 15 bp, Homo sapiens
actgaggctgatccc

SEQ ID NO: 4099 - DNA, 15 bp, Homo sapiens
gactgaggctgatcc

SEQ ID NO: 4100 - DNA, 15 bp, Homo sapiens
agactgaggctgatc

SEQ ID NO: 4101 - DNA, 15 bp, Homo sapiens
aagactgaggctgat

SEQ ID NO: 4102 - DNA, 15 bp, Homo sapiens
aaagactgaggctga

SEQ ID NO: 4103 - DNA, 15 bp, Homo sapiens
caaagactgaggctg

SEQ ID NO: 4104 - DNA, 15 bp, Homo sapiens
acaaagactgaggct

SEQ ID NO: 4105 - DNA, 15 bp, Homo sapiens
cacaaagactgaggc

SEQ ID NO: 4106 - DNA, 15 bp, Homo sapiens
tcacaaagactgagg

SEQ ID NO: 4107 - DNA, 15 bp, Homo sapiens
ctcacaaagactgag

SEQ ID NO: 4108 - DNA, 15 bp, Homo sapiens
tctcacaaagactga

SEQ ID NO: 4109 - DNA, 15 bp, Homo sapiens
ttctcacaaagactg

SEQ ID NO: 4110 - DNA, 15 bp, Homo sapiens
gttctcacaaagact

SEQ ID NO: 4111 - DNA, 15 bp, Homo sapiens
ggttctcacaaagac

SEQ ID NO: 4112 - DNA, 15 bp, Homo sapiens
tggttctcacaaaga

SEQ ID NO: 4113 - DNA, 15 bp, Homo sapiens
atggttctcacaaag

SEQ ID NO: 4114 - DNA, 15 bp, Homo sapiens
tatggttctcacaaa

SEQ ID NO: 4115 - DNA, 15 bp, Homo sapiens
gtatggttctcacaa

SEQ ID NO: 4116 - DNA, 15 bp, Homo sapiens
ggtatggttctcaca

SEQ ID NO: 4117 - DNA, 15 bp, Homo sapiens
tggtatggttctcac

SEQ ID NO: 4118 - DNA, 15 bp, Homo sapiens
atggtatggttctca

SEQ ID NO: 4119 - DNA, 15 bp, Homo sapiens
tatggtatggttctc

SEQ ID NO: 4120 - DNA, 15 bp, Homo sapiens
ctatggtatggttct

SEQ ID NO: 4121 - DNA, 15 bp, Homo sapiens
tctatggtatggttc

SEQ ID NO: 4122 - DNA, 15 bp, Homo sapiens
ctctatggtatggtt

SEQ ID NO: 4123 - DNA, 15 bp, Homo sapiens
cctctatggtatggt

SEQ ID NO: 4124 - DNA, 15 bp, Homo sapiens
ccctctatggtatgg

SEQ ID NO: 4125 - DNA, 15 bp, Homo sapiens
gccctctatggtatg

SEQ ID NO: 4126 - DNA, 15 bp, Homo sapiens
agccctctatggtat

SEQ ID NO: 4127 - DNA, 15 bp, Homo sapiens
tagccctctatggta

SEQ ID NO: 4128 - DNA, 15 bp, Homo sapiens
atagccctctatggt

SEQ ID NO: 4129 - DNA, 15 bp, Homo sapiens
aatagccctctatgg

SEQ ID NO: 4130 - DNA, 15 bp, Homo sapiens
aaatagccctctatg

SEQ ID NO: 4131 - DNA, 15 bp, Homo sapiens
aaaatagccctctat

SEQ ID NO: 4132 - DNA, 15 bp, Homo sapiens
caaaatagccctcta

SEQ ID NO: 4133 - DNA, 15 bp, Homo sapiens
tcaaaatagccctct

SEQ ID NO: 4134 - DNA, 15 bp, Homo sapiens
ctcaaaatagccctc

SEQ ID NO: 4135 - DNA, 15 bp, Homo sapiens
tctcaaaatagccct

SEQ ID NO: 4136 - DNA, 15 bp, Homo sapiens
ttctcaaaatagccc

SEQ ID NO: 4137 - DNA, 15 bp, Homo sapiens
gttctcaaaatagcc

SEQ ID NO: 4138 - DNA, 15 bp, Homo sapiens
cgttctcaaaatagc

SEQ ID NO: 4139 - DNA, 15 bp, Homo sapiens
tcgttctcaaaatag

SEQ ID NO: 4140 - DNA, 15 bp, Homo sapiens
ttcgttctcaaaata

SEQ ID NO: 4141 - DNA, 15 bp, Homo sapiens
tttcgttctcaaaat

SEQ ID NO: 4142 - DNA, 15 bp, Homo sapiens
atttcgttctcaaaa

SEQ ID NO: 4143 - DNA, 15 bp, Homo sapiens
tatttcgttctcaaa

SEQ ID NO: 4144 - DNA, 15 bp, Homo sapiens
ttatttcgttctcaa

SEQ ID NO: 4145 - DNA, 15 bp, Homo sapiens
tttatttcgttctca

SEQ ID NO: 4146 - DNA, 15 bp, Homo sapiens
gtttatttcgttctc

SEQ ID NO: 4147 - DNA, 15 bp, Homo sapiens
tgtttatttcgttct

SEQ ID NO: 4148 - DNA, 15 bp, Homo sapiens
ttgtttatttcgttc

SEQ ID NO: 4149 - DNA, 15 bp, Homo sapiens
tttgtttatttcgtt

SEQ ID NO: 4150 - DNA, 15 bp, Homo sapiens
ctttgtttatttcgt

SEQ ID NO: 4151 - DNA, 15 bp, Homo sapiens
gctttgtttatttcg

SEQ ID NO: 4152 - DNA, 15 bp, Homo sapiens
tgctttgtttatttc

SEQ ID NO: 4153 - DNA, 15 bp, Homo sapiens
ctgctttgtttattt

SEQ ID NO: 4154 - DNA, 15 bp, Homo sapiens
actgctttgtttatt

SEQ ID NO: 4155 - DNA, 15 bp, Homo sapiens
cactgctttgtttat

SEQ ID NO: 4156 - DNA, 15 bp, Homo sapiens
ccactgctttgttta

SEQ ID NO: 4157 - DNA, 15 bp, Homo sapiens
cccactgctttgttt

SEQ ID NO: 4158 - DNA, 15 bp, Homo sapiens
gcccactgctttgtt

SEQ ID NO: 4159 - DNA, 15 bp, Homo sapiens
tgcccactgctttgt

SEQ ID NO: 4160 - DNA, 15 bp, Homo sapiens
atgcccactgctttg

SEQ ID NO: 4161 - DNA, 15 bp, Homo sapiens
aatgcccactgcttt

SEQ ID NO: 4162 - DNA, 15 bp, Homo sapiens
aaatgcccactgctt

SEQ ID NO: 4163 - DNA, 15 bp, Homo sapiens
taaatgcccactgct

SEQ ID NO: 4164 - DNA, 15 bp, Homo sapiens
ataaatgcccactgc

SEQ ID NO: 4165 - DNA, 15 bp, Homo sapiens
aataaatgcccactg

SEQ ID NO: 4166 - DNA, 15 bp, Homo sapiens
aaataaatgcccact

SEQ ID NO: 4167 - DNA, 15 bp, Homo sapiens
taaataaatgcccac

SEQ ID NO: 4168 - DNA, 15 bp, Homo sapiens
ctaaataaatgccca

SEQ ID NO: 4169 - DNA, 15 bp, Homo sapiens
actaaataaatgccc

SEQ ID NO: 4170 - DNA, 15 bp, Homo sapiens
aactaaataaatgcc

SEQ ID NO: 4171 - DNA, 15 bp, Homo sapiens
gaactaaataaatgc

SEQ ID NO: 4172 - DNA, 15 bp, Homo sapiens
tgaactaaataaatg

SEQ ID NO: 4173 - DNA, 15 bp, Homo sapiens
ctgaactaaataaat

SEQ ID NO: 4174 - DNA, 15 bp, Homo sapiens
tctgaactaaataaa

SEQ ID NO: 4175 - DNA, 15 bp, Homo sapiens
atctgaactaaataa

SEQ ID NO: 4176 - DNA, 15 bp, Homo sapiens
catctgaactaaata

SEQ ID NO: 4177 - DNA, 15 bp, Homo sapiens
tcatctgaactaaat

SEQ ID NO: 4178 - DNA, 15 bp, Homo sapiens
ctcatctgaactaaa

SEQ ID NO: 4179 - DNA, 15 bp, Homo sapiens
cctcatctgaactaa

SEQ ID NO: 4180 - DNA, 15 bp, Homo sapiens
tcctcatctgaacta

SEQ ID NO: 4181 - DNA, 15 bp, Homo sapiens
ttcctcatctgaact

SEQ ID NO: 4182 - DNA, 15 bp, Homo sapiens
tttcctcatctgaac

SEQ ID NO: 4183 - DNA, 15 bp, Homo sapiens
ttttcctcatctgaa

SEQ ID NO: 4184 - DNA, 15 bp, Homo sapiens
cttttcctcatctga

SEQ ID NO: 4185 - DNA, 15 bp, Homo sapiens
tcttttcctcatctg

SEQ ID NO: 4186 - DNA, 15 bp, Homo sapiens
atcttttcctcatct

SEQ ID NO: 4187 - DNA, 15 bp, Homo sapiens
aatcttttcctcatc

SEQ ID NO: 4188 - DNA, 15 bp, Homo sapiens
taatcttttcctcat

SEQ ID NO: 4189 - DNA, 15 bp, Homo sapiens
ttaatcttttcctca

SEQ ID NO: 4190 - DNA, 15 bp, Homo sapiens
tttaatcttttcctc

SEQ ID NO: 4191 - DNA, 15 bp, Homo sapiens
atttaatcttttcct

SEQ ID NO: 4192 - DNA, 15 bp, Homo sapiens
aatttaatcttttcc

SEQ ID NO: 4193 - DNA, 15 bp, Homo sapiens
aaatttaatcttttc

SEQ ID NO: 4194 - DNA, 15 bp, Homo sapiens
taaatttaatctttt

SEQ ID NO: 4195 - DNA, 15 bp, Homo sapiens
ataaatttaatcttt

SEQ ID NO: 4196 - DNA, 15 bp, Homo sapiens
tataaatttaatctt

SEQ ID NO: 4197 - DNA, 15 bp, Homo sapiens
gtataaatttaatct

SEQ ID NO: 4198 - DNA, 15 bp, Homo sapiens
ggtataaatttaatc

SEQ ID NO: 4199 - DNA, 15 bp, Homo sapiens
gggtataaatttaat

SEQ ID NO: 4200 - DNA, 15 bp, Homo sapiens
tgggtataaatttaa

SEQ ID NO: 4201 - DNA, 15 bp, Homo sapiens
atgggtataaattta

SEQ ID NO: 4202 - DNA, 15 bp, Homo sapiens
gatgggtataaattt

SEQ ID NO: 4203 - DNA, 15 bp, Homo sapiens
agatgggtataaatt

SEQ ID NO: 4204 - DNA, 15 bp, Homo sapiens
aagatgggtataaat

SEQ ID NO: 4205 - DNA, 15 bp, Homo sapiens
aaagatgggtataaa

SEQ ID NO: 4206 - DNA, 15 bp, Homo sapiens
aaaagatgggtataa

SEQ ID NO: 4207 - DNA, 15 bp, Homo sapiens
taaaagatgggtata

SEQ ID NO: 4208 - DNA, 15 bp, Homo sapiens
ttaaaagatgggtat

SEQ ID NO: 4209 - DNA, 15 bp, Homo sapiens
cttaaaagatgggta

SEQ ID NO: 4210 - DNA, 15 bp, Homo sapiens
acttaaaagatgggt

SEQ ID NO: 4211 - DNA, 15 bp, Homo sapiens
tacttaaaagatggg

SEQ ID NO: 4212 - DNA, 15 bp, Homo sapiens
ctacttaaaagatgg

SEQ ID NO: 4213 - DNA, 15 bp, Homo sapiens
tctacttaaaagatg

SEQ ID NO: 4214 - DNA, 15 bp, Homo sapiens
atctacttaaaagat

SEQ ID NO: 4215 - DNA, 15 bp, Homo sapiens
tatctacttaaaaga

SEQ ID NO: 4216 - DNA, 15 bp, Homo sapiens
ctatctacttaaaag

SEQ ID NO: 4217 - DNA, 15 bp, Homo sapiens
actatctacttaaaa

SEQ ID NO: 4218 - DNA, 15 bp, Homo sapiens
cactatctacttaaa

SEQ ID NO: 4219 - DNA, 15 bp, Homo sapiens
ccactatctacttaa

SEQ ID NO: 4220 - DNA, 15 bp, Homo sapiens
gccactatctactta

SEQ ID NO: 4221 - DNA, 15 bp, Homo sapiens
tgccactatctactt

SEQ ID NO: 4222 - DNA, 15 bp, Homo sapiens
ctgccactatctact

SEQ ID NO: 4223 - DNA, 15 bp, Homo sapiens
gctgccactatctac

SEQ ID NO: 4224 - DNA, 15 bp, Homo sapiens
tgctgccactatcta

SEQ ID NO: 4225 - DNA, 15 bp, Homo sapiens
ctgctgccactatct

SEQ ID NO: 4226 - DNA, 15 bp, Homo sapiens
actgctgccactatc

SEQ ID NO: 4227 - DNA, 15 bp, Homo sapiens
tactgctgccactat

SEQ ID NO: 4228 - DNA, 15 bp, Homo sapiens
ttactgctgccacta

SEQ ID NO: 4229 - DNA, 15 bp, Homo sapiens
tttactgctgccact

SEQ ID NO: 4230 - DNA, 15 bp, Homo sapiens
atttactgctgccac

SEQ ID NO: 4231 - DNA, 15 bp, Homo sapiens
tatttactgctgcca

SEQ ID NO: 4232 - DNA, 15 bp, Homo sapiens
ttatttactgctgcc

SEQ ID NO: 4233 - DNA, 15 bp, Homo sapiens
tttatttactgctgc

SEQ ID NO: 4234 - DNA, 15 bp, Homo sapiens
atttatttactgctg

SEQ ID NO: 4235 - DNA, 15 bp, Homo sapiens
aatttatttactgct

SEQ ID NO: 4236 - DNA, 15 bp, Homo sapiens
aaatttatttactgc

SEQ ID NO: 4237 - DNA, 15 bp, Homo sapiens
caaatttatttactg

SEQ ID NO: 4238 - DNA, 15 bp, Homo sapiens
acaaatttatttact

SEQ ID NO: 4239 - DNA, 15 bp, Homo sapiens
cacaaatttatttac

SEQ ID NO: 4240 - DNA, 15 bp, Homo sapiens
ccacaaatttattta

SEQ ID NO: 4241 - DNA, 15 bp, Homo sapiens
tccacaaatttattt

SEQ ID NO: 4242 - DNA, 15 bp, Homo sapiens
ttccacaaatttatt

SEQ ID NO: 4243 - DNA, 15 bp, Homo sapiens
attccacaaatttat

SEQ ID NO: 4244 - DNA, 15 bp, Homo sapiens
tattccacaaattta

SEQ ID NO: 4245 - DNA, 15 bp, Homo sapiens
ttattccacaaattt

SEQ ID NO: 4246 - DNA, 15 bp, Homo sapiens
attattccacaaatt

SEQ ID NO: 4247 - DNA, 15 bp, Homo sapiens
aattattccacaaat

SEQ ID NO: 4248 - DNA, 15 bp, Homo sapiens
aaattattccacaaa

SEQ ID NO: 4249 - DNA, 15 bp, Homo sapiens
aaaattattccacaa

SEQ ID NO: 4250 - DNA, 15 bp, Homo sapiens
aaaaattattccaca

SEQ ID NO: 4251 - DNA, 15 bp, Homo sapiens
taaaaattattccac

SEQ ID NO: 4252 - DNA, 15 bp, Homo sapiens
gtaaaaattattcca

SEQ ID NO: 4253 - DNA, 15 bp, Homo sapiens
tgtaaaaattattcc

SEQ ID NO: 4254 - DNA, 15 bp, Homo sapiens
atgtaaaaattattc

SEQ ID NO: 4255 - DNA, 15 bp, Homo sapiens
tatgtaaaaattatt

SEQ ID NO: 4256 - DNA, 15 bp, Homo sapiens
ttatgtaaaaattat

SEQ ID NO: 4257 - DNA, 15 bp, Homo sapiens
tttatgtaaaaatta

SEQ ID NO: 4258 - DNA, 15 bp, Homo sapiens
atttatgtaaaaatt

SEQ ID NO: 4259 - DNA, 15 bp, Homo sapiens
gatttatgtaaaaat

SEQ ID NO: 4260 - DNA, 15 bp, Homo sapiens
ggatttatgtaaaaa

SEQ ID NO: 4261 - DNA, 15 bp, Homo sapiens
aggatttatgtaaaa

SEQ ID NO: 4262 - DNA, 15 bp, Homo sapiens
caggatttatgtaaa

SEQ ID NO: 4263 - DNA, 15 bp, Homo sapiens
gcaggatttatgtaa

SEQ ID NO: 4264 - DNA, 15 bp, Homo sapiens
agcaggatttatgta

SEQ ID NO: 4265 - DNA, 15 bp, Homo sapiens
tagcaggatttatgt

SEQ ID NO: 4266 - DNA, 15 bp, Homo sapiens
atagcaggatttatg

SEQ ID NO: 4267 - DNA, 15 bp, Homo sapiens
catagcaggatttat

SEQ ID NO: 4268 - DNA, 15 bp, Homo sapiens
tcatagcaggattta

SEQ ID NO: 4269 - DNA, 15 bp, Homo sapiens
atcatagcaggattt

SEQ ID NO: 4270 - DNA, 15 bp, Homo sapiens
tatcatagcaggatt

SEQ ID NO: 4271 - DNA, 15 bp, Homo sapiens
gtatcatagcaggat

SEQ ID NO: 4272 - DNA, 15 bp, Homo sapiens
agtatcatagcagga

SEQ ID NO: 4273 - DNA, 15 bp, Homo sapiens
aagtatcatagcagg

SEQ ID NO: 4274 - DNA, 15 bp, Homo sapiens
aaagtatcatagcag

SEQ ID NO: 4275 - DNA, 15 bp, Homo sapiens
taaagtatcatagca

SEQ ID NO: 4276 - DNA, 15 bp, Homo sapiens
ataaagtatcatagc

SEQ ID NO: 4277 - DNA, 15 bp, Homo sapiens
aataaagtatcatag

SEQ ID NO: 4278 - DNA, 15 bp, Homo sapiens
taataaagtatcata

SEQ ID NO: 4279 - DNA, 15 bp, Homo sapiens
ataataaagtatcat

SEQ ID NO: 4280 - DNA, 15 bp, Homo sapiens
cataataaagtatca

SEQ ID NO: 4281 - DNA, 15 bp, Homo sapiens
gcataataaagtatc

SEQ ID NO: 4282 - DNA, 15 bp, Homo sapiens
ggcataataaagtat

SEQ ID NO: 4283 - DNA, 15 bp, Homo sapiens
tggcataataaagta

SEQ ID NO: 4284 - DNA, 15 bp, Homo sapiens
atggcataataaagt

SEQ ID NO: 4285 - DNA, 15 bp, Homo sapiens
tatggcataataaag

SEQ ID NO: 4286 - DNA, 15 bp, Homo sapiens
atatggcataataaa

SEQ ID NO: 4287 - DNA, 15 bp, Homo sapiens
aatatggcataataa

SEQ ID NO: 4288 - DNA, 15 bp, Homo sapiens
taatatggcataata

SEQ ID NO: 4289 - DNA, 15 bp, Homo sapiens
ctaatatggcataat

SEQ ID NO: 4290 - DNA, 15 bp, Homo sapiens
gctaatatggcataa

SEQ ID NO: 4291 - DNA, 15 bp, Homo sapiens
ggctaatatggcata

SEQ ID NO: 4292 - DNA, 15 bp, Homo sapiens
tggctaatatggcat

SEQ ID NO: 4293 - DNA, 15 bp, Homo sapiens
ttggctaatatggca

SEQ ID NO: 4294 - DNA, 15 bp, Homo sapiens
cttggctaatatggc

SEQ ID NO: 4295 - DNA, 15 bp, Homo sapiens
acttggctaatatgg

SEQ ID NO: 4296 - DNA, 15 bp, Homo sapiens
tacttggctaatatg

SEQ ID NO: 4297 - DNA, 15 bp, Homo sapiens
atacttggctaatat

SEQ ID NO: 4298 - DNA, 15 bp, Homo sapiens
aatacttggctaata

SEQ ID NO: 4299 - DNA, 15 bp, Homo sapiens
caatacttggctaat

SEQ ID NO: 4300 - DNA, 15 bp, Homo sapiens
acaatacttggctaa

SEQ ID NO: 4301 - DNA, 15 bp, Homo sapiens
cacaatacttggcta

SEQ ID NO: 4302 - DNA, 15 bp, Homo sapiens
acacaatacttggct

SEQ ID NO: 4303 - DNA, 15 bp, Homo sapiens
tacacaatacttggc

SEQ ID NO: 4304 - DNA, 15 bp, Homo sapiens
ctacacaatacttgg

SEQ ID NO: 4305 - DNA, 15 bp, Homo sapiens
gctacacaatacttg

SEQ ID NO: 4306 - DNA, 15 bp, Homo sapiens
ggctacacaatactt

SEQ ID NO: 4307 - DNA, 15 bp, Homo sapiens
tggctacacaatact

SEQ ID NO: 4308 - DNA, 15 bp, Homo sapiens
atggctacacaatac

SEQ ID NO: 4309 - DNA, 15 bp, Homo sapiens
aatggctacacaata

SEQ ID NO: 4310 - DNA, 15 bp, Homo sapiens
taatggctacacaat

SEQ ID NO: 4311 - DNA, 15 bp, Homo sapiens
ttaatggctacacaa

SEQ ID NO: 4312 - DNA, 15 bp, Homo sapiens
attaatggctacaca

SEQ ID NO: 4313 - DNA, 15 bp, Homo sapiens
tattaatggctacac

SEQ ID NO: 4314 - DNA, 15 bp, Homo sapiens
ttattaatggctaca

SEQ ID NO: 4315 - DNA, 15 bp, Homo sapiens
attattaatggctac

SEQ ID NO: 4316 - DNA, 15 bp, Homo sapiens
aattattaatggcta

SEQ ID NO: 4317 - DNA, 15 bp, Homo sapiens
gaattattaatggct

SEQ ID NO: 4318 - DNA, 15 bp, Homo sapiens
tgaattattaatggc

SEQ ID NO: 4319 - DNA, 15 bp, Homo sapiens
ctgaattattaatgg

SEQ ID NO: 4320 - DNA, 15 bp, Homo sapiens
actgaattattaatg

SEQ ID NO: 4321 - DNA, 15 bp, Homo sapiens
gactgaattattaat

SEQ ID NO: 4322 - DNA, 15 bp, Homo sapiens
ggactgaattattaa

SEQ ID NO: 4323 - DNA, 15 bp, Homo sapiens
gggactgaattatta

SEQ ID NO: 4324 - DNA, 15 bp, Homo sapiens
ggggactgaattatt

SEQ ID NO: 4325 - DNA, 15 bp, Homo sapiens
tggggactgaattat

SEQ ID NO: 4326 - DNA, 15 bp, Homo sapiens
ttggggactgaatta

SEQ ID NO: 4327 - DNA, 15 bp, Homo sapiens
cttggggactgaatt

SEQ ID NO: 4328 - DNA, 15 bp, Homo sapiens
tcttggggactgaat

SEQ ID NO: 4329 - DNA, 15 bp, Homo sapiens
ttcttggggactgaa

SEQ ID NO: 4330 - DNA, 15 bp, Homo sapiens
gttcttggggactga

SEQ ID NO: 4331 - DNA, 15 bp, Homo sapiens
ggttcttggggactg

SEQ ID NO: 4332 - DNA, 15 bp, Homo sapiens
aggttcttggggact

SEQ ID NO: 4333 - DNA, 15 bp, Homo sapiens
aaggttcttggggac

SEQ ID NO: 4334 - DNA, 15 bp, Homo sapiens
aaaggttcttgggga

SEQ ID NO: 4335 - DNA, 15 bp, Homo sapiens
aaaaggttcttgggg

SEQ ID NO: 4336 - DNA, 15 bp, Homo sapiens
gaaaaggttcttggg

SEQ ID NO: 4337 - DNA, 15 bp, Homo sapiens
agaaaaggttcttgg

SEQ ID NO: 4338 - DNA, 15 bp, Homo sapiens
cagaaaaggttcttg

SEQ ID NO: 4339 - DNA, 15 bp, Homo sapiens
acagaaaaggttctt

SEQ ID NO: 4340 - DNA, 15 bp, Homo sapiens
cacagaaaaggttct

SEQ ID NO: 4341 - DNA, 15 bp, Homo sapiens
ccacagaaaaggttc

SEQ ID NO: 4342 - DNA, 15 bp, Homo sapiens
accacagaaaaggtt

SEQ ID NO: 4343 - DNA, 15 bp, Homo sapiens
aaccacagaaaaggt

SEQ ID NO: 4344 - DNA, 15 bp, Homo sapiens
aaaccacagaaaagg

SEQ ID NO: 4345 - DNA, 15 bp, Homo sapiens
aaaaccacagaaaag

SEQ ID NO: 4346 - DNA, 15 bp, Homo sapiens
gaaaaccacagaaaa

SEQ ID NO: 4347 - DNA, 15 bp, Homo sapiens
tgaaaaccacagaaa

SEQ ID NO: 4348 - DNA, 15 bp, Homo sapiens
atgaaaaccacagaa

SEQ ID NO: 4349 - DNA, 15 bp, Homo sapiens
aatgaaaaccacaga

SEQ ID NO: 4350 - DNA, 15 bp, Homo sapiens
caatgaaaaccacag

SEQ ID NO: 4351 - DNA, 15 bp, Homo sapiens
tcaatgaaaaccaca

SEQ ID NO: 4352 - DNA, 15 bp, Homo sapiens
atcaatgaaaaccac

SEQ ID NO: 4353 - DNA, 15 bp, Homo sapiens
aatcaatgaaaacca

SEQ ID NO: 4354 - DNA, 15 bp, Homo sapiens
taatcaatgaaaacc

SEQ ID NO: 4355 - DNA, 15 bp, Homo sapiens
ttaatcaatgaaaac

SEQ ID NO: 4356 - DNA, 15 bp, Homo sapiens
tttaatcaatgaaaa

SEQ ID NO: 4357 - DNA, 15 bp, Homo sapiens
ttttaatcaatgaaa

SEQ ID NO: 4358 - DNA, 15 bp, Homo sapiens
attttaatcaatgaa

SEQ ID NO: 4359 - DNA, 15 bp, Homo sapiens
cattttaatcaatga

SEQ ID NO: 4360 - DNA, 15 bp, Homo sapiens
ccattttaatcaatg

SEQ ID NO: 4361 - DNA, 15 bp, Homo sapiens
cccattttaatcaat

SEQ ID NO: 4362 - DNA, 15 bp, Homo sapiens
ccccattttaatcaa

SEQ ID NO: 4363 - DNA, 15 bp, Homo sapiens
tccccattttaatca

SEQ ID NO: 4364 - DNA, 15 bp, Homo sapiens
gtccccattttaatc

SEQ ID NO: 4365 - DNA, 15 bp, Homo sapiens
agtccccattttaat

SEQ ID NO: 4366 - DNA, 15 bp, Homo sapiens
aagtccccattttaa

SEQ ID NO: 4367 - DNA, 15 bp, Homo sapiens
taagtccccatttta

SEQ ID NO: 4368 - DNA, 15 bp, Homo sapiens
gtaagtccccatttt

SEQ ID NO: 4369 - DNA, 15 bp, Homo sapiens
tgtaagtccccattt

SEQ ID NO: 4370 - DNA, 15 bp, Homo sapiens
atgtaagtccccatt

SEQ ID NO: 4371 - DNA, 15 bp, Homo sapiens
tatgtaagtccccat

SEQ ID NO: 4372 - DNA, 15 bp, Homo sapiens
ctatgtaagtcccca

SEQ ID NO: 4373 - DNA, 15 bp, Homo sapiens
gctatgtaagtcccc

SEQ ID NO: 4374 - DNA, 15 bp, Homo sapiens
tgctatgtaagtccc

SEQ ID NO: 4375 - DNA, 15 bp, Homo sapiens
ttgctatgtaagtcc

SEQ ID NO: 4376 - DNA, 15 bp, Homo sapiens
tttgctatgtaagtc

SEQ ID NO: 4377 - DNA, 15 bp, Homo sapiens
gtttgctatgtaagt

SEQ ID NO: 4378 - DNA, 15 bp, Homo sapiens
ggtttgctatgtaag

SEQ ID NO: 4379 - DNA, 15 bp, Homo sapiens
tggtttgctatgtaa

SEQ ID NO: 4380 - DNA, 15 bp, Homo sapiens
atggtttgctatgta

SEQ ID NO: 4381 - DNA, 15 bp, Homo sapiens
aatggtttgctatgt

SEQ ID NO: 4382 - DNA, 15 bp, Homo sapiens
gaatggtttgctatg

SEQ ID NO: 4383 - DNA, 15 bp, Homo sapiens
tgaatggtttgctat

SEQ ID NO: 4384 - DNA, 15 bp, Homo sapiens
ctgaatggtttgcta

SEQ ID NO: 4385 - DNA, 15 bp, Homo sapiens
gctgaatggtttgct

SEQ ID NO: 4386 - DNA, 15 bp, Homo sapiens
tgctgaatggtttgc

SEQ ID NO: 4387 - DNA, 15 bp, Homo sapiens
atgctgaatggtttg

SEQ ID NO: 4388 - DNA, 15 bp, Homo sapiens
aatgctgaatggttt

SEQ ID NO: 4389 - DNA, 15 bp, Homo sapiens
gaatgctgaatggtt

SEQ ID NO: 4390 - DNA, 15 bp, Homo sapiens
agaatgctgaatggt

SEQ ID NO: 4391 - DNA, 15 bp, Homo sapiens
cagaatgctgaatgg

SEQ ID NO: 4392 - DNA, 15 bp, Homo sapiens
tcagaatgctgaatg

SEQ ID NO: 4393 - DNA, 15 bp, Homo sapiens
ctcagaatgctgaat

SEQ ID NO: 4394 - DNA, 15 bp, Homo sapiens
actcagaatgctgaa

SEQ ID NO: 4395 - DNA, 15 bp, Homo sapiens
gactcagaatgctga

SEQ ID NO: 4396 - DNA, 15 bp, Homo sapiens
tgactcagaatgctg

SEQ ID NO: 4397 - DNA, 15 bp, Homo sapiens
ctgactcagaatgct

SEQ ID NO: 4398 - DNA, 15 bp, Homo sapiens
actgactcagaatgc

SEQ ID NO: 4399 - DNA, 15 bp, Homo sapiens
gactgactcagaatg

SEQ ID NO: 4400 - DNA, 15 bp, Homo sapiens
tgactgactcagaat

SEQ ID NO: 4401 - DNA, 15 bp, Homo sapiens
gtgactgactcagaa

SEQ ID NO: 4402 - DNA, 15 bp, Homo sapiens
tgtgactgactcaga

SEQ ID NO: 4403 - DNA, 15 bp, Homo sapiens
ttgtgactgactcag

SEQ ID NO: 4404 - DNA, 15 bp, Homo sapiens
attgtgactgactca

SEQ ID NO: 4405 - DNA, 15 bp, Homo sapiens
cattgtgactgactc

SEQ ID NO: 4406 - DNA, 15 bp, Homo sapiens
acattgtgactgact

SEQ ID NO: 4407 - DNA, 15 bp, Homo sapiens
tacattgtgactgac

SEQ ID NO: 4408 - DNA, 15 bp, Homo sapiens
gtacattgtgactga

SEQ ID NO: 4409 - DNA, 15 bp, Homo sapiens
ggtacattgtgactg

SEQ ID NO: 4410 - DNA, 15 bp, Homo sapiens
aggtacattgtgact

SEQ ID NO: 4411 - DNA, 15 bp, Homo sapiens
gaggtacattgtgac

SEQ ID NO: 4412 - DNA, 15 bp, Homo sapiens
agaggtacattgtga

SEQ ID NO: 4413 - DNA, 15 bp, Homo sapiens
cagaggtacattgtg

SEQ ID NO: 4414 - DNA, 15 bp, Homo sapiens
tcagaggtacattgt

SEQ ID NO: 4415 - DNA, 15 bp, Homo sapiens
atcagaggtacattg

SEQ ID NO: 4416 - DNA, 15 bp, Homo sapiens
tatcagaggtacatt

SEQ ID NO: 4417 - DNA, 15 bp, Homo sapiens
ttatcagaggtacat

SEQ ID NO: 4418 - DNA, 15 bp, Homo sapiens
tttatcagaggtaca

SEQ ID NO: 4419 - DNA, 15 bp, Homo sapiens
ttttatcagaggtac

SEQ ID NO: 4420 - DNA, 15 bp, Homo sapiens
attttatcagaggta

SEQ ID NO: 4421 - DNA, 15 bp, Homo sapiens
cattttatcagaggt

SEQ ID NO: 4422 - DNA, 15 bp, Homo sapiens
acattttatcagagg

SEQ ID NO: 4423 - DNA, 15 bp, Homo sapiens
aacattttatcagag

SEQ ID NO: 4424 - DNA, 15 bp, Homo sapiens
aaacattttatcaga

SEQ ID NO: 4425 - DNA, 15 bp, Homo sapiens
gaaacattttatcag

SEQ ID NO: 4426 - DNA, 15 bp, Homo sapiens
agaaacattttatca

SEQ ID NO: 4427 - DNA, 15 bp, Homo sapiens
aagaaacattttatc

SEQ ID NO: 4428 - DNA, 15 bp, Homo sapiens
gaagaaacattttat

SEQ ID NO: 4429 - DNA, 15 bp, Homo sapiens
agaagaaacatttta

SEQ ID NO: 4430 - DNA, 15 bp, Homo sapiens
aagaagaaacatttt

SEQ ID NO: 4431 - DNA, 15 bp, Homo sapiens
caagaagaaacattt

SEQ ID NO: 4432 - DNA, 15 bp, Homo sapiens
tcaagaagaaacatt

SEQ ID NO: 4433 - DNA, 15 bp, Homo sapiens
atcaagaagaaacat

SEQ ID NO: 4434 - DNA, 15 bp, Homo sapiens
aatcaagaagaaaca

SEQ ID NO: 4435 - DNA, 15 bp, Homo sapiens
caatcaagaagaaac

SEQ ID NO: 4436 - DNA, 15 bp, Homo sapiens
tcaatcaagaagaaa

SEQ ID NO: 4437 - DNA, 15 bp, Homo sapiens
atcaatcaagaagaa

SEQ ID NO: 4438 - DNA, 15 bp, Homo sapiens
aatcaatcaagaaga

SEQ ID NO: 4439 - DNA, 15 bp, Homo sapiens
taatcaatcaagaag

SEQ ID NO: 4440 - DNA, 15 bp, Homo sapiens
ttaatcaatcaagaa

SEQ ID NO: 4441 - DNA, 15 bp, Homo sapiens
tttaatcaatcaaga

SEQ ID NO: 4442 - DNA, 15 bp, Homo sapiens
ttttaatcaatcaag

SEQ ID NO: 4443 - DNA, 15 bp, Homo sapiens
tttttaatcaatcaa

SEQ ID NO: 4444 - DNA, 15 bp, Homo sapiens
ttttttaatcaatca

SEQ ID NO: 4445 - DNA, 15 bp, Homo sapiens
attttttaatcaatc

SEQ ID NO: 4446 - DNA, 15 bp, Homo sapiens
aattttttaatcaat

SEQ ID NO: 4447 - DNA, 15 bp, Homo sapiens
aaattttttaatcaa

SEQ ID NO: 4448 - DNA, 15 bp, Homo sapiens
aaaattttttaatca

SEQ ID NO: 4449 - DNA, 15 bp, Homo sapiens
gaaaattttttaatc

SEQ ID NO: 4450 - DNA, 15 bp, Homo sapiens
ggaaaattttttaat

SEQ ID NO: 4451 - DNA, 15 bp, Homo sapiens
gggaaaattttttaa

SEQ ID NO: 4452 - DNA, 15 bp, Homo sapiens
ggggaaaatttttta

SEQ ID NO: 4453 - DNA, 15 bp, Homo sapiens
gggggaaaatttttt

SEQ ID NO: 4454 - DNA, 15 bp, Homo sapiens
tgggggaaaattttt

SEQ ID NO: 4455 - DNA, 15 bp, Homo sapiens
ctgggggaaaatttt

SEQ ID NO: 4456 - DNA, 15 bp, Homo sapiens
tctgggggaaaattt

SEQ ID NO: 4457 - DNA, 15 bp, Homo sapiens
ttctgggggaaaatt

SEQ ID NO: 4458 - DNA, 15 bp, Homo sapiens
tttctgggggaaaat

SEQ ID NO: 4459 - DNA, 15 bp, Homo sapiens
ttttctgggggaaaa

SEQ ID NO: 4460 - DNA, 15 bp, Homo sapiens
attttctgggggaaa

SEQ ID NO: 4461 - DNA, 15 bp, Homo sapiens
cattttctgggggaa

SEQ ID NO: 4462 - DNA, 15 bp, Homo sapiens
ccattttctggggga

SEQ ID NO: 4463 - DNA, 15 bp, Homo sapiens
gccattttctggggg

SEQ ID NO: 4464 - DNA, 15 bp, Homo sapiens
agccattttctgggg

SEQ ID NO: 4465 - DNA, 15 bp, Homo sapiens
cagccattttctggg

SEQ ID NO: 4466 - DNA, 15 bp, Homo sapiens
gcagccattttctgg

SEQ ID NO: 4467 - DNA, 15 bp, Homo sapiens
agcagccattttctg

SEQ ID NO: 4468 - DNA, 15 bp, Homo sapiens
cagcagccattttct

SEQ ID NO: 4469 - DNA, 15 bp, Homo sapiens
acagcagccattttc

SEQ ID NO: 4470 - DNA, 15 bp, Homo sapiens
aacagcagccatttt

SEQ ID NO: 4471 - DNA, 15 bp, Homo sapiens
aaacagcagccattt

SEQ ID NO: 4472 - DNA, 15 bp, Homo sapiens
aaaacagcagccatt

SEQ ID NO: 4473 - DNA, 15 bp, Homo sapiens
taaaacagcagccat

SEQ ID NO: 4474 - DNA, 15 bp, Homo sapiens
gtaaaacagcagcca

SEQ ID NO: 4475 - DNA, 15 bp, Homo sapiens
ggtaaaacagcagcc

SEQ ID NO: 4476 - DNA, 15 bp, Homo sapiens
tggtaaaacagcagc

SEQ ID NO: 4477 - DNA, 15 bp, Homo sapiens
ttggtaaaacagcag

SEQ ID NO: 4478 - DNA, 15 bp, Homo sapiens
attggtaaaacagca

SEQ ID NO: 4479 - DNA, 15 bp, Homo sapiens
aattggtaaaacagc

SEQ ID NO: 4480 - DNA, 15 bp, Homo sapiens
taattggtaaaacag

SEQ ID NO: 4481 - DNA, 15 bp, Homo sapiens
ttaattggtaaaaca

SEQ ID NO: 4482 - DNA, 15 bp, Homo sapiens
cttaattggtaaaac

SEQ ID NO: 4483 - DNA, 15 bp, Homo sapiens
ccttaattggtaaaa

SEQ ID NO: 4484 - DNA, 15 bp, Homo sapiens
cccttaattggtaaa

SEQ ID NO: 4485 - DNA, 15 bp, Homo sapiens
tcccttaattggtaa

SEQ ID NO: 4486 - DNA, 15 bp, Homo sapiens
ttcccttaattggta

SEQ ID NO: 4487 - DNA, 15 bp, Homo sapiens
tttcccttaattggt

SEQ ID NO: 4488 - DNA, 15 bp, Homo sapiens
atttcccttaattgg

SEQ ID NO: 4489 - DNA, 15 bp, Homo sapiens
catttcccttaattg

SEQ ID NO: 4490 - DNA, 15 bp, Homo sapiens
tcatttcccttaatt

SEQ ID NO: 4491 - DNA, 15 bp, Homo sapiens
ctcatttcccttaat

SEQ ID NO: 4492 - DNA, 15 bp, Homo sapiens
actcatttcccttaa

SEQ ID NO: 4493 - DNA, 15 bp, Homo sapiens
tactcatttccctta

SEQ ID NO: 4494 - DNA, 15 bp, Homo sapiens
ctactcatttccctt

SEQ ID NO: 4495 - DNA, 15 bp, Homo sapiens
tctactcatttccct

SEQ ID NO: 4496 - DNA, 15 bp, Homo sapiens
gtctactcatttccc

SEQ ID NO: 4497 - DNA, 15 bp, Homo sapiens
ggtctactcatttcc

SEQ ID NO: 4498 - DNA, 15 bp, Homo sapiens
gggtctactcatttc

SEQ ID NO: 4499 - DNA, 15 bp, Homo sapiens
cgggtctactcattt

SEQ ID NO: 4500 - DNA, 15 bp, Homo sapiens
tcgggtctactcatt

SEQ ID NO: 4501 - DNA, 15 bp, Homo sapiens
atcgggtctactcat

SEQ ID NO: 4502 - DNA, 15 bp, Homo sapiens
aatcgggtctactca

SEQ ID NO: 4503 - DNA, 15 bp, Homo sapiens
taatcgggtctactc

SEQ ID NO: 4504 - DNA, 15 bp, Homo sapiens
ttaatcgggtctact

SEQ ID NO: 4505 - DNA, 15 bp, Homo sapiens
gttaatcgggtctac

SEQ ID NO: 4506 - DNA, 15 bp, Homo sapiens
agttaatcgggtcta

SEQ ID NO: 4507 - DNA, 15 bp, Homo sapiens
tagttaatcgggtct

SEQ ID NO: 4508 - DNA, 15 bp, Homo sapiens
atagttaatcgggtc

SEQ ID NO: 4509 - DNA, 15 bp, Homo sapiens
tatagttaatcgggt

SEQ ID NO: 4510 - DNA, 15 bp, Homo sapiens
ctatagttaatcggg

SEQ ID NO: 4511 - DNA, 15 bp, Homo sapiens
actatagttaatcgg

SEQ ID NO: 4512 - DNA, 15 bp, Homo sapiens
aactatagttaatcg

SEQ ID NO: 4513 - DNA, 15 bp, Homo sapiens
aaactatagttaatc

SEQ ID NO: 4514 - DNA, 15 bp, Homo sapiens
taaactatagttaat

SEQ ID NO: 4515 - DNA, 15 bp, Homo sapiens
ataaactatagttaa

SEQ ID NO: 4516 - DNA, 15 bp, Homo sapiens
gataaactatagtta

SEQ ID NO: 4517 - DNA, 15 bp, Homo sapiens
tgataaactatagtt

SEQ ID NO: 4518 - DNA, 15 bp, Homo sapiens
ttgataaactatagt

SEQ ID NO: 4519 - DNA, 15 bp, Homo sapiens
attgataaactatag

SEQ ID NO: 4520 - DNA, 15 bp, Homo sapiens
tattgataaactata

SEQ ID NO: 4521 - DNA, 15 bp, Homo sapiens
gtattgataaactat

SEQ ID NO: 4522 - DNA, 15 bp, Homo sapiens
tgtattgataaacta

SEQ ID NO: 4523 - DNA, 15 bp, Homo sapiens
atgtattgataaact

SEQ ID NO: 4524 - DNA, 15 bp, Homo sapiens
aatgtattgataaac

SEQ ID NO: 4525 - DNA, 15 bp, Homo sapiens
caatgtattgataaa

SEQ ID NO: 4526 - DNA, 15 bp, Homo sapiens
acaatgtattgataa

SEQ ID NO: 4527 - DNA, 15 bp, Homo sapiens
gacaatgtattgata

SEQ ID NO: 4528 - DNA, 15 bp, Homo sapiens
tgacaatgtattgat

SEQ ID NO: 4529 - DNA, 15 bp, Homo sapiens
atgacaatgtattga

SEQ ID NO: 4530 - DNA, 15 bp, Homo sapiens
catgacaatgtattg

SEQ ID NO: 4531 - DNA, 15 bp, Homo sapiens
ccatgacaatgtatt

SEQ ID NO: 4532 - DNA, 15 bp, Homo sapiens
cccatgacaatgtat

SEQ ID NO: 4533 - DNA, 15 bp, Homo sapiens
ccccatgacaatgta

SEQ ID NO: 4534 - DNA, 15 bp, Homo sapiens
gccccatgacaatgt

SEQ ID NO: 4535 - DNA, 15 bp, Homo sapiens
tgccccatgacaatg

SEQ ID NO: 4536 - DNA, 15 bp, Homo sapiens
ttgccccatgacaat

SEQ ID NO: 4537 - DNA, 15 bp, Homo sapiens
tttgccccatgacaa

SEQ ID NO: 4538 - DNA, 15 bp, Homo sapiens
ttttgccccatgaca

SEQ ID NO: 4539 - DNA, 15 bp, Homo sapiens
attttgccccatgac

SEQ ID NO: 4540 - DNA, 15 bp, Homo sapiens
tattttgccccatga

SEQ ID NO: 4541 - DNA, 15 bp, Homo sapiens
ttattttgccccatg

SEQ ID NO: 4542 - DNA, 15 bp, Homo sapiens
tttattttgccccat

SEQ ID NO: 4543 - DNA, 15 bp, Homo sapiens
atttattttgcccca

SEQ ID NO: 4544 - DNA, 15 bp, Homo sapiens
catttattttgcccc

SEQ ID NO: 4545 - DNA, 15 bp, Homo sapiens
tcatttattttgccc

SEQ ID NO: 4546 - DNA, 15 bp, Homo sapiens
atcatttattttgcc

SEQ ID NO: 4547 - DNA, 15 bp, Homo sapiens
tatcatttattttgc

SEQ ID NO: 4548 - DNA, 15 bp, Homo sapiens
gtatcatttattttg

SEQ ID NO: 4549 - DNA, 15 bp, Homo sapiens
tgtatcatttatttt

SEQ ID NO: 4550 - DNA, 15 bp, Homo sapiens
atgtatcatttattt

SEQ ID NO: 4551 - DNA, 15 bp, Homo sapiens
aatgtatcatttatt

SEQ ID NO: 4552 - DNA, 15 bp, Homo sapiens
aaatgtatcatttat

SEQ ID NO: 4553 - DNA, 15 bp, Homo sapiens
caaatgtatcattta

SEQ ID NO: 4554 - DNA, 15 bp, Homo sapiens
ccaaatgtatcattt

SEQ ID NO: 4555 - DNA, 15 bp, Homo sapiens
tccaaatgtatcatt

SEQ ID NO: 4556 - DNA, 15 bp, Homo sapiens
ctccaaatgtatcat

SEQ ID NO: 4557 - DNA, 15 bp, Homo sapiens
gctccaaatgtatca

SEQ ID NO: 4558 - DNA, 15 bp, Homo sapiens
agctccaaatgtatc

SEQ ID NO: 4559 - DNA, 15 bp, Homo sapiens
tagctccaaatgtat

SEQ ID NO: 4560 - DNA, 15 bp, Homo sapiens
ctagctccaaatgta

SEQ ID NO: 4561 - DNA, 15 bp, Homo sapiens
actagctccaaatgt

SEQ ID NO: 4562 - DNA, 15 bp, Homo sapiens
cactagctccaaatg

SEQ ID NO: 4563 - DNA, 15 bp, Homo sapiens
acactagctccaaat

SEQ ID NO: 4564 - DNA, 15 bp, Homo sapiens
tacactagctccaaa

SEQ ID NO: 4565 - DNA, 15 bp, Homo sapiens
ttacactagctccaa

SEQ ID NO: 4566 - DNA, 15 bp, Homo sapiens
cttacactagctcca

SEQ ID NO: 4567 - DNA, 15 bp, Homo sapiens
tcttacactagctcc

SEQ ID NO: 4568 - DNA, 15 bp, Homo sapiens
atcttacactagctc

SEQ ID NO: 4569 - DNA, 15 bp, Homo sapiens
aatcttacactagct

SEQ ID NO: 4570 - DNA, 15 bp, Homo sapiens
aaatcttacactagc

SEQ ID NO: 4571 - DNA, 15 bp, Homo sapiens
caaatcttacactag

SEQ ID NO: 4572 - DNA, 15 bp, Homo sapiens
acaaatcttacacta

SEQ ID NO: 4573 - DNA, 15 bp, Homo sapiens
tacaaatcttacact

SEQ ID NO: 4574 - DNA, 15 bp, Homo sapiens
atacaaatcttacac

SEQ ID NO: 4575 - DNA, 15 bp, Homo sapiens
aatacaaatcttaca

SEQ ID NO: 4576 - DNA, 15 bp, Homo sapiens
aaatacaaatcttac

SEQ ID NO: 4577 - DNA, 15 bp, Homo sapiens
taaatacaaatctta

SEQ ID NO: 4578 - DNA, 15 bp, Homo sapiens
ttaaatacaaatctt

SEQ ID NO: 4579 - DNA, 15 bp, Homo sapiens
gttaaatacaaatct

SEQ ID NO: 4580 - DNA, 15 bp, Homo sapiens
agttaaatacaaatc

SEQ ID NO: 4581 - DNA, 15 bp, Homo sapiens
cagttaaatacaaat

SEQ ID NO: 4582 - DNA, 15 bp, Homo sapiens
ccagttaaatacaaa

SEQ ID NO: 4583 - DNA, 15 bp, Homo sapiens
cccagttaaatacaa

SEQ ID NO: 4584 - DNA, 15 bp, Homo sapiens
acccagttaaataca

SEQ ID NO: 4585 - DNA, 15 bp, Homo sapiens
tacccagttaaatac

SEQ ID NO: 4586 - DNA, 15 bp, Homo sapiens
gtacccagttaaata

SEQ ID NO: 4587 - DNA, 15 bp, Homo sapiens
tgtacccagttaaat

SEQ ID NO: 4588 - DNA, 15 bp, Homo sapiens
atgtacccagttaaa

SEQ ID NO: 4589 - DNA, 15 bp, Homo sapiens
tatgtacccagttaa

SEQ ID NO: 4590 - DNA, 15 bp, Homo sapiens
ttatgtacccagtta

SEQ ID NO: 4591 - DNA, 15 bp, Homo sapiens
attatgtacccagtt

SEQ ID NO: 4592 - DNA, 15 bp, Homo sapiens
tattatgtacccagt

SEQ ID NO: 4593 - DNA, 15 bp, Homo sapiens
ctattatgtacccag

SEQ ID NO: 4594 - DNA, 15 bp, Homo sapiens
gctattatgtaccca

SEQ ID NO: 4595 - DNA, 15 bp, Homo sapiens
cgctattatgtaccc

SEQ ID NO: 4596 - DNA, 15 bp, Homo sapiens
acgctattatgtacc

SEQ ID NO: 4597 - DNA, 15 bp, Homo sapiens
aacgctattatgtac

SEQ ID NO: 4598 - DNA, 15 bp, Homo sapiens
caacgctattatgta

SEQ ID NO: 4599 - DNA, 15 bp, Homo sapiens
ccaacgctattatgt

SEQ ID NO: 4600 - DNA, 15 bp, Homo sapiens
gccaacgctattatg

SEQ ID NO: 4601 - DNA, 15 bp, Homo sapiens
tgccaacgctattat

SEQ ID NO: 4602 - DNA, 15 bp, Homo sapiens
ctgccaacgctatta

SEQ ID NO: 4603 - DNA, 15 bp, Homo sapiens
actgccaacgctatt

SEQ ID NO: 4604 - DNA, 15 bp, Homo sapiens
aactgccaacgctat

SEQ ID NO: 4605 - DNA, 15 bp, Homo sapiens
taactgccaacgcta

SEQ ID NO: 4606 - DNA, 15 bp, Homo sapiens
ttaactgccaacgct

SEQ ID NO: 4607 - DNA, 15 bp, Homo sapiens
tttaactgccaacgc

SEQ ID NO: 4608 - DNA, 15 bp, Homo sapiens
atttaactgccaacg

SEQ ID NO: 4609 - DNA, 15 bp, Homo sapiens
tatttaactgccaac

SEQ ID NO: 4610 - DNA, 15 bp, Homo sapiens
ttatttaactgccaa

SEQ ID NO: 4611 - DNA, 15 bp, Homo sapiens
attatttaactgcca

SEQ ID NO: 4612 - DNA, 15 bp, Homo sapiens
cattatttaactgcc

SEQ ID NO: 4613 - DNA, 15 bp, Homo sapiens
ccattatttaactgc

SEQ ID NO: 4614 - DNA, 15 bp, Homo sapiens
cccattatttaactg

SEQ ID NO: 4615 - DNA, 15 bp, Homo sapiens
ccccattatttaact

SEQ ID NO: 4616 - DNA, 15 bp, Homo sapiens
accccattatttaac

SEQ ID NO: 4617 - DNA, 15 bp, Homo sapiens
gaccccattatttaa

SEQ ID NO: 4618 - DNA, 15 bp, Homo sapiens
ggaccccattattta

SEQ ID NO: 4619 - DNA, 15 bp, Homo sapiens
cggaccccattattt

SEQ ID NO: 4620 - DNA, 15 bp, Homo sapiens
tcggaccccattatt

SEQ ID NO: 4621 - DNA, 15 bp, Homo sapiens
atcggaccccattat

SEQ ID NO: 4622 - DNA, 15 bp, Homo sapiens
tatcggaccccatta

SEQ ID NO: 4623 - DNA, 15 bp, Homo sapiens
ttatcggaccccatt

SEQ ID NO: 4624 - DNA, 15 bp, Homo sapiens
cttatcggaccccat

SEQ ID NO: 4625 - DNA, 15 bp, Homo sapiens
ccttatcggacccca

SEQ ID NO: 4626 - DNA, 15 bp, Homo sapiens
accttatcggacccc

SEQ ID NO: 4627 - DNA, 15 bp, Homo sapiens
gaccttatcggaccc

SEQ ID NO: 4628 - DNA, 15 bp, Homo sapiens
tgaccttatcggacc

SEQ ID NO: 4629 - DNA, 15 bp, Homo sapiens
atgaccttatcggac

SEQ ID NO: 4630 - DNA, 15 bp, Homo sapiens
aatgaccttatcgga

SEQ ID NO: 4631 - DNA, 15 bp, Homo sapiens
caatgaccttatcgg

SEQ ID NO: 4632 - DNA, 15 bp, Homo sapiens
ccaatgaccttatcg

SEQ ID NO: 4633 - DNA, 15 bp, Homo sapiens
cccaatgaccttatc

SEQ ID NO: 4634 - DNA, 15 bp, Homo sapiens
tcccaatgaccttat

SEQ ID NO: 4635 - DNA, 15 bp, Homo sapiens
ttcccaatgacctta

SEQ ID NO: 4636 - DNA, 15 bp, Homo sapiens
gttcccaatgacctt

SEQ ID NO: 4637 - DNA, 15 bp, Homo sapiens
agttcccaatgacct

SEQ ID NO: 4638 - DNA, 15 bp, Homo sapiens
aagttcccaatgacc

SEQ ID NO: 4639 - DNA, 15 bp, Homo sapiens
gaagttcccaatgac

SEQ ID NO: 4640 - DNA, 15 bp, Homo sapiens
agaagttcccaatga

SEQ ID NO: 4641 - DNA, 15 bp, Homo sapiens
aagaagttcccaatg

SEQ ID NO: 4642 - DNA, 15 bp, Homo sapiens
taagaagttcccaat

SEQ ID NO: 4643 - DNA, 15 bp, Homo sapiens
ttaagaagttcccaa

SEQ ID NO: 4644 - DNA, 15 bp, Homo sapiens
tttaagaagttccca

SEQ ID NO: 4645 - DNA, 15 bp, Homo sapiens
ttttaagaagttccc

SEQ ID NO: 4646 - DNA, 15 bp, Homo sapiens
tttttaagaagttcc

SEQ ID NO: 4647 - DNA, 15 bp, Homo sapiens
atttttaagaagttc

SEQ ID NO: 4648 - DNA, 15 bp, Homo sapiens
aatttttaagaagtt

SEQ ID NO: 4649 - DNA, 15 bp, Homo sapiens
taatttttaagaagt

SEQ ID NO: 4650 - DNA, 15 bp, Homo sapiens
ttaatttttaagaag

SEQ ID NO: 4651 - DNA, 15 bp, Homo sapiens
attaatttttaagaa

SEQ ID NO: 4652 - DNA, 15 bp, Homo sapiens
gattaatttttaaga

SEQ ID NO: 4653 - DNA, 15 bp, Homo sapiens
tgattaatttttaag

SEQ ID NO: 4654 - DNA, 15 bp, Homo sapiens
ctgattaatttttaa

SEQ ID NO: 4655 - DNA, 15 bp, Homo sapiens
gctgattaattttta

SEQ ID NO: 4656 - DNA, 15 bp, Homo sapiens
agctgattaattttt

SEQ ID NO: 4657 - DNA, 15 bp, Homo sapiens
cagctgattaatttt

SEQ ID NO: 4658 - DNA, 15 bp, Homo sapiens
tcagctgattaattt

SEQ ID NO: 4659 - DNA, 15 bp, Homo sapiens
gtcagctgattaatt

SEQ ID NO: 4660 - DNA, 15 bp, Homo sapiens
agtcagctgattaat

SEQ ID NO: 4661 - DNA, 15 bp, Homo sapiens
tagtcagctgattaa

SEQ ID NO: 4662 - DNA, 15 bp, Homo sapiens
gtagtcagctgatta

SEQ ID NO: 4663 - DNA, 15 bp, Homo sapiens
tgtagtcagctgatt

SEQ ID NO: 4664 - DNA, 15 bp, Homo sapiens
ttgtagtcagctgat

SEQ ID NO: 4665 - DNA, 15 bp, Homo sapiens
cttgtagtcagctga

SEQ ID NO: 4666 - DNA, 15 bp, Homo sapiens
gcttgtagtcagctg

SEQ ID NO: 4667 - DNA, 15 bp, Homo sapiens
ggcttgtagtcagct

SEQ ID NO: 4668 - DNA, 15 bp, Homo sapiens
tggcttgtagtcagc

SEQ ID NO: 4669 - DNA, 15 bp, Homo sapiens
ctggcttgtagtcag

SEQ ID NO: 4670 - DNA, 15 bp, Homo sapiens
tctggcttgtagtca

SEQ ID NO: 4671 - DNA, 15 bp, Homo sapiens
ttctggcttgtagtc

SEQ ID NO: 4672 - DNA, 15 bp, Homo sapiens
cttctggcttgtagt

SEQ ID NO: 4673 - DNA, 15 bp, Homo sapiens
gcttctggcttgtag

SEQ ID NO: 4674 - DNA, 15 bp, Homo sapiens
tgcttctggcttgta

SEQ ID NO: 4675 - DNA, 15 bp, Homo sapiens
ttgcttctggcttgt

SEQ ID NO: 4676 - DNA, 15 bp, Homo sapiens
tttgcttctggcttg

SEQ ID NO: 4677 - DNA, 15 bp, Homo sapiens
ttttgcttctggctt

SEQ ID NO: 4678 - DNA, 15 bp, Homo sapiens
attttgcttctggct

SEQ ID NO: 4679 - DNA, 15 bp, Homo sapiens
tattttgcttctggc

SEQ ID NO: 4680 - DNA, 15 bp, Homo sapiens
gtattttgcttctgg

SEQ ID NO: 4681 - DNA, 15 bp, Homo sapiens
tgtattttgcttctg

SEQ ID NO: 4682 - DNA, 15 bp, Homo sapiens
atgtattttgcttct

SEQ ID NO: 4683 - DNA, 15 bp, Homo sapiens
aatgtattttgcttc

SEQ ID NO: 4684 - DNA, 15 bp, Homo sapiens
aaatgtattttgctt

SEQ ID NO: 4685 - DNA, 15 bp, Homo sapiens
aaaatgtattttgct

SEQ ID NO: 4686 - DNA, 15 bp, Homo sapiens
aaaaatgtattttgc

SEQ ID NO: 4687 - DNA, 15 bp, Homo sapiens
taaaaatgtattttg

SEQ ID NO: 4688 - DNA, 15 bp, Homo sapiens
gtaaaaatgtatttt

SEQ ID NO: 4689 - DNA, 15 bp, Homo sapiens
agtaaaaatgtattt

SEQ ID NO: 4690 - DNA, 15 bp, Homo sapiens
cagtaaaaatgtatt

SEQ ID NO: 4691 - DNA, 15 bp, Homo sapiens
tcagtaaaaatgtat

SEQ ID NO: 4692 - DNA, 15 bp, Homo sapiens
ttcagtaaaaatgta

SEQ ID NO: 4693 - DNA, 15 bp, Homo sapiens
attcagtaaaaatgt

SEQ ID NO: 4694 - DNA, 15 bp, Homo sapiens
aattcagtaaaaatg

SEQ ID NO: 4695 - DNA, 15 bp, Homo sapiens
gaattcagtaaaaat

SEQ ID NO: 4696 - DNA, 15 bp, Homo sapiens
agaattcagtaaaaa

SEQ ID NO: 4697 - DNA, 15 bp, Homo sapiens
gagaattcagtaaaa

SEQ ID NO: 4698 - DNA, 15 bp, Homo sapiens
agagaattcagtaaa

SEQ ID NO: 4699 - DNA, 15 bp, Homo sapiens
cagagaattcagtaa

SEQ ID NO: 4700 - DNA, 15 bp, Homo sapiens
acagagaattcagta

SEQ ID NO: 4701 - DNA, 15 bp, Homo sapiens
cacagagaattcagt

SEQ ID NO: 4702 - DNA, 15 bp, Homo sapiens
acacagagaattcag

SEQ ID NO: 4703 - DNA, 15 bp, Homo sapiens
aacacagagaattca

SEQ ID NO: 4704 - DNA, 15 bp, Homo sapiens
taacacagagaattc

SEQ ID NO: 4705 - DNA, 15 bp, Homo sapiens
gtaacacagagaatt

SEQ ID NO: 4706 - DNA, 15 bp, Homo sapiens
tgtaacacagagaat

SEQ ID NO: 4707 - DNA, 15 bp, Homo sapiens
ttgtaacacagagaa

SEQ ID NO: 4708 - DNA, 15 bp, Homo sapiens
cttgtaacacagaga

SEQ ID NO: 4709 - DNA, 15 bp, Homo sapiens
acttgtaacacagag

SEQ ID NO: 4710 - DNA, 15 bp, Homo sapiens
aacttgtaacacaga

SEQ ID NO: 4711 - DNA, 15 bp, Homo sapiens
caacttgtaacacag

SEQ ID NO: 4712 - DNA, 15 bp, Homo sapiens
tcaacttgtaacaca

SEQ ID NO: 4713 - DNA, 15 bp, Homo sapiens
ttcaacttgtaacac

SEQ ID NO: 4714 - DNA, 15 bp, Homo sapiens
cttcaacttgtaaca

SEQ ID NO: 4715 - DNA, 15 bp, Homo sapiens
gcttcaacttgtaac

SEQ ID NO: 4716 - DNA, 15 bp, Homo sapiens
tgcttcaacttgtaa

SEQ ID NO: 4717 - DNA, 15 bp, Homo sapiens
ctgcttcaacttgta

SEQ ID NO: 4718 - DNA, 15 bp, Homo sapiens
actgcttcaacttgt

SEQ ID NO: 4719 - DNA, 15 bp, Homo sapiens
cactgcttcaacttg

SEQ ID NO: 4720 - DNA, 15 bp, Homo sapiens
acactgcttcaactt

SEQ ID NO: 4721 - DNA, 15 bp, Homo sapiens
cacactgcttcaact

SEQ ID NO: 4722 - DNA, 15 bp, Homo sapiens
ccacactgcttcaac

SEQ ID NO: 4723 - DNA, 15 bp, Homo sapiens
cccacactgcttcaa

SEQ ID NO: 4724 - DNA, 15 bp, Homo sapiens
tcccacactgcttca

SEQ ID NO: 4725 - DNA, 15 bp, Homo sapiens
ttcccacactgcttc

SEQ ID NO: 4726 - DNA, 15 bp, Homo sapiens
tttcccacactgctt

SEQ ID NO: 4727 - DNA, 15 bp, Homo sapiens
gtttcccacactgct

SEQ ID NO: 4728 - DNA, 15 bp, Homo sapiens
ggtttcccacactgc

SEQ ID NO: 4729 - DNA, 15 bp, Homo sapiens
tggtttcccacactg

SEQ ID NO: 4730 - DNA, 15 bp, Homo sapiens
atggtttcccacact

SEQ ID NO: 4731 - DNA, 15 bp, Homo sapiens
catggtttcccacac

SEQ ID NO: 4732 - DNA, 15 bp, Homo sapiens
gcatggtttcccaca

SEQ ID NO: 4733 - DNA, 15 bp, Homo sapiens
ggcatggtttcccac

SEQ ID NO: 4734 - DNA, 15 bp, Homo sapiens
tggcatggtttccca

SEQ ID NO: 4735 - DNA, 15 bp, Homo sapiens
gtggcatggtttccc

SEQ ID NO: 4736 - DNA, 15 bp, Homo sapiens
agtggcatggtttcc

SEQ ID NO: 4737 - DNA, 15 bp, Homo sapiens
cagtggcatggtttc

SEQ ID NO: 4738 - DNA, 15 bp, Homo sapiens
ccagtggcatggttt

SEQ ID NO: 4739 - DNA, 15 bp, Homo sapiens
accagtggcatggtt

SEQ ID NO: 4740 - DNA, 15 bp, Homo sapiens
caccagtggcatggt

SEQ ID NO: 4741 - DNA, 15 bp, Homo sapiens
acaccagtggcatgg

SEQ ID NO: 4742 - DNA, 15 bp, Homo sapiens
aacaccagtggcatg

SEQ ID NO: 4743 - DNA, 15 bp, Homo sapiens
taacaccagtggcat

SEQ ID NO: 4744 - DNA, 15 bp, Homo sapiens
gtaacaccagtggca

SEQ ID NO: 4745 - DNA, 15 bp, Homo sapiens
agtaacaccagtggc

SEQ ID NO: 4746 - DNA, 15 bp, Homo sapiens
tagtaacaccagtgg

SEQ ID NO: 4747 - DNA, 15 bp, Homo sapiens
atagtaacaccagtg

SEQ ID NO: 4748 - DNA, 15 bp, Homo sapiens
aatagtaacaccagt

SEQ ID NO: 4749 - DNA, 15 bp, Homo sapiens
caatagtaacaccag

SEQ ID NO: 4750 - DNA, 15 bp, Homo sapiens
ccaatagtaacacca

SEQ ID NO: 4751 - DNA, 15 bp, Homo sapiens
cccaatagtaacacc

SEQ ID NO: 4752 - DNA, 15 bp, Homo sapiens
ccccaatagtaacac

SEQ ID NO: 4753 - DNA, 15 bp, Homo sapiens
accccaatagtaaca

SEQ ID NO: 4754 - DNA, 15 bp, Homo sapiens
aaccccaatagtaac

SEQ ID NO: 4755 - DNA, 15 bp, Homo sapiens
caaccccaatagtaa

SEQ ID NO: 4756 - DNA, 15 bp, Homo sapiens
gcaaccccaatagta

SEQ ID NO: 4757 - DNA, 15 bp, Homo sapiens
tgcaaccccaatagt

SEQ ID NO: 4758 - DNA, 15 bp, Homo sapiens
gtgcaaccccaatag

SEQ ID NO: 4759 - DNA, 15 bp, Homo sapiens
agtgcaaccccaata

SEQ ID NO: 4760 - DNA, 15 bp, Homo sapiens
cagtgcaaccccaat

SEQ ID NO: 4761 - DNA, 15 bp, Homo sapiens
ccagtgcaaccccaa

SEQ ID NO: 4762 - DNA, 15 bp, Homo sapiens
cccagtgcaacccca

SEQ ID NO: 4763 - DNA, 15 bp, Homo sapiens
acccagtgcaacccc

SEQ ID NO: 4764 - DNA, 15 bp, Homo sapiens
gacccagtgcaaccc

SEQ ID NO: 4765 - DNA, 15 bp, Homo sapiens
agacccagtgcaacc

SEQ ID NO: 4766 - DNA, 15 bp, Homo sapiens
cagacccagtgcaac

SEQ ID NO: 4767 - DNA, 15 bp, Homo sapiens
acagacccagtgcaa

SEQ ID NO: 4768 - DNA, 15 bp, Homo sapiens
aacagacccagtgca

SEQ ID NO: 4769 - DNA, 15 bp, Homo sapiens
aaacagacccagtgc

SEQ ID NO: 4770 - DNA, 15 bp, Homo sapiens
aaaacagacccagtg

SEQ ID NO: 4771 - DNA, 15 bp, Homo sapiens
aaaaacagacccagt

SEQ ID NO: 4772 - DNA, 15 bp, Homo sapiens
aaaaaacagacccag

SEQ ID NO: 4773 - DNA, 15 bp, Homo sapiens
caaaaaacagaccca

SEQ ID NO: 4774 - DNA, 15 bp, Homo sapiens
tcaaaaaacagaccc

SEQ ID NO: 4775 - DNA, 15 bp, Homo sapiens
ctcaaaaaacagacc

SEQ ID NO: 4776 - DNA, 15 bp, Homo sapiens
actcaaaaaacagac

SEQ ID NO: 4777 - DNA, 15 bp, Homo sapiens
cactcaaaaaacaga

SEQ ID NO: 4778 - DNA, 15 bp, Homo sapiens
ccactcaaaaaacag

SEQ ID NO: 4779 - DNA, 15 bp, Homo sapiens
gccactcaaaaaaca

SEQ ID NO: 4780 - DNA, 15 bp, Homo sapiens
ggccactcaaaaaac

SEQ ID NO: 4781 - DNA, 15 bp, Homo sapiens
tggccactcaaaaaa

SEQ ID NO: 4782 - DNA, 15 bp, Homo sapiens
ctggccactcaaaaa

SEQ ID NO: 4783 - DNA, 15 bp, Homo sapiens
actggccactcaaaa

SEQ ID NO: 4784 - DNA, 15 bp, Homo sapiens
aactggccactcaaa

SEQ ID NO: 4785 - DNA, 15 bp, Homo sapiens
aaactggccactcaa

SEQ ID NO: 4786 - DNA, 15 bp, Homo sapiens
caaactggccactca

SEQ ID NO: 4787 - DNA, 15 bp, Homo sapiens
tcaaactggccactc

SEQ ID NO: 4788 - DNA, 15 bp, Homo sapiens
ctcaaactggccact

SEQ ID NO: 4789 - DNA, 15 bp, Homo sapiens
actcaaactggccac

SEQ ID NO: 4790 - DNA, 15 bp, Homo sapiens
cactcaaactggcca

SEQ ID NO: 4791 - DNA, 15 bp, Homo sapiens
tcactcaaactggcc

SEQ ID NO: 4792 - DNA, 15 bp, Homo sapiens
gtcactcaaactggc

SEQ ID NO: 4793 - DNA, 15 bp, Homo sapiens
agtcactcaaactgg

SEQ ID NO: 4794 - DNA, 15 bp, Homo sapiens
aagtcactcaaactg

SEQ ID NO: 4795 - DNA, 15 bp, Homo sapiens
aaagtcactcaaact

SEQ ID NO: 4796 - DNA, 15 bp, Homo sapiens
taaagtcactcaaac

SEQ ID NO: 4797 - DNA, 15 bp, Homo sapiens
ataaagtcactcaaa

SEQ ID NO: 4798 - DNA, 15 bp, Homo sapiens
tataaagtcactcaa

SEQ ID NO: 4799 - DNA, 15 bp, Homo sapiens
atataaagtcactca

SEQ ID NO: 4800 - DNA, 15 bp, Homo sapiens
aatataaagtcactc

SEQ ID NO: 4801 - DNA, 15 bp, Homo sapiens
taatataaagtcact

SEQ ID NO: 4802 - DNA, 15 bp, Homo sapiens
ctaatataaagtcac

SEQ ID NO: 4803 - DNA, 15 bp, Homo sapiens
gctaatataaagtca

SEQ ID NO: 4804 - DNA, 15 bp, Homo sapiens
tgctaatataaagtc

SEQ ID NO: 4805 - DNA, 15 bp, Homo sapiens
atgctaatataaagt

SEQ ID NO: 4806 - DNA, 15 bp, Homo sapiens
aatgctaatataaag

SEQ ID NO: 4807 - DNA, 15 bp, Homo sapiens
aaatgctaatataaa

SEQ ID NO: 4808 - DNA, 15 bp, Homo sapiens
aaaatgctaatataa

SEQ ID NO: 4809 - DNA, 15 bp, Homo sapiens
taaaatgctaatata

SEQ ID NO: 4810 - DNA, 15 bp, Homo sapiens
ttaaaatgctaatat

SEQ ID NO: 4811 - DNA, 15 bp, Homo sapiens
tttaaaatgctaata

SEQ ID NO: 4812 - DNA, 15 bp, Homo sapiens
atttaaaatgctaat

SEQ ID NO: 4813 - DNA, 15 bp, Homo sapiens
aatttaaaatgctaa

SEQ ID NO: 4814 - DNA, 15 bp, Homo sapiens
taatttaaaatgcta

SEQ ID NO: 4815 - DNA, 15 bp, Homo sapiens
ttaatttaaaatgct

SEQ ID NO: 4816 - DNA, 15 bp, Homo sapiens
attaatttaaaatgc

SEQ ID NO: 4817 - DNA, 15 bp, Homo sapiens
cattaatttaaaatg

SEQ ID NO: 4818 - DNA, 15 bp, Homo sapiens
tcattaatttaaaat

SEQ ID NO: 4819 - DNA, 15 bp, Homo sapiens
atcattaatttaaaa

SEQ ID NO: 4820 - DNA, 15 bp, Homo sapiens
catcattaatttaaa

SEQ ID NO: 4821 - DNA, 15 bp, Homo sapiens
acatcattaatttaa

SEQ ID NO: 4822 - DNA, 15 bp, Homo sapiens
cacatcattaattta

SEQ ID NO: 4823 - DNA, 15 bp, Homo sapiens
acacatcattaattt

SEQ ID NO: 4824 - DNA, 15 bp, Homo sapiens
cacacatcattaatt

SEQ ID NO: 4825 - DNA, 15 bp, Homo sapiens
acacacatcattaat

SEQ ID NO: 4826 - DNA, 15 bp, Homo sapiens
cacacacatcattaa

SEQ ID NO: 4827 - DNA, 15 bp, Homo sapiens
ccacacacatcatta

SEQ ID NO: 4828 - DNA, 15 bp, Homo sapiens
cccacacacatcatt

SEQ ID NO: 4829 - DNA, 15 bp, Homo sapiens
acccacacacatcat

SEQ ID NO: 4830 - DNA, 15 bp, Homo sapiens
aacccacacacatca

SEQ ID NO: 4831 - DNA, 15 bp, Homo sapiens
aaacccacacacatc

SEQ ID NO: 4832 - DNA, 15 bp, Homo sapiens
aaaacccacacacat

SEQ ID NO: 4833 - DNA, 15 bp, Homo sapiens
caaaacccacacaca

SEQ ID NO: 4834 - DNA, 15 bp, Homo sapiens
acaaaacccacacac

SEQ ID NO: 4835 - DNA, 15 bp, Homo sapiens
aacaaaacccacaca

SEQ ID NO: 4836 - DNA, 15 bp, Homo sapiens
aaacaaaacccacac

SEQ ID NO: 4837 - DNA, 15 bp, Homo sapiens
caaacaaaacccaca

SEQ ID NO: 4838 - DNA, 15 bp, Homo sapiens
acaaacaaaacccac

SEQ ID NO: 4839 - DNA, 15 bp, Homo sapiens
aacaaacaaaaccca

SEQ ID NO: 4840 - DNA, 15 bp, Homo sapiens
gaacaaacaaaaccc

SEQ ID NO: 4841 - DNA, 15 bp, Homo sapiens
tgaacaaacaaaacc

SEQ ID NO: 4842 - DNA, 15 bp, Homo sapiens
atgaacaaacaaaac

SEQ ID NO: 4843 - DNA, 15 bp, Homo sapiens
aatgaacaaacaaaa

SEQ ID NO: 4844 - DNA, 15 bp, Homo sapiens
aaatgaacaaacaaa

SEQ ID NO: 4845 - DNA, 15 bp, Homo sapiens
aaaatgaacaaacaa

SEQ ID NO: 4846 - DNA, 15 bp, Homo sapiens
aaaaatgaacaaaca

SEQ ID NO: 4847 - DNA, 15 bp, Homo sapiens
aaaaaatgaacaaac

SEQ ID NO: 4848 - DNA, 15 bp, Homo sapiens
taaaaaatgaacaaa

SEQ ID NO: 4849 - DNA, 15 bp, Homo sapiens
gtaaaaaatgaacaa

SEQ ID NO: 4850 - DNA, 15 bp, Homo sapiens
agtaaaaaatgaaca

SEQ ID NO: 4851 - DNA, 15 bp, Homo sapiens
aagtaaaaaatgaac

SEQ ID NO: 4852 - DNA, 15 bp, Homo sapiens
aaagtaaaaaatgaa

SEQ ID NO: 4853 - DNA, 15 bp, Homo sapiens
caaagtaaaaaatga

SEQ ID NO: 4854 - DNA, 15 bp, Homo sapiens
tcaaagtaaaaaatg

SEQ ID NO: 4855 - DNA, 15 bp, Homo sapiens
ttcaaagtaaaaaat

SEQ ID NO: 4856 - DNA, 15 bp, Homo sapiens
cttcaaagtaaaaaa

SEQ ID NO: 4857 - DNA, 15 bp, Homo sapiens
acttcaaagtaaaaa

SEQ ID NO: 4858 - DNA, 15 bp, Homo sapiens
tacttcaaagtaaaa

SEQ ID NO: 4859 - DNA, 15 bp, Homo sapiens
ttacttcaaagtaaa

SEQ ID NO: 4860 - DNA, 15 bp, Homo sapiens
attacttcaaagtaa

SEQ ID NO: 4861 - DNA, 15 bp, Homo sapiens
aattacttcaaagta

SEQ ID NO: 4862 - DNA, 15 bp, Homo sapiens
taattacttcaaagt

SEQ ID NO: 4863 - DNA, 15 bp, Homo sapiens
ctaattacttcaaag

SEQ ID NO: 4864 - DNA, 15 bp, Homo sapiens
tctaattacttcaaa

SEQ ID NO: 4865 - DNA, 15 bp, Homo sapiens
ctctaattacttcaa

SEQ ID NO: 4866 - DNA, 15 bp, Homo sapiens
cctctaattacttca

SEQ ID NO: 4867 - DNA, 15 bp, Homo sapiens
gcctctaattacttc

SEQ ID NO: 4868 - DNA, 15 bp, Homo sapiens
agcctctaattactt

SEQ ID NO: 4869 - DNA, 15 bp, Homo sapiens
aagcctctaattact

SEQ ID NO: 4870 - DNA, 15 bp, Homo sapiens
taagcctctaattac

SEQ ID NO: 4871 - DNA, 15 bp, Homo sapiens
ataagcctctaatta

SEQ ID NO: 4872 - DNA, 15 bp, Homo sapiens
tataagcctctaatt

SEQ ID NO: 4873 - DNA, 15 bp, Homo sapiens
ctataagcctctaat

SEQ ID NO: 4874 - DNA, 15 bp, Homo sapiens
actataagcctctaa

SEQ ID NO: 4875 - DNA, 15 bp, Homo sapiens
aactataagcctcta

SEQ ID NO: 4876 - DNA, 15 bp, Homo sapiens
aaactataagcctct

SEQ ID NO: 4877 - DNA, 15 bp, Homo sapiens
caaactataagcctc

SEQ ID NO: 4878 - DNA, 15 bp, Homo sapiens
acaaactataagcct

SEQ ID NO: 4879 - DNA, 15 bp, Homo sapiens
tacaaactataagcc

SEQ ID NO: 4880 - DNA, 15 bp, Homo sapiens
ttacaaactataagc

SEQ ID NO: 4881 - DNA, 15 bp, Homo sapiens
cttacaaactataag

SEQ ID NO: 4882 - DNA, 15 bp, Homo sapiens
gcttacaaactataa

SEQ ID NO: 4883 - DNA, 15 bp, Homo sapiens
tgcttacaaactata

SEQ ID NO: 4884 - DNA, 15 bp, Homo sapiens
atgcttacaaactat

SEQ ID NO: 4885 - DNA, 15 bp, Homo sapiens
aatgcttacaaacta

SEQ ID NO: 4886 - DNA, 15 bp, Homo sapiens
aaatgcttacaaact

SEQ ID NO: 4887 - DNA, 15 bp, Homo sapiens
gaaatgcttacaaac

SEQ ID NO: 4888 - DNA, 15 bp, Homo sapiens
tgaaatgcttacaaa

SEQ ID NO: 4889 - DNA, 15 bp, Homo sapiens
ttgaaatgcttacaa

SEQ ID NO: 4890 - DNA, 15 bp, Homo sapiens
cttgaaatgcttaca

SEQ ID NO: 4891 - DNA, 15 bp, Homo sapiens
gcttgaaatgcttac

SEQ ID NO: 4892 - DNA, 15 bp, Homo sapiens
tgcttgaaatgctta

SEQ ID NO: 4893 - DNA, 15 bp, Homo sapiens
ctgcttgaaatgctt

SEQ ID NO: 4894 - DNA, 15 bp, Homo sapiens
cctgcttgaaatgct

SEQ ID NO: 4895 - DNA, 15 bp, Homo sapiens
acctgcttgaaatgc

SEQ ID NO: 4896 - DNA, 15 bp, Homo sapiens
aacctgcttgaaatg

SEQ ID NO: 4897 - DNA, 15 bp, Homo sapiens
aaacctgcttgaaat

SEQ ID NO: 4898 - DNA, 15 bp, Homo sapiens
aaaacctgcttgaaa

SEQ ID NO: 4899 - DNA, 15 bp, Homo sapiens
aaaaacctgcttgaa

SEQ ID NO: 4900 - DNA, 15 bp, Homo sapiens
taaaaacctgcttga

SEQ ID NO: 4901 - DNA, 15 bp, Homo sapiens
ttaaaaacctgcttg

SEQ ID NO: 4902 - DNA, 15 bp, Homo sapiens
tttaaaaacctgctt

SEQ ID NO: 4903 - DNA, 15 bp, Homo sapiens
atttaaaaacctgct

SEQ ID NO: 4904 - DNA, 15 bp, Homo sapiens
tatttaaaaacctgc

SEQ ID NO: 4905 - DNA, 15 bp, Homo sapiens
ttatttaaaaacctg

SEQ ID NO: 4906 - DNA, 15 bp, Homo sapiens
tttatttaaaaacct

SEQ ID NO: 4907 - DNA, 15 bp, Homo sapiens
atttatttaaaaacc

SEQ ID NO: 4908 - DNA, 15 bp, Homo sapiens
catttatttaaaaac

SEQ ID NO: 4909 - DNA, 15 bp, Homo sapiens
gcatttatttaaaaa

SEQ ID NO: 4910 - DNA, 15 bp, Homo sapiens
agcatttatttaaaa

SEQ ID NO: 4911 - DNA, 15 bp, Homo sapiens
aagcatttatttaaa

SEQ ID NO: 4912 - DNA, 15 bp, Homo sapiens
aaagcatttatttaa

SEQ ID NO: 4913 - DNA, 15 bp, Homo sapiens
taaagcatttattta

SEQ ID NO: 4914 - DNA, 15 bp, Homo sapiens
ttaaagcatttattt

SEQ ID NO: 4915 - DNA, 15 bp, Homo sapiens
attaaagcatttatt

SEQ ID NO: 4916 - DNA, 15 bp, Homo sapiens
aattaaagcatttat

SEQ ID NO: 4917 - DNA, 15 bp, Homo sapiens
aaattaaagcattta

SEQ ID NO: 4918 - DNA, 15 bp, Homo sapiens
aaaattaaagcattt

SEQ ID NO: 4919 - DNA, 15 bp, Homo sapiens
aaaaattaaagcatt

SEQ ID NO: 4920 - DNA, 15 bp, Homo sapiens
aaaaaattaaagcat

SEQ ID NO: 4921 - DNA, 15 bp, Homo sapiens
aaaaaaattaaagca

SEQ ID NO: 4922 - DNA, 15 bp, Homo sapiens
aaaaaaaattaaagc

SEQ ID NO: 4923 - DNA, 15 bp, Homo sapiens
taaaaaaaattaaag

SEQ ID NO: 4924 - DNA, 15 bp, Homo sapiens
ataaaaaaaattaaa

SEQ ID NO: 4925 - DNA, 15 bp, Homo sapiens
tataaaaaaaattaa

SEQ ID NO: 4926 - DNA, 15 bp, Homo sapiens
ttataaaaaaaatta

SEQ ID NO: 4927 - DNA, 15 bp, Homo sapiens
cttataaaaaaaatt

SEQ ID NO: 4928 - DNA, 15 bp, Homo sapiens
tcttataaaaaaaat

SEQ ID NO: 4929 - DNA, 15 bp, Homo sapiens
atcttataaaaaaaa

SEQ ID NO: 4930 - DNA, 15 bp, Homo sapiens
tatcttataaaaaaa

SEQ ID NO: 4931 - DNA, 15 bp, Homo sapiens
ctatcttataaaaaa

SEQ ID NO: 4932 - DNA, 15 bp, Homo sapiens
cctatcttataaaaa

SEQ ID NO: 4933 - DNA, 15 bp, Homo sapiens
tcctatcttataaaa

SEQ ID NO: 4934 - DNA, 15 bp, Homo sapiens
gtcctatcttataaa

SEQ ID NO: 4935 - DNA, 15 bp, Homo sapiens
ggtcctatcttataa

SEQ ID NO: 4936 - DNA, 15 bp, Homo sapiens
aggtcctatcttata

SEQ ID NO: 4937 - DNA, 15 bp, Homo sapiens
aaggtcctatcttat

SEQ ID NO: 4938 - DNA, 15 bp, Homo sapiens
caaggtcctatctta

SEQ ID NO: 4939 - DNA, 15 bp, Homo sapiens
ccaaggtcctatctt

SEQ ID NO: 4940 - DNA, 15 bp, Homo sapiens
gccaaggtcctatct

SEQ ID NO: 4941 - DNA, 15 bp, Homo sapiens
agccaaggtcctatc

SEQ ID NO: 4942 - DNA, 15 bp, Homo sapiens
aagccaaggtcctat

SEQ ID NO: 4943 - DNA, 15 bp, Homo sapiens
aaagccaaggtccta

SEQ ID NO: 4944 - DNA, 15 bp, Homo sapiens
caaagccaaggtcct

SEQ ID NO: 4945 - DNA, 15 bp, Homo sapiens
acaaagccaaggtcc

SEQ ID NO: 4946 - DNA, 15 bp, Homo sapiens
cacaaagccaaggtc

SEQ ID NO: 4947 - DNA, 15 bp, Homo sapiens
ccacaaagccaaggt

SEQ ID NO: 4948 - DNA, 15 bp, Homo sapiens
tccacaaagccaagg

SEQ ID NO: 4949 - DNA, 15 bp, Homo sapiens
ctccacaaagccaag

SEQ ID NO: 4950 - DNA, 15 bp, Homo sapiens
gctccacaaagccaa

SEQ ID NO: 4951 - DNA, 15 bp, Homo sapiens
tgctccacaaagcca

SEQ ID NO: 4952 - DNA, 15 bp, Homo sapiens
atgctccacaaagcc

SEQ ID NO: 4953 - DNA, 15 bp, Homo sapiens
aatgctccacaaagc

SEQ ID NO: 4954 - DNA, 15 bp, Homo sapiens
taatgctccacaaag

SEQ ID NO: 4955 - DNA, 15 bp, Homo sapiens
ataatgctccacaaa

SEQ ID NO: 4956 - DNA, 15 bp, Homo sapiens
tataatgctccacaa

SEQ ID NO: 4957 - DNA, 15 bp, Homo sapiens
ctataatgctccaca

SEQ ID NO: 4958 - DNA, 15 bp, Homo sapiens
tctataatgctccac

SEQ ID NO: 4959 - DNA, 15 bp, Homo sapiens
ctctataatgctcca

SEQ ID NO: 4960 - DNA, 15 bp, Homo sapiens
gctctataatgctcc

SEQ ID NO: 4961 - DNA, 15 bp, Homo sapiens
agctctataatgctc

SEQ ID NO: 4962 - DNA, 15 bp, Homo sapiens
tagctctataatgct

SEQ ID NO: 4963 - DNA, 15 bp, Homo sapiens
atagctctataatgc

SEQ ID NO: 4964 - DNA, 15 bp, Homo sapiens
tatagctctataatg

SEQ ID NO: 4965 - DNA, 15 bp, Homo sapiens
atatagctctataat

SEQ ID NO: 4966 - DNA, 15 bp, Homo sapiens
aatatagctctataa

SEQ ID NO: 4967 - DNA, 15 bp, Homo sapiens
aaatatagctctata

SEQ ID NO: 4968 - DNA, 15 bp, Homo sapiens
aaaatatagctctat

SEQ ID NO: 4969 - DNA, 15 bp, Homo sapiens
caaaatatagctcta

SEQ ID NO: 4970 - DNA, 15 bp, Homo sapiens
ccaaaatatagctct

SEQ ID NO: 4971 - DNA, 15 bp, Homo sapiens
tccaaaatatagctc

SEQ ID NO: 4972 - DNA, 15 bp, Homo sapiens
ctccaaaatatagct

SEQ ID NO: 4973 - DNA, 15 bp, Homo sapiens
actccaaaatatagc

SEQ ID NO: 4974 - DNA, 15 bp, Homo sapiens
aactccaaaatatag

SEQ ID NO: 4975 - DNA, 15 bp, Homo sapiens
caactccaaaatata

SEQ ID NO: 4976 - DNA, 15 bp, Homo sapiens
tcaactccaaaatat

SEQ ID NO: 4977 - DNA, 15 bp, Homo sapiens
ttcaactccaaaata

SEQ ID NO: 4978 - DNA, 15 bp, Homo sapiens
tttcaactccaaaat

SEQ ID NO: 4979 - DNA, 15 bp, Homo sapiens
atttcaactccaaaa

SEQ ID NO: 4980 - DNA, 15 bp, Homo sapiens
aatttcaactccaaa

SEQ ID NO: 4981 - DNA, 15 bp, Homo sapiens
aaatttcaactccaa

SEQ ID NO: 4982 - DNA, 15 bp, Homo sapiens
caaatttcaactcca

SEQ ID NO: 4983 - DNA, 15 bp, Homo sapiens
tcaaatttcaactcc

SEQ ID NO: 4984 - DNA, 15 bp, Homo sapiens
ctcaaatttcaactc

SEQ ID NO: 4985 - DNA, 15 bp, Homo sapiens
gctcaaatttcaact

SEQ ID NO: 4986 - DNA, 15 bp, Homo sapiens
agctcaaatttcaac

SEQ ID NO: 4987 - DNA, 15 bp, Homo sapiens
gagctcaaatttcaa

SEQ ID NO: 4988 - DNA, 15 bp, Homo sapiens
ggagctcaaatttca

SEQ ID NO: 4989 - DNA, 15 bp, Homo sapiens
aggagctcaaatttc

SEQ ID NO: 4990 - DNA, 15 bp, Homo sapiens
aaggagctcaaattt

SEQ ID NO: 4991 - DNA, 15 bp, Homo sapiens
aaaggagctcaaatt

SEQ ID NO: 4992 - DNA, 15 bp, Homo sapiens
aaaaggagctcaaat

SEQ ID NO: 4993 - DNA, 15 bp, Homo sapiens
aaaaaggagctcaaa

SEQ ID NO: 4994 - DNA, 15 bp, Homo sapiens
caaaaaggagctcaa

SEQ ID NO: 4995 - DNA, 15 bp, Homo sapiens
ccaaaaaggagctca

SEQ ID NO: 4996 - DNA, 15 bp, Homo sapiens
accaaaaaggagctc

SEQ ID NO: 4997 - DNA, 15 bp, Homo sapiens
taccaaaaaggagct

SEQ ID NO: 4998 - DNA, 15 bp, Homo sapiens
ttaccaaaaaggagc

SEQ ID NO: 4999 - DNA, 15 bp, Homo sapiens
gttaccaaaaaggag

SEQ ID NO: 5000 - DNA, 15 bp, Homo sapiens
agttaccaaaaagga

SEQ ID NO: 5001 - DNA, 15 bp, Homo sapiens
cagttaccaaaaagg

SEQ ID NO: 5002 - DNA, 15 bp, Homo sapiens
acagttaccaaaaag

SEQ ID NO: 5003 - DNA, 15 bp, Homo sapiens
cacagttaccaaaaa

SEQ ID NO: 5004 - DNA, 15 bp, Homo sapiens
ccacagttaccaaaa

SEQ ID NO: 5005 - DNA, 15 bp, Homo sapiens
tccacagttaccaaa

SEQ ID NO: 5006 - DNA, 15 bp, Homo sapiens
ctccacagttaccaa

SEQ ID NO: 5007 - DNA, 15 bp, Homo sapiens
actccacagttacca

SEQ ID NO: 5008 - DNA, 15 bp, Homo sapiens
aactccacagttacc

SEQ ID NO: 5009 - DNA, 15 bp, Homo sapiens
taactccacagttac

SEQ ID NO: 5010 - DNA, 15 bp, Homo sapiens
gtaactccacagtta

SEQ ID NO: 5011 - DNA, 15 bp, Homo sapiens
agtaactccacagtt

SEQ ID NO: 5012 - DNA, 15 bp, Homo sapiens
cagtaactccacagt

SEQ ID NO: 5013 - DNA, 15 bp, Homo sapiens
gcagtaactccacag

SEQ ID NO: 5014 - DNA, 15 bp, Homo sapiens
agcagtaactccaca

SEQ ID NO: 5015 - DNA, 15 bp, Homo sapiens
gagcagtaactccac

SEQ ID NO: 5016 - DNA, 15 bp, Homo sapiens
tgagcagtaactcca

SEQ ID NO: 5017 - DNA, 15 bp, Homo sapiens
ctgagcagtaactcc

SEQ ID NO: 5018 - DNA, 15 bp, Homo sapiens
cctgagcagtaactc

SEQ ID NO: 5019 - DNA, 15 bp, Homo sapiens
tcctgagcagtaact

SEQ ID NO: 5020 - DNA, 15 bp, Homo sapiens
ttcctgagcagtaac

SEQ ID NO: 5021 - DNA, 15 bp, Homo sapiens
tttcctgagcagtaa

SEQ ID NO: 5022 - DNA, 15 bp, Homo sapiens
atttcctgagcagta

SEQ ID NO: 5023 - DNA, 15 bp, Homo sapiens
catttcctgagcagt

SEQ ID NO: 5024 - DNA, 15 bp, Homo sapiens
tcatttcctgagcag

SEQ ID NO: 5025 - DNA, 15 bp, Homo sapiens
ttcatttcctgagca

SEQ ID NO: 5026 - DNA, 15 bp, Homo sapiens
gttcatttcctgagc

SEQ ID NO: 5027 - DNA, 15 bp, Homo sapiens
agttcatttcctgag

SEQ ID NO: 5028 - DNA, 15 bp, Homo sapiens
cagttcatttcctga

SEQ ID NO: 5029 - DNA, 15 bp, Homo sapiens
acagttcatttcctg

SEQ ID NO: 5030 - DNA, 15 bp, Homo sapiens
cacagttcatttcct

SEQ ID NO: 5031 - DNA, 15 bp, Homo sapiens
acacagttcatttcc

SEQ ID NO: 5032 - DNA, 15 bp, Homo sapiens
aacacagttcatttc

SEQ ID NO: 5033 - DNA, 15 bp, Homo sapiens
taacacagttcattt

SEQ ID NO: 5034 - DNA, 15 bp, Homo sapiens
gtaacacagttcatt

SEQ ID NO: 5035 - DNA, 15 bp, Homo sapiens
tgtaacacagttcat

SEQ ID NO: 5036 - DNA, 15 bp, Homo sapiens
atgtaacacagttca

SEQ ID NO: 5037 - DNA, 15 bp, Homo sapiens
aatgtaacacagttc

SEQ ID NO: 5038 - DNA, 15 bp, Homo sapiens
aaatgtaacacagtt

SEQ ID NO: 5039 - DNA, 15 bp, Homo sapiens
aaaatgtaacacagt

SEQ ID NO: 5040 - DNA, 15 bp, Homo sapiens
aaaaatgtaacacag

SEQ ID NO: 5041 - DNA, 15 bp, Homo sapiens
taaaaatgtaacaca

SEQ ID NO: 5042 - DNA, 15 bp, Homo sapiens
ataaaaatgtaacac

SEQ ID NO: 5043 - DNA, 15 bp, Homo sapiens
aataaaaatgtaaca

SEQ ID NO: 5044 - DNA, 15 bp, Homo sapiens
aaataaaaatgtaac

SEQ ID NO: 5045 - DNA, 15 bp, Homo sapiens
aaaataaaaatgtaa

SEQ ID NO: 5046 - DNA, 15 bp, Homo sapiens
taaaataaaaatgta

SEQ ID NO: 5047 - DNA, 15 bp, Homo sapiens
ataaaataaaaatgt

SEQ ID NO: 5048 - DNA, 15 bp, Homo sapiens
cataaaataaaaatg

SEQ ID NO: 5049 - DNA, 15 bp, Homo sapiens
tcataaaataaaaat

SEQ ID NO: 5050 - DNA, 15 bp, Homo sapiens
ctcataaaataaaaa

SEQ ID NO: 5051 - DNA, 15 bp, Homo sapiens
actcataaaataaaa

SEQ ID NO: 5052 - DNA, 15 bp, Homo sapiens
aactcataaaataaa

SEQ ID NO: 5053 - DNA, 15 bp, Homo sapiens
caactcataaaataa

SEQ ID NO: 5054 - DNA, 15 bp, Homo sapiens
ccaactcataaaata

SEQ ID NO: 5055 - DNA, 15 bp, Homo sapiens
accaactcataaaat

SEQ ID NO: 5056 - DNA, 15 bp, Homo sapiens
taccaactcataaaa

SEQ ID NO: 5057 - DNA, 15 bp, Homo sapiens
ttaccaactcataaa

SEQ ID NO: 5058 - DNA, 15 bp, Homo sapiens
tttaccaactcataa

SEQ ID NO: 5059 - DNA, 15 bp, Homo sapiens
atttaccaactcata

SEQ ID NO: 5060 - DNA, 15 bp, Homo sapiens
tatttaccaactcat

SEQ ID NO: 5061 - DNA, 15 bp, Homo sapiens
ctatttaccaactca

SEQ ID NO: 5062 - DNA, 15 bp, Homo sapiens
gctatttaccaactc

SEQ ID NO: 5063 - DNA, 15 bp, Homo sapiens
tgctatttaccaact

SEQ ID NO: 5064 - DNA, 15 bp, Homo sapiens
ttgctatttaccaac

SEQ ID NO: 5065 - DNA, 15 bp, Homo sapiens
tttgctatttaccaa

SEQ ID NO: 5066 - DNA, 15 bp, Homo sapiens
ttttgctatttacca

SEQ ID NO: 5067 - DNA, 15 bp, Homo sapiens
cttttgctatttacc

SEQ ID NO: 5068 - DNA, 15 bp, Homo sapiens
tcttttgctatttac

SEQ ID NO: 5069 - DNA, 15 bp, Homo sapiens
ttcttttgctattta

SEQ ID NO: 5070 - DNA, 15 bp, Homo sapiens
attcttttgctattt

SEQ ID NO: 5071 - DNA, 15 bp, Homo sapiens
tattcttttgctatt

SEQ ID NO: 5072 - DNA, 15 bp, Homo sapiens
ttattcttttgctat

SEQ ID NO: 5073 - DNA, 15 bp, Homo sapiens
cttattcttttgcta

SEQ ID NO: 5074 - DNA, 15 bp, Homo sapiens
acttattcttttgct

SEQ ID NO: 5075 - DNA, 15 bp, Homo sapiens
cacttattcttttgc

SEQ ID NO: 5076 - DNA, 15 bp, Homo sapiens
acacttattcttttg

SEQ ID NO: 5077 - DNA, 15 bp, Homo sapiens
aacacttattctttt

SEQ ID NO: 5078 - DNA, 15 bp, Homo sapiens
aaacacttattcttt

SEQ ID NO: 5079 - DNA, 15 bp, Homo sapiens
taaacacttattctt

SEQ ID NO: 5080 - DNA, 15 bp, Homo sapiens
ctaaacacttattct

SEQ ID NO: 5081 - DNA, 15 bp, Homo sapiens
cctaaacacttattc

SEQ ID NO: 5082 - DNA, 15 bp, Homo sapiens
ccctaaacacttatt

SEQ ID NO: 5083 - DNA, 15 bp, Homo sapiens
tccctaaacacttat

SEQ ID NO: 5084 - DNA, 15 bp, Homo sapiens
ctccctaaacactta

SEQ ID NO: 5085 - DNA, 15 bp, Homo sapiens
actccctaaacactt

SEQ ID NO: 5086 - DNA, 15 bp, Homo sapiens
tactccctaaacact

SEQ ID NO: 5087 - DNA, 15 bp, Homo sapiens
gtactccctaaacac

SEQ ID NO: 5088 - DNA, 15 bp, Homo sapiens
agtactccctaaaca

SEQ ID NO: 5089 - DNA, 15 bp, Homo sapiens
aagtactccctaaac

SEQ ID NO: 5090 - DNA, 15 bp, Homo sapiens
gaagtactccctaaa

SEQ ID NO: 5091 - DNA, 15 bp, Homo sapiens
agaagtactccctaa

SEQ ID NO: 5092 - DNA, 15 bp, Homo sapiens
tagaagtactcccta

SEQ ID NO: 5093 - DNA, 15 bp, Homo sapiens
atagaagtactccct

SEQ ID NO: 5094 - DNA, 15 bp, Homo sapiens
tatagaagtactccc

SEQ ID NO: 5095 - DNA, 15 bp, Homo sapiens
ctatagaagtactcc

SEQ ID NO: 5096 - DNA, 15 bp, Homo sapiens
tctatagaagtactc

SEQ ID NO: 5097 - DNA, 15 bp, Homo sapiens
ttctatagaagtact

SEQ ID NO: 5098 - DNA, 15 bp, Homo sapiens
attctatagaagtac

SEQ ID NO: 5099 - DNA, 15 bp, Homo sapiens
aattctatagaagta

SEQ ID NO: 5100 - DNA, 15 bp, Homo sapiens
taattctatagaagt

SEQ ID NO: 5101 - DNA, 15 bp, Homo sapiens
ttaattctatagaag

SEQ ID NO: 5102 - DNA, 15 bp, Homo sapiens
attaattctatagaa

SEQ ID NO: 5103 - DNA, 15 bp, Homo sapiens
aattaattctataga

SEQ ID NO: 5104 - DNA, 15 bp, Homo sapiens
aaattaattctatag

SEQ ID NO: 5105 - DNA, 15 bp, Homo sapiens
caaattaattctata

SEQ ID NO: 5106 - DNA, 15 bp, Homo sapiens
gcaaattaattctat

SEQ ID NO: 5107 - DNA, 15 bp, Homo sapiens
agcaaattaattcta

SEQ ID NO: 5108 - DNA, 15 bp, Homo sapiens
aagcaaattaattct

SEQ ID NO: 5109 - DNA, 15 bp, Homo sapiens
aaagcaaattaattc

SEQ ID NO: 5110 - DNA, 15 bp, Homo sapiens
caaagcaaattaatt

SEQ ID NO: 5111 - DNA, 15 bp, Homo sapiens
ccaaagcaaattaat

SEQ ID NO: 5112 - DNA, 15 bp, Homo sapiens
accaaagcaaattaa

SEQ ID NO: 5113 - DNA, 15 bp, Homo sapiens
aaccaaagcaaatta

SEQ ID NO: 5114 - DNA, 15 bp, Homo sapiens
aaaccaaagcaaatt

SEQ ID NO: 5115 - DNA, 15 bp, Homo sapiens
caaaccaaagcaaat

SEQ ID NO: 5116 - DNA, 15 bp, Homo sapiens
acaaaccaaagcaaa

SEQ ID NO: 5117 - DNA, 15 bp, Homo sapiens
aacaaaccaaagcaa

SEQ ID NO: 5118 - DNA, 15 bp, Homo sapiens
aaacaaaccaaagca

SEQ ID NO: 5119 - DNA, 15 bp, Homo sapiens
caaacaaaccaaagc

SEQ ID NO: 5120 - DNA, 15 bp, Homo sapiens
tcaaacaaaccaaag

SEQ ID NO: 5121 - DNA, 15 bp, Homo sapiens
atcaaacaaaccaaa

SEQ ID NO: 5122 - DNA, 15 bp, Homo sapiens
gatcaaacaaaccaa

SEQ ID NO: 5123 - DNA, 15 bp, Homo sapiens
tgatcaaacaaacca

SEQ ID NO: 5124 - DNA, 15 bp, Homo sapiens
ttgatcaaacaaacc

SEQ ID NO: 5125 - DNA, 15 bp, Homo sapiens
cttgatcaaacaaac

SEQ ID NO: 5126 - DNA, 15 bp, Homo sapiens
ccttgatcaaacaaa

SEQ ID NO: 5127 - DNA, 15 bp, Homo sapiens
tccttgatcaaacaa

SEQ ID NO: 5128 - DNA, 15 bp, Homo sapiens
ttccttgatcaaaca

SEQ ID NO: 5129 - DNA, 15 bp, Homo sapiens
attccttgatcaaac

SEQ ID NO: 5130 - DNA, 15 bp, Homo sapiens
aattccttgatcaaa

SEQ ID NO: 5131 - DNA, 15 bp, Homo sapiens
caattccttgatcaa

SEQ ID NO: 5132 - DNA, 15 bp, Homo sapiens
gcaattccttgatca

SEQ ID NO: 5133 - DNA, 15 bp, Homo sapiens
tgcaattccttgatc

SEQ ID NO: 5134 - DNA, 15 bp, Homo sapiens
ctgcaattccttgat

SEQ ID NO: 5135 - DNA, 15 bp, Homo sapiens
tctgcaattccttga

SEQ ID NO: 5136 - DNA, 15 bp, Homo sapiens
atctgcaattccttg

SEQ ID NO: 5137 - DNA, 15 bp, Homo sapiens
tatctgcaattcctt

SEQ ID NO: 5138 - DNA, 15 bp, Homo sapiens
atatctgcaattcct

SEQ ID NO: 5139 - DNA, 15 bp, Homo sapiens
tatatctgcaattcc

SEQ ID NO: 5140 - DNA, 15 bp, Homo sapiens
ttatatctgcaattc

SEQ ID NO: 5141 - DNA, 15 bp, Homo sapiens
cttatatctgcaatt

SEQ ID NO: 5142 - DNA, 15 bp, Homo sapiens
tcttatatctgcaat

SEQ ID NO: 5143 - DNA, 15 bp, Homo sapiens
gtcttatatctgcaa

SEQ ID NO: 5144 - DNA, 15 bp, Homo sapiens
ggtcttatatctgca

SEQ ID NO: 5145 - DNA, 15 bp, Homo sapiens
aggtcttatatctgc

SEQ ID NO: 5146 - DNA, 15 bp, Homo sapiens
caggtcttatatctg

SEQ ID NO: 5147 - DNA, 15 bp, Homo sapiens
acaggtcttatatct

SEQ ID NO: 5148 - DNA, 15 bp, Homo sapiens
aacaggtcttatatc

SEQ ID NO: 5149 - DNA, 15 bp, Homo sapiens
caacaggtcttatat

SEQ ID NO: 5150 - DNA, 15 bp, Homo sapiens
acaacaggtcttata

SEQ ID NO: 5151 - DNA, 15 bp, Homo sapiens
cacaacaggtcttat

SEQ ID NO: 5152 - DNA, 15 bp, Homo sapiens
acacaacaggtctta

SEQ ID NO: 5153 - DNA, 15 bp, Homo sapiens
aacacaacaggtctt

SEQ ID NO: 5154 - DNA, 15 bp, Homo sapiens
caacacaacaggtct

SEQ ID NO: 5155 - DNA, 15 bp, Homo sapiens
tcaacacaacaggtc

SEQ ID NO: 5156 - DNA, 15 bp, Homo sapiens
atcaacacaacaggt

SEQ ID NO: 5157 - DNA, 15 bp, Homo sapiens
aatcaacacaacagg

SEQ ID NO: 5158 - DNA, 15 bp, Homo sapiens
aaatcaacacaacag

SEQ ID NO: 5159 - DNA, 15 bp, Homo sapiens
aaaatcaacacaaca

SEQ ID NO: 5160 - DNA, 15 bp, Homo sapiens
gaaaatcaacacaac

SEQ ID NO: 5161 - DNA, 15 bp, Homo sapiens
agaaaatcaacacaa

SEQ ID NO: 5162 - DNA, 15 bp, Homo sapiens
aagaaaatcaacaca

SEQ ID NO: 5163 - DNA, 15 bp, Homo sapiens
gaagaaaatcaacac

SEQ ID NO: 5164 - DNA, 15 bp, Homo sapiens
tgaagaaaatcaaca

SEQ ID NO: 5165 - DNA, 15 bp, Homo sapiens
atgaagaaaatcaac

SEQ ID NO: 5166 - DNA, 15 bp, Homo sapiens
catgaagaaaatcaa

SEQ ID NO: 5167 - DNA, 15 bp, Homo sapiens
acatgaagaaaatca

SEQ ID NO: 5168 - DNA, 15 bp, Homo sapiens
cacatgaagaaaatc

SEQ ID NO: 5169 - DNA, 15 bp, Homo sapiens
ccacatgaagaaaat

SEQ ID NO: 5170 - DNA, 15 bp, Homo sapiens
cccacatgaagaaaa

SEQ ID NO: 5171 - DNA, 15 bp, Homo sapiens
ccccacatgaagaaa

SEQ ID NO: 5172 - DNA, 15 bp, Homo sapiens
accccacatgaagaa

SEQ ID NO: 5173 - DNA, 15 bp, Homo sapiens
aaccccacatgaaga

SEQ ID NO: 5174 - DNA, 15 bp, Homo sapiens
caaccccacatgaag

SEQ ID NO: 5175 - DNA, 15 bp, Homo sapiens
ccaaccccacatgaa

SEQ ID NO: 5176 - DNA, 15 bp, Homo sapiens
cccaaccccacatga

SEQ ID NO: 5177 - DNA, 15 bp, Homo sapiens
acccaaccccacatg

SEQ ID NO: 5178 - DNA, 15 bp, Homo sapiens
tacccaaccccacat

SEQ ID NO: 5179 - DNA, 15 bp, Homo sapiens
gtacccaaccccaca

SEQ ID NO: 5180 - DNA, 15 bp, Homo sapiens
agtacccaaccccac

SEQ ID NO: 5181 - DNA, 15 bp, Homo sapiens
cagtacccaacccca

SEQ ID NO: 5182 - DNA, 15 bp, Homo sapiens
gcagtacccaacccc

SEQ ID NO: 5183 - DNA, 15 bp, Homo sapiens
agcagtacccaaccc

SEQ ID NO: 5184 - DNA, 15 bp, Homo sapiens
cagcagtacccaacc

SEQ ID NO: 5185 - DNA, 15 bp, Homo sapiens
gcagcagtacccaac

SEQ ID NO: 5186 - DNA, 15 bp, Homo sapiens
agcagcagtacccaa

SEQ ID NO: 5187 - DNA, 15 bp, Homo sapiens
cagcagcagtaccca

SEQ ID NO: 5188 - DNA, 15 bp, Homo sapiens
gcagcagcagtaccc

SEQ ID NO: 5189 - DNA, 15 bp, Homo sapiens
tgcagcagcagtacc

SEQ ID NO: 5190 - DNA, 15 bp, Homo sapiens
atgcagcagcagtac

SEQ ID NO: 5191 - DNA, 15 bp, Homo sapiens
aatgcagcagcagta

SEQ ID NO: 5192 - DNA, 15 bp, Homo sapiens
caatgcagcagcagt

SEQ ID NO: 5193 - DNA, 15 bp, Homo sapiens
acaatgcagcagcag

SEQ ID NO: 5194 - DNA, 15 bp, Homo sapiens
gacaatgcagcagca

SEQ ID NO: 5195 - DNA, 15 bp, Homo sapiens
agacaatgcagcagc

SEQ ID NO: 5196 - DNA, 15 bp, Homo sapiens
aagacaatgcagcag

SEQ ID NO: 5197 - DNA, 15 bp, Homo sapiens
aaagacaatgcagca

SEQ ID NO: 5198 - DNA, 15 bp, Homo sapiens
taaagacaatgcagc

SEQ ID NO: 5199 - DNA, 15 bp, Homo sapiens
ctaaagacaatgcag

SEQ ID NO: 5200 - DNA, 15 bp, Homo sapiens
actaaagacaatgca

SEQ ID NO: 5201 - DNA, 15 bp, Homo sapiens
cactaaagacaatgc

SEQ ID NO: 5202 - DNA, 15 bp, Homo sapiens
acactaaagacaatg

SEQ ID NO: 5203 - DNA, 15 bp, Homo sapiens
aacactaaagacaat

SEQ ID NO: 5204 - DNA, 15 bp, Homo sapiens
aaacactaaagacaa

SEQ ID NO: 5205 - DNA, 15 bp, Homo sapiens
gaaacactaaagaca

SEQ ID NO: 5206 - DNA, 15 bp, Homo sapiens
tgaaacactaaagac

SEQ ID NO: 5207 - DNA, 15 bp, Homo sapiens
atgaaacactaaaga

SEQ ID NO: 5208 - DNA, 15 bp, Homo sapiens
aatgaaacactaaag

SEQ ID NO: 5209 - DNA, 15 bp, Homo sapiens
gaatgaaacactaaa

SEQ ID NO: 5210 - DNA, 15 bp, Homo sapiens
ggaatgaaacactaa

SEQ ID NO: 5211 - DNA, 15 bp, Homo sapiens
aggaatgaaacacta

SEQ ID NO: 5212 - DNA, 15 bp, Homo sapiens
gaggaatgaaacact

SEQ ID NO: 5213 - DNA, 15 bp, Homo sapiens
ggaggaatgaaacac

SEQ ID NO: 5214 - DNA, 15 bp, Homo sapiens
aggaggaatgaaaca

SEQ ID NO: 5215 - DNA, 15 bp, Homo sapiens
caggaggaatgaaac

SEQ ID NO: 5216 - DNA, 15 bp, Homo sapiens
acaggaggaatgaaa

SEQ ID NO: 5217 - DNA, 15 bp, Homo sapiens
gacaggaggaatgaa

SEQ ID NO: 5218 - DNA, 15 bp, Homo sapiens
agacaggaggaatga

SEQ ID NO: 5219 - DNA, 15 bp, Homo sapiens
cagacaggaggaatg

SEQ ID NO: 5220 - DNA, 15 bp, Homo sapiens
acagacaggaggaat

SEQ ID NO: 5221 - DNA, 15 bp, Homo sapiens
tacagacaggaggaa

SEQ ID NO: 5222 - DNA, 15 bp, Homo sapiens
atacagacaggagga

SEQ ID NO: 5223 - DNA, 15 bp, Homo sapiens
gatacagacaggagg

SEQ ID NO: 5224 - DNA, 15 bp, Homo sapiens
agatacagacaggag

SEQ ID NO: 5225 - DNA, 15 bp, Homo sapiens
aagatacagacagga

SEQ ID NO: 5226 - DNA, 15 bp, Homo sapiens
aaagatacagacagg

SEQ ID NO: 5227 - DNA, 15 bp, Homo sapiens
aaaagatacagacag

SEQ ID NO: 5228 - DNA, 15 bp, Homo sapiens
taaaagatacagaca

SEQ ID NO: 5229 - DNA, 15 bp, Homo sapiens
ttaaaagatacagac

SEQ ID NO: 5230 - DNA, 15 bp, Homo sapiens
tttaaaagatacaga

SEQ ID NO: 5231 - DNA, 15 bp, Homo sapiens
ttttaaaagatacag

SEQ ID NO: 5232 - DNA, 15 bp, Homo sapiens
cttttaaaagataca

SEQ ID NO: 5233 - DNA, 15 bp, Homo sapiens
tcttttaaaagatac

SEQ ID NO: 5234 - DNA, 15 bp, Homo sapiens
ttcttttaaaagata

SEQ ID NO: 5235 - DNA, 15 bp, Homo sapiens
tttcttttaaaagat

SEQ ID NO: 5236 - DNA, 15 bp, Homo sapiens
ctttcttttaaaaga

SEQ ID NO: 5237 - DNA, 15 bp, Homo sapiens
tctttcttttaaaag

SEQ ID NO: 5238 - DNA, 15 bp, Homo sapiens
ctctttcttttaaaa

SEQ ID NO: 5239 - DNA, 15 bp, Homo sapiens
gctctttcttttaaa

SEQ ID NO: 5240 - DNA, 15 bp, Homo sapiens
tgctctttcttttaa

SEQ ID NO: 5241 - DNA, 15 bp, Homo sapiens
gtgctctttctttta

SEQ ID NO: 5242 - DNA, 15 bp, Homo sapiens
agtgctctttctttt

SEQ ID NO: 5243 - DNA, 15 bp, Homo sapiens
cagtgctctttcttt

SEQ ID NO: 5244 - DNA, 15 bp, Homo sapiens
tcagtgctctttctt

SEQ ID NO: 5245 - DNA, 15 bp, Homo sapiens
gtcagtgctctttct

SEQ ID NO: 5246 - DNA, 15 bp, Homo sapiens
agtcagtgctctttc

SEQ ID NO: 5247 - DNA, 15 bp, Homo sapiens
gagtcagtgctcttt

SEQ ID NO: 5248 - DNA, 15 bp, Homo sapiens
agagtcagtgctctt

SEQ ID NO: 5249 - DNA, 15 bp, Homo sapiens
gagagtcagtgctct

SEQ ID NO: 5250 - DNA, 15 bp, Homo sapiens
agagagtcagtgctc

SEQ ID NO: 5251 - DNA, 15 bp, Homo sapiens
aagagagtcagtgct

SEQ ID NO: 5252 - DNA, 15 bp, Homo sapiens
aaagagagtcagtgc

SEQ ID NO: 5253 - DNA, 15 bp, Homo sapiens
aaaagagagtcagtg

SEQ ID NO: 5254 - DNA, 15 bp, Homo sapiens
aaaaagagagtcagt

SEQ ID NO: 5255 - DNA, 15 bp, Homo sapiens
caaaaagagagtcag

SEQ ID NO: 5256 - DNA, 15 bp, Homo sapiens
acaaaaagagagtca

SEQ ID NO: 5257 - DNA, 15 bp, Homo sapiens
cacaaaaagagagtc

SEQ ID NO: 5258 - DNA, 15 bp, Homo sapiens
acacaaaaagagagt

SEQ ID NO: 5259 - DNA, 15 bp, Homo sapiens
gacacaaaaagagag

SEQ ID NO: 5260 - DNA, 15 bp, Homo sapiens
tgacacaaaaagaga

SEQ ID NO: 5261 - DNA, 15 bp, Homo sapiens
ctgacacaaaaagag

SEQ ID NO: 5262 - DNA, 15 bp, Homo sapiens
actgacacaaaaaga

SEQ ID NO: 5263 - DNA, 15 bp, Homo sapiens
aactgacacaaaaag

SEQ ID NO: 5264 - DNA, 15 bp, Homo sapiens
aaactgacacaaaaa

SEQ ID NO: 5265 - DNA, 15 bp, Homo sapiens
taaactgacacaaaa

SEQ ID NO: 5266 - DNA, 15 bp, Homo sapiens
ataaactgacacaaa

SEQ ID NO: 5267 - DNA, 15 bp, Homo sapiens
aataaactgacacaa

SEQ ID NO: 5268 - DNA, 15 bp, Homo sapiens
gaataaactgacaca

SEQ ID NO: 5269 - DNA, 15 bp, Homo sapiens
ggaataaactgacac

SEQ ID NO: 5270 - DNA, 15 bp, Homo sapiens
aggaataaactgaca

SEQ ID NO: 5271 - DNA, 15 bp, Homo sapiens
taggaataaactgac

SEQ ID NO: 5272 - DNA, 15 bp, Homo sapiens
ataggaataaactga

SEQ ID NO: 5273 - DNA, 15 bp, Homo sapiens
aataggaataaactg

SEQ ID NO: 5274 - DNA, 15 bp, Homo sapiens
caataggaataaact

SEQ ID NO: 5275 - DNA, 15 bp, Homo sapiens
tcaataggaataaac

SEQ ID NO: 5276 - DNA, 15 bp, Homo sapiens
atcaataggaataaa

SEQ ID NO: 5277 - DNA, 15 bp, Homo sapiens
catcaataggaataa

SEQ ID NO: 5278 - DNA, 15 bp, Homo sapiens
acatcaataggaata

SEQ ID NO: 5279 - DNA, 15 bp, Homo sapiens
tacatcaataggaat

SEQ ID NO: 5280 - DNA, 15 bp, Homo sapiens
ttacatcaataggaa

SEQ ID NO: 5281 - DNA, 15 bp, Homo sapiens
gttacatcaatagga

SEQ ID NO: 5282 - DNA, 15 bp, Homo sapiens
tgttacatcaatagg

SEQ ID NO: 5283 - DNA, 15 bp, Homo sapiens
ctgttacatcaatag

SEQ ID NO: 5284 - DNA, 15 bp, Homo sapiens
tctgttacatcaata

SEQ ID NO: 5285 - DNA, 15 bp, Homo sapiens
ttctgttacatcaat

SEQ ID NO: 5286 - DNA, 15 bp, Homo sapiens
tttctgttacatcaa

SEQ ID NO: 5287 - DNA, 15 bp, Homo sapiens
ttttctgttacatca

SEQ ID NO: 5288 - DNA, 15 bp, Homo sapiens
tttttctgttacatc

SEQ ID NO: 5289 - DNA, 15 bp, Homo sapiens
ttttttctgttacat

SEQ ID NO: 5290 - DNA, 15 bp, Homo sapiens
gttttttctgttaca

SEQ ID NO: 5291 - DNA, 15 bp, Homo sapiens
tgttttttctgttac

SEQ ID NO: 5292 - DNA, 15 bp, Homo sapiens
atgttttttctgtta

SEQ ID NO: 5293 - DNA, 15 bp, Homo sapiens
catgttttttctgtt

SEQ ID NO: 5294 - DNA, 15 bp, Homo sapiens
ccatgttttttctgt

SEQ ID NO: 5295 - DNA, 15 bp, Homo sapiens
accatgttttttctg

SEQ ID NO: 5296 - DNA, 15 bp, Homo sapiens
taccatgttttttct

SEQ ID NO: 5297 - DNA, 15 bp, Homo sapiens
ctaccatgttttttc

SEQ ID NO: 5298 - DNA, 15 bp, Homo sapiens
tctaccatgtttttt

SEQ ID NO: 5299 - DNA, 15 bp, Homo sapiens
ttctaccatgttttt

SEQ ID NO: 5300 - DNA, 15 bp, Homo sapiens
attctaccatgtttt

SEQ ID NO: 5301 - DNA, 15 bp, Homo sapiens
tattctaccatgttt

SEQ ID NO: 5302 - DNA, 15 bp, Homo sapiens
atattctaccatgtt

SEQ ID NO: 5303 - DNA, 15 bp, Homo sapiens
aatattctaccatgt

SEQ ID NO: 5304 - DNA, 15 bp, Homo sapiens
gaatattctaccatg

SEQ ID NO: 5305 - DNA, 15 bp, Homo sapiens
tgaatattctaccat

SEQ ID NO: 5306 - DNA, 15 bp, Homo sapiens
ctgaatattctacca

SEQ ID NO: 5307 - DNA, 15 bp, Homo sapiens
cctgaatattctacc

SEQ ID NO: 5308 - DNA, 15 bp, Homo sapiens
acctgaatattctac

SEQ ID NO: 5309 - DNA, 15 bp, Homo sapiens
aacctgaatattcta

SEQ ID NO: 5310 - DNA, 15 bp, Homo sapiens
aaacctgaatattct

SEQ ID NO: 5311 - DNA, 15 bp, Homo sapiens
aaaacctgaatattc

SEQ ID NO: 5312 - DNA, 15 bp, Homo sapiens
aaaaacctgaatatt

SEQ ID NO: 5313 - DNA, 15 bp, Homo sapiens
aaaaaacctgaatat

SEQ ID NO: 5314 - DNA, 15 bp, Homo sapiens
aaaaaaacctgaata

SEQ ID NO: 5315 - DNA, 15 bp, Homo sapiens
caaaaaaacctgaat

SEQ ID NO: 5316 - DNA, 15 bp, Homo sapiens
ccaaaaaaacctgaa

SEQ ID NO: 5317 - DNA, 15 bp, Homo sapiens
tccaaaaaaacctga

SEQ ID NO: 5318 - DNA, 15 bp, Homo sapiens
ctccaaaaaaacctg

SEQ ID NO: 5319 - DNA, 15 bp, Homo sapiens
tctccaaaaaaacct

SEQ ID NO: 5320 - DNA, 15 bp, Homo sapiens
ttctccaaaaaaacc

SEQ ID NO: 5321 - DNA, 15 bp, Homo sapiens
cttctccaaaaaaac

SEQ ID NO: 5322 - DNA, 15 bp, Homo sapiens
acttctccaaaaaaa

SEQ ID NO: 5323 - DNA, 15 bp, Homo sapiens
cacttctccaaaaaa

SEQ ID NO: 5324 - DNA, 15 bp, Homo sapiens
tcacttctccaaaaa

SEQ ID NO: 5325 - DNA, 15 bp, Homo sapiens
gtcacttctccaaaa

SEQ ID NO: 5326 - DNA, 15 bp, Homo sapiens
agtcacttctccaaa

SEQ ID NO: 5327 - DNA, 15 bp, Homo sapiens
tagtcacttctccaa

SEQ ID NO: 5328 - DNA, 15 bp, Homo sapiens
ctagtcacttctcca

SEQ ID NO: 5329 - DNA, 15 bp, Homo sapiens
cctagtcacttctcc

SEQ ID NO: 5330 - DNA, 15 bp, Homo sapiens
gcctagtcacttctc

SEQ ID NO: 5331 - DNA, 15 bp, Homo sapiens
cgcctagtcacttct

SEQ ID NO: 5332 - DNA, 15 bp, Homo sapiens
tcgcctagtcacttc

SEQ ID NO: 5333 - DNA, 15 bp, Homo sapiens
atcgcctagtcactt

SEQ ID NO: 5334 - DNA, 15 bp, Homo sapiens
aatcgcctagtcact

SEQ ID NO: 5335 - DNA, 15 bp, Homo sapiens
gaatcgcctagtcac

SEQ ID NO: 5336 - DNA, 15 bp, Homo sapiens
agaatcgcctagtca

SEQ ID NO: 5337 - DNA, 15 bp, Homo sapiens
aagaatcgcctagtc

SEQ ID NO: 5338 - DNA, 15 bp, Homo sapiens
taagaatcgcctagt

SEQ ID NO: 5339 - DNA, 15 bp, Homo sapiens
ataagaatcgcctag

SEQ ID NO: 5340 - DNA, 15 bp, Homo sapiens
tataagaatcgccta

SEQ ID NO: 5341 - DNA, 15 bp, Homo sapiens
atataagaatcgcct

SEQ ID NO: 5342 - DNA, 15 bp, Homo sapiens
tatataagaatcgcc

SEQ ID NO: 5343 - DNA, 15 bp, Homo sapiens
gtatataagaatcgc

SEQ ID NO: 5344 - DNA, 15 bp, Homo sapiens
tgtatataagaatcg

SEQ ID NO: 5345 - DNA, 15 bp, Homo sapiens
atgtatataagaatc

SEQ ID NO: 5346 - DNA, 15 bp, Homo sapiens
gatgtatataagaat

SEQ ID NO: 5347 - DNA, 15 bp, Homo sapiens
tgatgtatataagaa

SEQ ID NO: 5348 - DNA, 15 bp, Homo sapiens
atgatgtatataaga

SEQ ID NO: 5349 - DNA, 15 bp, Homo sapiens
catgatgtatataag

SEQ ID NO: 5350 - DNA, 15 bp, Homo sapiens
gcatgatgtatataa

SEQ ID NO: 5351 - DNA, 15 bp, Homo sapiens
cgcatgatgtatata

SEQ ID NO: 5352 - DNA, 15 bp, Homo sapiens
acgcatgatgtatat

SEQ ID NO: 5353 - DNA, 15 bp, Homo sapiens
gacgcatgatgtata

SEQ ID NO: 5354 - DNA, 15 bp, Homo sapiens
tgacgcatgatgtat

SEQ ID NO: 5355 - DNA, 15 bp, Homo sapiens
atgacgcatgatgta

SEQ ID NO: 5356 - DNA, 15 bp, Homo sapiens
gatgacgcatgatgt

SEQ ID NO: 5357 - DNA, 15 bp, Homo sapiens
tgatgacgcatgatg

SEQ ID NO: 5358 - DNA, 15 bp, Homo sapiens
ttgatgacgcatgat

SEQ ID NO: 5359 - DNA, 15 bp, Homo sapiens
cttgatgacgcatga

SEQ ID NO: 5360 - DNA, 15 bp, Homo sapiens
acttgatgacgcatg

SEQ ID NO: 5361 - DNA, 15 bp, Homo sapiens
gacttgatgacgcat

SEQ ID NO: 5362 - DNA, 15 bp, Homo sapiens
tgacttgatgacgca

SEQ ID NO: 5363 - DNA, 15 bp, Homo sapiens
atgacttgatgacgc

SEQ ID NO: 5364 - DNA, 15 bp, Homo sapiens
catgacttgatgacg

SEQ ID NO: 5365 - DNA, 15 bp, Homo sapiens
gcatgacttgatgac

SEQ ID NO: 5366 - DNA, 15 bp, Homo sapiens
agcatgacttgatga

SEQ ID NO: 5367 - DNA, 15 bp, Homo sapiens
aagcatgacttgatg

SEQ ID NO: 5368 - DNA, 15 bp, Homo sapiens
taagcatgacttgat

SEQ ID NO: 5369 - DNA, 15 bp, Homo sapiens
ttaagcatgacttga

SEQ ID NO: 5370 - DNA, 15 bp, Homo sapiens
tttaagcatgacttg

SEQ ID NO: 5371 - DNA, 15 bp, Homo sapiens
atttaagcatgactt

SEQ ID NO: 5372 - DNA, 15 bp, Homo sapiens
aatttaagcatgact

SEQ ID NO: 5373 - DNA, 15 bp, Homo sapiens
taatttaagcatgac

SEQ ID NO: 5374 - DNA, 15 bp, Homo sapiens
ttaatttaagcatga

SEQ ID NO: 5375 - DNA, 15 bp, Homo sapiens
tttaatttaagcatg

SEQ ID NO: 5376 - DNA, 15 bp, Homo sapiens
ttttaatttaagcat

SEQ ID NO: 5377 - DNA, 15 bp, Homo sapiens
tttttaatttaagca

SEQ ID NO: 5378 - DNA, 15 bp, Homo sapiens
ctttttaatttaagc

SEQ ID NO: 5379 - DNA, 15 bp, Homo sapiens
tctttttaatttaag

SEQ ID NO: 5380 - DNA, 15 bp, Homo sapiens
ttctttttaatttaa

SEQ ID NO: 5381 - DNA, 15 bp, Homo sapiens
attctttttaattta

SEQ ID NO: 5382 - DNA, 15 bp, Homo sapiens
tattctttttaattt

SEQ ID NO: 5383 - DNA, 15 bp, Homo sapiens
atattctttttaatt

SEQ ID NO: 5384 - DNA, 15 bp, Homo sapiens
aatattctttttaat

SEQ ID NO: 5385 - DNA, 15 bp, Homo sapiens
taatattctttttaa

SEQ ID NO: 5386 - DNA, 15 bp, Homo sapiens
ctaatattcttttta

SEQ ID NO: 5387 - DNA, 15 bp, Homo sapiens
actaatattcttttt

SEQ ID NO: 5388 - DNA, 15 bp, Homo sapiens
cactaatattctttt

SEQ ID NO: 5389 - DNA, 15 bp, Homo sapiens
tcactaatattcttt

SEQ ID NO: 5390 - DNA, 15 bp, Homo sapiens
gtcactaatattctt

SEQ ID NO: 5391 - DNA, 15 bp, Homo sapiens
agtcactaatattct

SEQ ID NO: 5392 - DNA, 15 bp, Homo sapiens
aagtcactaatattc

SEQ ID NO: 5393 - DNA, 15 bp, Homo sapiens
taagtcactaatatt

SEQ ID NO: 5394 - DNA, 15 bp, Homo sapiens
gtaagtcactaatat

SEQ ID NO: 5395 - DNA, 15 bp, Homo sapiens
agtaagtcactaata

SEQ ID NO: 5396 - DNA, 15 bp, Homo sapiens
aagtaagtcactaat

SEQ ID NO: 5397 - DNA, 15 bp, Homo sapiens
gaagtaagtcactaa

SEQ ID NO: 5398 - DNA, 15 bp, Homo sapiens
tgaagtaagtcacta

SEQ ID NO: 5399 - DNA, 15 bp, Homo sapiens
ttgaagtaagtcact

SEQ ID NO: 5400 - DNA, 15 bp, Homo sapiens
tttgaagtaagtcac

SEQ ID NO: 5401 - DNA, 15 bp, Homo sapiens
atttgaagtaagtca

SEQ ID NO: 5402 - DNA, 15 bp, Homo sapiens
tatttgaagtaagtc

SEQ ID NO: 5403 - DNA, 15 bp, Homo sapiens
atatttgaagtaagt

SEQ ID NO: 5404 - DNA, 15 bp, Homo sapiens
gatatttgaagtaag

SEQ ID NO: 5405 - DNA, 15 bp, Homo sapiens
tgatatttgaagtaa

SEQ ID NO: 5406 - DNA, 15 bp, Homo sapiens
ttgatatttgaagta

SEQ ID NO: 5407 - DNA, 15 bp, Homo sapiens
tttgatatttgaagt

SEQ ID NO: 5408 - DNA, 15 bp, Homo sapiens
gtttgatatttgaag

SEQ ID NO: 5409 - DNA, 15 bp, Homo sapiens
agtttgatatttgaa

SEQ ID NO: 5410 - DNA, 15 bp, Homo sapiens
tagtttgatatttga

SEQ ID NO: 5411 - DNA, 15 bp, Homo sapiens
ttagtttgatatttg

SEQ ID NO: 5412 - DNA, 15 bp, Homo sapiens
cttagtttgatattt

SEQ ID NO: 5413 - DNA, 15 bp, Homo sapiens
acttagtttgatatt

SEQ ID NO: 5414 - DNA, 15 bp, Homo sapiens
tacttagtttgatat

SEQ ID NO: 5415 - DNA, 15 bp, Homo sapiens
ctacttagtttgata

SEQ ID NO: 5416 - DNA, 15 bp, Homo sapiens
actacttagtttgat

SEQ ID NO: 5417 - DNA, 15 bp, Homo sapiens
tactacttagtttga

SEQ ID NO: 5418 - DNA, 15 bp, Homo sapiens
ttactacttagtttg

SEQ ID NO: 5419 - DNA, 15 bp, Homo sapiens
tttactacttagttt

SEQ ID NO: 5420 - DNA, 15 bp, Homo sapiens
gtttactacttagtt

SEQ ID NO: 5421 - DNA, 15 bp, Homo sapiens
agtttactacttagt

SEQ ID NO: 5422 - DNA, 15 bp, Homo sapiens
cagtttactacttag

SEQ ID NO: 5423 - DNA, 15 bp, Homo sapiens
acagtttactactta

SEQ ID NO: 5424 - DNA, 15 bp, Homo sapiens
aacagtttactactt

SEQ ID NO: 5425 - DNA, 15 bp, Homo sapiens
taacagtttactact

SEQ ID NO: 5426 - DNA, 15 bp, Homo sapiens
ttaacagtttactac

SEQ ID NO: 5427 - DNA, 15 bp, Homo sapiens
gttaacagtttacta

SEQ ID NO: 5428 - DNA, 15 bp, Homo sapiens
agttaacagtttact

SEQ ID NO: 5429 - DNA, 15 bp, Homo sapiens
tagttaacagtttac

SEQ ID NO: 5430 - DNA, 15 bp, Homo sapiens
atagttaacagttta

SEQ ID NO: 5431 - DNA, 15 bp, Homo sapiens
tatagttaacagttt

SEQ ID NO: 5432 - DNA, 15 bp, Homo sapiens
ctatagttaacagtt

SEQ ID NO: 5433 - DNA, 15 bp, Homo sapiens
actatagttaacagt

SEQ ID NO: 5434 - DNA, 15 bp, Homo sapiens
aactatagttaacag

SEQ ID NO: 5435 - DNA, 15 bp, Homo sapiens
taactatagttaaca

SEQ ID NO: 5436 - DNA, 15 bp, Homo sapiens
ttaactatagttaac

SEQ ID NO: 5437 - DNA, 15 bp, Homo sapiens
attaactatagttaa

SEQ ID NO: 5438 - DNA, 15 bp, Homo sapiens
tattaactatagtta

SEQ ID NO: 5439 - DNA, 15 bp, Homo sapiens
atattaactatagtt

SEQ ID NO: 5440 - DNA, 15 bp, Homo sapiens
aatattaactatagt

SEQ ID NO: 5441 - DNA, 15 bp, Homo sapiens
aaatattaactatag

SEQ ID NO: 5442 - DNA, 15 bp, Homo sapiens
aaaatattaactata

SEQ ID NO: 5443 - DNA, 15 bp, Homo sapiens
caaaatattaactat

SEQ ID NO: 5444 - DNA, 15 bp, Homo sapiens
gcaaaatattaacta

SEQ ID NO: 5445 - DNA, 15 bp, Homo sapiens
agcaaaatattaact

SEQ ID NO: 5446 - DNA, 15 bp, Homo sapiens
cagcaaaatattaac

SEQ ID NO: 5447 - DNA, 15 bp, Homo sapiens
acagcaaaatattaa

SEQ ID NO: 5448 - DNA, 15 bp, Homo sapiens
cacagcaaaatatta

SEQ ID NO: 5449 - DNA, 15 bp, Homo sapiens
ccacagcaaaatatt

SEQ ID NO: 5450 - DNA, 15 bp, Homo sapiens
gccacagcaaaatat

SEQ ID NO: 5451 - DNA, 15 bp, Homo sapiens
tgccacagcaaaata

SEQ ID NO: 5452 - DNA, 15 bp, Homo sapiens
atgccacagcaaaat

SEQ ID NO: 5453 - DNA, 15 bp, Homo sapiens
tatgccacagcaaaa

SEQ ID NO: 5454 - DNA, 15 bp, Homo sapiens
ctatgccacagcaaa

SEQ ID NO: 5455 - DNA, 15 bp, Homo sapiens
tctatgccacagcaa

SEQ ID NO: 5456 - DNA, 15 bp, Homo sapiens
ttctatgccacagca

SEQ ID NO: 5457 - DNA, 15 bp, Homo sapiens
attctatgccacagc

SEQ ID NO: 5458 - DNA, 15 bp, Homo sapiens
tattctatgccacag

SEQ ID NO: 5459 - DNA, 15 bp, Homo sapiens
ctattctatgccaca

SEQ ID NO: 5460 - DNA, 15 bp, Homo sapiens
cctattctatgccac

SEQ ID NO: 5461 - DNA, 15 bp, Homo sapiens
tcctattctatgcca

SEQ ID NO: 5462 - DNA, 15 bp, Homo sapiens
ttcctattctatgcc

SEQ ID NO: 5463 - DNA, 15 bp, Homo sapiens
cttcctattctatgc

SEQ ID NO: 5464 - DNA, 15 bp, Homo sapiens
gcttcctattctatg

SEQ ID NO: 5465 - DNA, 15 bp, Homo sapiens
agcttcctattctat

SEQ ID NO: 5466 - DNA, 15 bp, Homo sapiens
tagcttcctattcta

SEQ ID NO: 5467 - DNA, 15 bp, Homo sapiens
atagcttcctattct

SEQ ID NO: 5468 - DNA, 15 bp, Homo sapiens
catagcttcctattc

SEQ ID NO: 5469 - DNA, 15 bp, Homo sapiens
gcatagcttcctatt

SEQ ID NO: 5470 - DNA, 15 bp, Homo sapiens
agcatagcttcctat

SEQ ID NO: 5471 - DNA, 15 bp, Homo sapiens
aagcatagcttccta

SEQ ID NO: 5472 - DNA, 15 bp, Homo sapiens
caagcatagcttcct

SEQ ID NO: 5473 - DNA, 15 bp, Homo sapiens
acaagcatagcttcc

SEQ ID NO: 5474 - DNA, 15 bp, Homo sapiens
cacaagcatagcttc

SEQ ID NO: 5475 - DNA, 15 bp, Homo sapiens
tcacaagcatagctt

SEQ ID NO: 5476 - DNA, 15 bp, Homo sapiens
gtcacaagcatagct

SEQ ID NO: 5477 - DNA, 15 bp, Homo sapiens
ggtcacaagcatagc

SEQ ID NO: 5478 - DNA, 15 bp, Homo sapiens
aggtcacaagcatag

SEQ ID NO: 5479 - DNA, 15 bp, Homo sapiens
caggtcacaagcata

SEQ ID NO: 5480 - DNA, 15 bp, Homo sapiens
acaggtcacaagcat

SEQ ID NO: 5481 - DNA, 15 bp, Homo sapiens
tacaggtcacaagca

SEQ ID NO: 5482 - DNA, 15 bp, Homo sapiens
ctacaggtcacaagc

SEQ ID NO: 5483 - DNA, 15 bp, Homo sapiens
cctacaggtcacaag

SEQ ID NO: 5484 - DNA, 15 bp, Homo sapiens
ccctacaggtcacaa

SEQ ID NO: 5485 - DNA, 15 bp, Homo sapiens
tccctacaggtcaca

SEQ ID NO: 5486 - DNA, 15 bp, Homo sapiens
atccctacaggtcac

SEQ ID NO: 5487 - DNA, 15 bp, Homo sapiens
gatccctacaggtca

SEQ ID NO: 5488 - DNA, 15 bp, Homo sapiens
agatccctacaggtc

SEQ ID NO: 5489 - DNA, 15 bp, Homo sapiens
tagatccctacaggt

SEQ ID NO: 5490 - DNA, 15 bp, Homo sapiens
ctagatccctacagg

SEQ ID NO: 5491 - DNA, 15 bp, Homo sapiens
actagatccctacag

SEQ ID NO: 5492 - DNA, 15 bp, Homo sapiens
aactagatccctaca

SEQ ID NO: 5493 - DNA, 15 bp, Homo sapiens
aaactagatccctac

SEQ ID NO: 5494 - DNA, 15 bp, Homo sapiens
taaactagatcccta

SEQ ID NO: 5495 - DNA, 15 bp, Homo sapiens
ttaaactagatccct

SEQ ID NO: 5496 - DNA, 15 bp, Homo sapiens
attaaactagatccc

SEQ ID NO: 5497 - DNA, 15 bp, Homo sapiens
aattaaactagatcc

SEQ ID NO: 5498 - DNA, 15 bp, Homo sapiens
aaattaaactagatc

SEQ ID NO: 5499 - DNA, 15 bp, Homo sapiens
caaattaaactagat

SEQ ID NO: 5500 - DNA, 15 bp, Homo sapiens
acaaattaaactaga

SEQ ID NO: 5501 - DNA, 15 bp, Homo sapiens
tacaaattaaactag

SEQ ID NO: 5502 - DNA, 15 bp, Homo sapiens
ttacaaattaaacta

SEQ ID NO: 5503 - DNA, 15 bp, Homo sapiens
attacaaattaaact

SEQ ID NO: 5504 - DNA, 15 bp, Homo sapiens
tattacaaattaaac

SEQ ID NO: 5505 - DNA, 15 bp, Homo sapiens
atattacaaattaaa

SEQ ID NO: 5506 - DNA, 15 bp, Homo sapiens
aatattacaaattaa

SEQ ID NO: 5507 - DNA, 15 bp, Homo sapiens
caatattacaaatta

SEQ ID NO: 5508 - DNA, 15 bp, Homo sapiens
ccaatattacaaatt

SEQ ID NO: 5509 - DNA, 15 bp, Homo sapiens
gccaatattacaaat

SEQ ID NO: 5510 - DNA, 15 bp, Homo sapiens
ggccaatattacaaa

SEQ ID NO: 5511 - DNA, 15 bp, Homo sapiens
tggccaatattacaa

SEQ ID NO: 5512 - DNA, 15 bp, Homo sapiens
ttggccaatattaca

SEQ ID NO: 5513 - DNA, 15 bp, Homo sapiens
tttggccaatattac

SEQ ID NO: 5514 - DNA, 15 bp, Homo sapiens
ctttggccaatatta

SEQ ID NO: 5515 - DNA, 15 bp, Homo sapiens
actttggccaatatt

SEQ ID NO: 5516 - DNA, 15 bp, Homo sapiens
cactttggccaatat

SEQ ID NO: 5517 - DNA, 15 bp, Homo sapiens
acactttggccaata

SEQ ID NO: 5518 - DNA, 15 bp, Homo sapiens
aacactttggccaat

SEQ ID NO: 5519 - DNA, 15 bp, Homo sapiens
aaacactttggccaa

SEQ ID NO: 5520 - DNA, 15 bp, Homo sapiens
aaaacactttggcca

SEQ ID NO: 5521 - DNA, 15 bp, Homo sapiens
aaaaacactttggcc

SEQ ID NO: 5522 - DNA, 15 bp, Homo sapiens
aaaaaacactttggc

SEQ ID NO: 5523 - DNA, 15 bp, Homo sapiens
aaaaaaacactttgg

SEQ ID NO: 5524 - DNA, 15 bp, Homo sapiens
caaaaaaacactttg

SEQ ID NO: 5525 - DNA, 15 bp, Homo sapiens
tcaaaaaaacacttt

SEQ ID NO: 5526 - DNA, 15 bp, Homo sapiens
ttcaaaaaaacactt

SEQ ID NO: 5527 - DNA, 15 bp, Homo sapiens
tttcaaaaaaacact

SEQ ID NO: 5528 - DNA, 15 bp, Homo sapiens
gtttcaaaaaaacac

SEQ ID NO: 5529 - DNA, 15 bp, Homo sapiens
cgtttcaaaaaaaca

SEQ ID NO: 5530 - DNA, 15 bp, Homo sapiens
ccgtttcaaaaaaac

SEQ ID NO: 5531 - DNA, 15 bp, Homo sapiens
accgtttcaaaaaaa

SEQ ID NO: 5532 - DNA, 15 bp, Homo sapiens
gaccgtttcaaaaaa

SEQ ID NO: 5533 - DNA, 15 bp, Homo sapiens
tgaccgtttcaaaaa

SEQ ID NO: 5534 - DNA, 15 bp, Homo sapiens
gtgaccgtttcaaaa

SEQ ID NO: 5535 - DNA, 15 bp, Homo sapiens
agtgaccgtttcaaa

SEQ ID NO: 5536 - DNA, 15 bp, Homo sapiens
aagtgaccgtttcaa

SEQ ID NO: 5537 - DNA, 15 bp, Homo sapiens
caagtgaccgtttca

SEQ ID NO: 5538 - DNA, 15 bp, Homo sapiens
ccaagtgaccgtttc

SEQ ID NO: 5539 - DNA, 15 bp, Homo sapiens
tccaagtgaccgttt

SEQ ID NO: 5540 - DNA, 15 bp, Homo sapiens
atccaagtgaccgtt

SEQ ID NO: 5541 - DNA, 15 bp, Homo sapiens
aatccaagtgaccgt

SEQ ID NO: 5542 - DNA, 15 bp, Homo sapiens
caatccaagtgaccg

SEQ ID NO: 5543 - DNA, 15 bp, Homo sapiens
tcaatccaagtgacc

SEQ ID NO: 5544 - DNA, 15 bp, Homo sapiens
ttcaatccaagtgac

SEQ ID NO: 5545 - DNA, 15 bp, Homo sapiens
tttcaatccaagtga

SEQ ID NO: 5546 - DNA, 15 bp, Homo sapiens
ctttcaatccaagtg

SEQ ID NO: 5547 - DNA, 15 bp, Homo sapiens
tctttcaatccaagt

SEQ ID NO: 5548 - DNA, 15 bp, Homo sapiens
ttctttcaatccaag

SEQ ID NO: 5549 - DNA, 15 bp, Homo sapiens
tttctttcaatccaa

SEQ ID NO: 5550 - DNA, 15 bp, Homo sapiens
atttctttcaatcca

SEQ ID NO: 5551 - DNA, 15 bp, Homo sapiens
tatttctttcaatcc

SEQ ID NO: 5552 - DNA, 15 bp, Homo sapiens
ttatttctttcaatc

SEQ ID NO: 5553 - DNA, 15 bp, Homo sapiens
cttatttctttcaat

SEQ ID NO: 5554 - DNA, 15 bp, Homo sapiens
gcttatttctttcaa

SEQ ID NO: 5555 - DNA, 15 bp, Homo sapiens
agcttatttctttca

SEQ ID NO: 5556 - DNA, 15 bp, Homo sapiens
aagcttatttctttc

SEQ ID NO: 5557 - DNA, 15 bp, Homo sapiens
gaagcttatttcttt

SEQ ID NO: 5558 - DNA, 15 bp, Homo sapiens
tgaagcttatttctt

SEQ ID NO: 5559 - DNA, 15 bp, Homo sapiens
atgaagcttatttct

SEQ ID NO: 5560 - DNA, 15 bp, Homo sapiens
gatgaagcttatttc

SEQ ID NO: 5561 - DNA, 15 bp, Homo sapiens
agatgaagcttattt

SEQ ID NO: 5562 - DNA, 15 bp, Homo sapiens
aagatgaagcttatt

SEQ ID NO: 5563 - DNA, 15 bp, Homo sapiens
gaagatgaagcttat

SEQ ID NO: 5564 - DNA, 15 bp, Homo sapiens
ggaagatgaagctta

SEQ ID NO: 5565 - DNA, 15 bp, Homo sapiens
tggaagatgaagctt

SEQ ID NO: 5566 - DNA, 15 bp, Homo sapiens
ctggaagatgaagct

SEQ ID NO: 5567 - DNA, 15 bp, Homo sapiens
actggaagatgaagc

SEQ ID NO: 5568 - DNA, 15 bp, Homo sapiens
cactggaagatgaag

SEQ ID NO: 5569 - DNA, 15 bp, Homo sapiens
gcactggaagatgaa

SEQ ID NO: 5570 - DNA, 15 bp, Homo sapiens
tgcactggaagatga

SEQ ID NO: 5571 - DNA, 15 bp, Homo sapiens
atgcactggaagatg

SEQ ID NO: 5572 - DNA, 15 bp, Homo sapiens
tatgcactggaagat

SEQ ID NO: 5573 - DNA, 15 bp, Homo sapiens
atatgcactggaaga

SEQ ID NO: 5574 - DNA, 15 bp, Homo sapiens
catatgcactggaag

SEQ ID NO: 5575 - DNA, 15 bp, Homo sapiens
tcatatgcactggaa

SEQ ID NO: 5576 - DNA, 15 bp, Homo sapiens
ttcatatgcactgga

SEQ ID NO: 5577 - DNA, 15 bp, Homo sapiens
gttcatatgcactgg

SEQ ID NO: 5578 - DNA, 15 bp, Homo sapiens
tgttcatatgcactg

SEQ ID NO: 5579 - DNA, 15 bp, Homo sapiens
atgttcatatgcact

SEQ ID NO: 5580 - DNA, 15 bp, Homo sapiens
aatgttcatatgcac

SEQ ID NO: 5581 - DNA, 15 bp, Homo sapiens
taatgttcatatgca

SEQ ID NO: 5582 - DNA, 15 bp, Homo sapiens
ctaatgttcatatgc

SEQ ID NO: 5583 - DNA, 15 bp, Homo sapiens
tctaatgttcatatg

SEQ ID NO: 5584 - DNA, 15 bp, Homo sapiens
ttctaatgttcatat

SEQ ID NO: 5585 - DNA, 15 bp, Homo sapiens
tttctaatgttcata

SEQ ID NO: 5586 - DNA, 15 bp, Homo sapiens
atttctaatgttcat

SEQ ID NO: 5587 - DNA, 15 bp, Homo sapiens
aatttctaatgttca

SEQ ID NO: 5588 - DNA, 15 bp, Homo sapiens
caatttctaatgttc

SEQ ID NO: 5589 - DNA, 15 bp, Homo sapiens
gcaatttctaatgtt

SEQ ID NO: 5590 - DNA, 15 bp, Homo sapiens
agcaatttctaatgt

SEQ ID NO: 5591 - DNA, 15 bp, Homo sapiens
aagcaatttctaatg

SEQ ID NO: 5592 - DNA, 15 bp, Homo sapiens
taagcaatttctaat

SEQ ID NO: 5593 - DNA, 15 bp, Homo sapiens
ttaagcaatttctaa

SEQ ID NO: 5594 - DNA, 15 bp, Homo sapiens
attaagcaatttcta

SEQ ID NO: 5595 - DNA, 15 bp, Homo sapiens
aattaagcaatttct

SEQ ID NO: 5596 - DNA, 15 bp, Homo sapiens
aaattaagcaatttc

SEQ ID NO: 5597 - DNA, 15 bp, Homo sapiens
caaattaagcaattt

SEQ ID NO: 5598 - DNA, 15 bp, Homo sapiens
tcaaattaagcaatt

SEQ ID NO: 5599 - DNA, 15 bp, Homo sapiens
gtcaaattaagcaat

SEQ ID NO: 5600 - DNA, 15 bp, Homo sapiens
tgtcaaattaagcaa

SEQ ID NO: 5601 - DNA, 15 bp, Homo sapiens
gtgtcaaattaagca

SEQ ID NO: 5602 - DNA, 15 bp, Homo sapiens
agtgtcaaattaagc

SEQ ID NO: 5603 - DNA, 15 bp, Homo sapiens
cagtgtcaaattaag

SEQ ID NO: 5604 - DNA, 15 bp, Homo sapiens
tcagtgtcaaattaa

SEQ ID NO: 5605 - DNA, 15 bp, Homo sapiens
ttcagtgtcaaatta

SEQ ID NO: 5606 - DNA, 15 bp, Homo sapiens
cttcagtgtcaaatt

SEQ ID NO: 5607 - DNA, 15 bp, Homo sapiens
tcttcagtgtcaaat

SEQ ID NO: 5608 - DNA, 15 bp, Homo sapiens
gtcttcagtgtcaaa

SEQ ID NO: 5609 - DNA, 15 bp, Homo sapiens
ggtcttcagtgtcaa

SEQ ID NO: 5610 - DNA, 15 bp, Homo sapiens
gggtcttcagtgtca

SEQ ID NO: 5611 - DNA, 15 bp, Homo sapiens
ggggtcttcagtgtc

SEQ ID NO: 5612 - DNA, 15 bp, Homo sapiens
gggggtcttcagtgt

SEQ ID NO: 5613 - DNA, 15 bp, Homo sapiens
ggggggtcttcagtg

SEQ ID NO: 5614 - DNA, 15 bp, Homo sapiens
gggggggtcttcagt

SEQ ID NO: 5615 - DNA, 15 bp, Homo sapiens
agggggggtcttcag

SEQ ID NO: 5616 - DNA, 15 bp, Homo sapiens
gagggggggtcttca

SEQ ID NO: 5617 - DNA, 15 bp, Homo sapiens
agagggggggtcttc

SEQ ID NO: 5618 - DNA, 15 bp, Homo sapiens
tagagggggggtctt

SEQ ID NO: 5619 - DNA, 15 bp, Homo sapiens
atagagggggggtct

SEQ ID NO: 5620 - DNA, 15 bp, Homo sapiens
gatagagggggggtc

SEQ ID NO: 5621 - DNA, 15 bp, Homo sapiens
tgatagagggggggt

SEQ ID NO: 5622 - DNA, 15 bp, Homo sapiens
atgatagaggggggg

SEQ ID NO: 5623 - DNA, 15 bp, Homo sapiens
aatgatagagggggg

SEQ ID NO: 5624 - DNA, 15 bp, Homo sapiens
gaatgatagaggggg

SEQ ID NO: 5625 - DNA, 15 bp, Homo sapiens
tgaatgatagagggg

SEQ ID NO: 5626 - DNA, 15 bp, Homo sapiens
gtgaatgatagaggg

SEQ ID NO: 5627 - DNA, 15 bp, Homo sapiens
agtgaatgatagagg

SEQ ID NO: 5628 - DNA, 15 bp, Homo sapiens
aagtgaatgatagag

SEQ ID NO: 5629 - DNA, 15 bp, Homo sapiens
aaagtgaatgataga

SEQ ID NO: 5630 - DNA, 15 bp, Homo sapiens
taaagtgaatgatag

SEQ ID NO: 5631 - DNA, 15 bp, Homo sapiens
ataaagtgaatgata

SEQ ID NO: 5632 - DNA, 15 bp, Homo sapiens
gataaagtgaatgat

SEQ ID NO: 5633 - DNA, 15 bp, Homo sapiens
agataaagtgaatga

SEQ ID NO: 5634 - DNA, 15 bp, Homo sapiens
aagataaagtgaatg

SEQ ID NO: 5635 - DNA, 15 bp, Homo sapiens
aaagataaagtgaat

SEQ ID NO: 5636 - DNA, 15 bp, Homo sapiens
aaaagataaagtgaa

SEQ ID NO: 5637 - DNA, 15 bp, Homo sapiens
gaaaagataaagtga

SEQ ID NO: 5638 - DNA, 15 bp, Homo sapiens
tgaaaagataaagtg

SEQ ID NO: 5639 - DNA, 15 bp, Homo sapiens
atgaaaagataaagt

SEQ ID NO: 5640 - DNA, 15 bp, Homo sapiens
aatgaaaagataaag

SEQ ID NO: 5641 - DNA, 15 bp, Homo sapiens
gaatgaaaagataaa

SEQ ID NO: 5642 - DNA, 15 bp, Homo sapiens
agaatgaaaagataa

SEQ ID NO: 5643 - DNA, 15 bp, Homo sapiens
gagaatgaaaagata

SEQ ID NO: 5644 - DNA, 15 bp, Homo sapiens
agagaatgaaaagat

SEQ ID NO: 5645 - DNA, 15 bp, Homo sapiens
aagagaatgaaaaga

SEQ ID NO: 5646 - DNA, 15 bp, Homo sapiens
gaagagaatgaaaag

SEQ ID NO: 5647 - DNA, 15 bp, Homo sapiens
agaagagaatgaaaa

SEQ ID NO: 5648 - DNA, 15 bp, Homo sapiens
aagaagagaatgaaa

SEQ ID NO: 5649 - DNA, 15 bp, Homo sapiens
caagaagagaatgaa

SEQ ID NO: 5650 - DNA, 15 bp, Homo sapiens
tcaagaagagaatga

SEQ ID NO: 5651 - DNA, 15 bp, Homo sapiens
atcaagaagagaatg

SEQ ID NO: 5652 - DNA, 15 bp, Homo sapiens
aatcaagaagagaat

SEQ ID NO: 5653 - DNA, 15 bp, Homo sapiens
taatcaagaagagaa

SEQ ID NO: 5654 - DNA, 15 bp, Homo sapiens
gtaatcaagaagaga

SEQ ID NO: 5655 - DNA, 15 bp, Homo sapiens
ggtaatcaagaagag

SEQ ID NO: 5656 - DNA, 15 bp, Homo sapiens
tggtaatcaagaaga

SEQ ID NO: 5657 - DNA, 15 bp, Homo sapiens
ttggtaatcaagaag

SEQ ID NO: 5658 - DNA, 15 bp, Homo sapiens
gttggtaatcaagaa

SEQ ID NO: 5659 - DNA, 15 bp, Homo sapiens
agttggtaatcaaga

SEQ ID NO: 5660 - DNA, 15 bp, Homo sapiens
aagttggtaatcaag

SEQ ID NO: 5661 - DNA, 15 bp, Homo sapiens
aaagttggtaatcaa

SEQ ID NO: 5662 - DNA, 15 bp, Homo sapiens
caaagttggtaatca

SEQ ID NO: 5663 - DNA, 15 bp, Homo sapiens
acaaagttggtaatc

SEQ ID NO: 5664 - DNA, 15 bp, Homo sapiens
aacaaagttggtaat

SEQ ID NO: 5665 - DNA, 15 bp, Homo sapiens
gaacaaagttggtaa

SEQ ID NO: 5666 - DNA, 15 bp, Homo sapiens
agaacaaagttggta

SEQ ID NO: 5667 - DNA, 15 bp, Homo sapiens
tagaacaaagttggt

SEQ ID NO: 5668 - DNA, 15 bp, Homo sapiens
ttagaacaaagttgg

SEQ ID NO: 5669 - DNA, 15 bp, Homo sapiens
tttagaacaaagttg

SEQ ID NO: 5670 - DNA, 15 bp, Homo sapiens
atttagaacaaagtt

SEQ ID NO: 5671 - DNA, 15 bp, Homo sapiens
catttagaacaaagt

SEQ ID NO: 5672 - DNA, 15 bp, Homo sapiens
acatttagaacaaag

SEQ ID NO: 5673 - DNA, 15 bp, Homo sapiens
tacatttagaacaaa

SEQ ID NO: 5674 - DNA, 15 bp, Homo sapiens
ttacatttagaacaa

SEQ ID NO: 5675 - DNA, 15 bp, Homo sapiens
gttacatttagaaca

SEQ ID NO: 5676 - DNA, 15 bp, Homo sapiens
tgttacatttagaac

SEQ ID NO: 5677 - DNA, 15 bp, Homo sapiens
gtgttacatttagaa

SEQ ID NO: 5678 - DNA, 15 bp, Homo sapiens
tgtgttacatttaga

SEQ ID NO: 5679 - DNA, 15 bp, Homo sapiens
atgtgttacatttag

SEQ ID NO: 5680 - DNA, 15 bp, Homo sapiens
gatgtgttacattta

SEQ ID NO: 5681 - DNA, 15 bp, Homo sapiens
cgatgtgttacattt

SEQ ID NO: 5682 - DNA, 15 bp, Homo sapiens
acgatgtgttacatt

SEQ ID NO: 5683 - DNA, 15 bp, Homo sapiens
tacgatgtgttacat

SEQ ID NO: 5684 - DNA, 15 bp, Homo sapiens
atacgatgtgttaca

SEQ ID NO: 5685 - DNA, 15 bp, Homo sapiens
catacgatgtgttac

SEQ ID NO: 5686 - DNA, 15 bp, Homo sapiens
ccatacgatgtgtta

SEQ ID NO: 5687 - DNA, 15 bp, Homo sapiens
accatacgatgtgtt

SEQ ID NO: 5688 - DNA, 15 bp, Homo sapiens
aaccatacgatgtgt

SEQ ID NO: 5689 - DNA, 15 bp, Homo sapiens
caaccatacgatgtg

SEQ ID NO: 5690 - DNA, 15 bp, Homo sapiens
gcaaccatacgatgt

SEQ ID NO: 5691 - DNA, 15 bp, Homo sapiens
agcaaccatacgatg

SEQ ID NO: 5692 - DNA, 15 bp, Homo sapiens
aagcaaccatacgat

SEQ ID NO: 5693 - DNA, 15 bp, Homo sapiens
taagcaaccatacga

SEQ ID NO: 5694 - DNA, 15 bp, Homo sapiens
ttaagcaaccatacg

SEQ ID NO: 5695 - DNA, 15 bp, Homo sapiens
gttaagcaaccatac

SEQ ID NO: 5696 - DNA, 15 bp, Homo sapiens
agttaagcaaccata

SEQ ID NO: 5697 - DNA, 15 bp, Homo sapiens
cagttaagcaaccat

SEQ ID NO: 5698 - DNA, 15 bp, Homo sapiens
tcagttaagcaacca

SEQ ID NO: 5699 - DNA, 15 bp, Homo sapiens
atcagttaagcaacc

SEQ ID NO: 5700 - DNA, 15 bp, Homo sapiens
catcagttaagcaac

SEQ ID NO: 5701 - DNA, 15 bp, Homo sapiens
gcatcagttaagcaa

SEQ ID NO: 5702 - DNA, 15 bp, Homo sapiens
ggcatcagttaagca

SEQ ID NO: 5703 - DNA, 15 bp, Homo sapiens
aggcatcagttaagc

SEQ ID NO: 5704 - DNA, 15 bp, Homo sapiens
caggcatcagttaag

SEQ ID NO: 5705 - DNA, 15 bp, Homo sapiens
gcaggcatcagttaa

SEQ ID NO: 5706 - DNA, 15 bp, Homo sapiens
ggcaggcatcagtta

SEQ ID NO: 5707 - DNA, 15 bp, Homo sapiens
gggcaggcatcagtt

SEQ ID NO: 5708 - DNA, 15 bp, Homo sapiens
agggcaggcatcagt

SEQ ID NO: 5709 - DNA, 15 bp, Homo sapiens
aagggcaggcatcag

SEQ ID NO: 5710 - DNA, 15 bp, Homo sapiens
aaagggcaggcatca

SEQ ID NO: 5711 - DNA, 15 bp, Homo sapiens
gaaagggcaggcatc

SEQ ID NO: 5712 - DNA, 15 bp, Homo sapiens
agaaagggcaggcat

SEQ ID NO: 5713 - DNA, 15 bp, Homo sapiens
aagaaagggcaggca

SEQ ID NO: 5714 - DNA, 15 bp, Homo sapiens
gaagaaagggcaggc

SEQ ID NO: 5715 - DNA, 15 bp, Homo sapiens
agaagaaagggcagg

SEQ ID NO: 5716 - DNA, 15 bp, Homo sapiens
gagaagaaagggcag

SEQ ID NO: 5717 - DNA, 15 bp, Homo sapiens
agagaagaaagggca

SEQ ID NO: 5718 - DNA, 15 bp, Homo sapiens
aagagaagaaagggc

SEQ ID NO: 5719 - DNA, 15 bp, Homo sapiens
aaagagaagaaaggg

SEQ ID NO: 5720 - DNA, 15 bp, Homo sapiens
aaaagagaagaaagg

SEQ ID NO: 5721 - DNA, 15 bp, Homo sapiens
gaaaagagaagaaag

SEQ ID NO: 5722 - DNA, 15 bp, Homo sapiens
ggaaaagagaagaaa

SEQ ID NO: 5723 - DNA, 15 bp, Homo sapiens
aggaaaagagaagaa

SEQ ID NO: 5724 - DNA, 15 bp, Homo sapiens
caggaaaagagaaga

SEQ ID NO: 5725 - DNA, 15 bp, Homo sapiens
gcaggaaaagagaag

SEQ ID NO: 5726 - DNA, 15 bp, Homo sapiens
agcaggaaaagagaa

SEQ ID NO: 5727 - DNA, 15 bp, Homo sapiens
aagcaggaaaagaga

SEQ ID NO: 5728 - DNA, 15 bp, Homo sapiens
aaagcaggaaaagag

SEQ ID NO: 5729 - DNA, 15 bp, Homo sapiens
caaagcaggaaaaga

SEQ ID NO: 5730 - DNA, 15 bp, Homo sapiens
acaaagcaggaaaag

SEQ ID NO: 5731 - DNA, 15 bp, Homo sapiens
aacaaagcaggaaaa

SEQ ID NO: 5732 - DNA, 15 bp, Homo sapiens
taacaaagcaggaaa

SEQ ID NO: 5733 - DNA, 15 bp, Homo sapiens
ttaacaaagcaggaa

SEQ ID NO: 5734 - DNA, 15 bp, Homo sapiens
cttaacaaagcagga

SEQ ID NO: 5735 - DNA, 15 bp, Homo sapiens
tcttaacaaagcagg

SEQ ID NO: 5736 - DNA, 15 bp, Homo sapiens
atcttaacaaagcag

SEQ ID NO: 5737 - DNA, 15 bp, Homo sapiens
tatcttaacaaagca

SEQ ID NO: 5738 - DNA, 15 bp, Homo sapiens
atatcttaacaaagc

SEQ ID NO: 5739 - DNA, 15 bp, Homo sapiens
aatatcttaacaaag

SEQ ID NO: 5740 - DNA, 15 bp, Homo sapiens
aaatatcttaacaaa

SEQ ID NO: 5741 - DNA, 15 bp, Homo sapiens
taaatatcttaacaa

SEQ ID NO: 5742 - DNA, 15 bp, Homo sapiens
ataaatatcttaaca

SEQ ID NO: 5743 - DNA, 15 bp, Homo sapiens
aataaatatcttaac

SEQ ID NO: 5744 - DNA, 15 bp, Homo sapiens
caataaatatcttaa

SEQ ID NO: 5745 - DNA, 15 bp, Homo sapiens
tcaataaatatctta

SEQ ID NO: 5746 - DNA, 15 bp, Homo sapiens
ctcaataaatatctt

SEQ ID NO: 5747 - DNA, 15 bp, Homo sapiens
gctcaataaatatct

SEQ ID NO: 5748 - DNA, 15 bp, Homo sapiens
tgctcaataaatatc

SEQ ID NO: 5749 - DNA, 15 bp, Homo sapiens
gtgctcaataaatat

SEQ ID NO: 5750 - DNA, 15 bp, Homo sapiens
ggtgctcaataaata

SEQ ID NO: 5751 - DNA, 15 bp, Homo sapiens
aggtgctcaataaat

SEQ ID NO: 5752 - DNA, 15 bp, Homo sapiens
caggtgctcaataaa

SEQ ID NO: 5753 - DNA, 15 bp, Homo sapiens
acaggtgctcaataa

SEQ ID NO: 5754 - DNA, 15 bp, Homo sapiens
gacaggtgctcaata

SEQ ID NO: 5755 - DNA, 15 bp, Homo sapiens
tgacaggtgctcaat

SEQ ID NO: 5756 - DNA, 15 bp, Homo sapiens
gtgacaggtgctcaa

SEQ ID NO: 5757 - DNA, 15 bp, Homo sapiens
tgtgacaggtgctca

SEQ ID NO: 5758 - DNA, 15 bp, Homo sapiens
ctgtgacaggtgctc

SEQ ID NO: 5759 - DNA, 15 bp, Homo sapiens
tctgtgacaggtgct

SEQ ID NO: 5760 - DNA, 15 bp, Homo sapiens
gtctgtgacaggtgc

SEQ ID NO: 5761 - DNA, 15 bp, Homo sapiens
tgtctgtgacaggtg

SEQ ID NO: 5762 - DNA, 15 bp, Homo sapiens
gtgtctgtgacaggt

SEQ ID NO: 5763 - DNA, 15 bp, Homo sapiens
agtgtctgtgacagg

SEQ ID NO: 5764 - DNA, 15 bp, Homo sapiens
cagtgtctgtgacag

SEQ ID NO: 5765 - DNA, 15 bp, Homo sapiens
ccagtgtctgtgaca

SEQ ID NO: 5766 - DNA, 15 bp, Homo sapiens
cccagtgtctgtgac

SEQ ID NO: 5767 - DNA, 15 bp, Homo sapiens
ccccagtgtctgtga

SEQ ID NO: 5768 - DNA, 15 bp, Homo sapiens
tccccagtgtctgtg

SEQ ID NO: 5769 - DNA, 15 bp, Homo sapiens
atccccagtgtctgt

SEQ ID NO: 5770 - DNA, 15 bp, Homo sapiens
tatccccagtgtctg

SEQ ID NO: 5771 - DNA, 15 bp, Homo sapiens
gtatccccagtgtct

SEQ ID NO: 5772 - DNA, 15 bp, Homo sapiens
tgtatccccagtgtc

SEQ ID NO: 5773 - DNA, 15 bp, Homo sapiens
ctgtatccccagtgt

SEQ ID NO: 5774 - DNA, 15 bp, Homo sapiens
actgtatccccagtg

SEQ ID NO: 5775 - DNA, 15 bp, Homo sapiens
tactgtatccccagt

SEQ ID NO: 5776 - DNA, 15 bp, Homo sapiens
ctactgtatccccag

SEQ ID NO: 5777 - DNA, 15 bp, Homo sapiens
actactgtatcccca

SEQ ID NO: 5778 - DNA, 15 bp, Homo sapiens
cactactgtatcccc

SEQ ID NO: 5779 - DNA, 15 bp, Homo sapiens
tcactactgtatccc

SEQ ID NO: 5780 - DNA, 15 bp, Homo sapiens
ttcactactgtatcc

SEQ ID NO: 5781 - DNA, 15 bp, Homo sapiens
attcactactgtatc

SEQ ID NO: 5782 - DNA, 15 bp, Homo sapiens
tattcactactgtat

SEQ ID NO: 5783 - DNA, 15 bp, Homo sapiens
ttattcactactgta

SEQ ID NO: 5784 - DNA, 15 bp, Homo sapiens
tttattcactactgt

SEQ ID NO: 5785 - DNA, 15 bp, Homo sapiens
ttttattcactactg

SEQ ID NO: 5786 - DNA, 15 bp, Homo sapiens
gttttattcactact

SEQ ID NO: 5787 - DNA, 15 bp, Homo sapiens
tgttttattcactac

SEQ ID NO: 5788 - DNA, 15 bp, Homo sapiens
ctgttttattcacta

SEQ ID NO: 5789 - DNA, 15 bp, Homo sapiens
tctgttttattcact

SEQ ID NO: 5790 - DNA, 15 bp, Homo sapiens
gtctgttttattcac

SEQ ID NO: 5791 - DNA, 15 bp, Homo sapiens
tgtctgttttattca

SEQ ID NO: 5792 - DNA, 15 bp, Homo sapiens
ctgtctgttttattc

SEQ ID NO: 5793 - DNA, 15 bp, Homo sapiens
tctgtctgttttatt

SEQ ID NO: 5794 - DNA, 15 bp, Homo sapiens
ctctgtctgttttat

SEQ ID NO: 5795 - DNA, 15 bp, Homo sapiens
tctctgtctgtttta

SEQ ID NO: 5796 - DNA, 15 bp, Homo sapiens
gtctctgtctgtttt

SEQ ID NO: 5797 - DNA, 15 bp, Homo sapiens
ggtctctgtctgttt

SEQ ID NO: 5798 - DNA, 15 bp, Homo sapiens
gggtctctgtctgtt

SEQ ID NO: 5799 - DNA, 15 bp, Homo sapiens
agggtctctgtctgt

SEQ ID NO: 5800 - DNA, 15 bp, Homo sapiens
aagggtctctgtctg

SEQ ID NO: 5801 - DNA, 15 bp, Homo sapiens
taagggtctctgtct

SEQ ID NO: 5802 - DNA, 15 bp, Homo sapiens
gtaagggtctctgtc

SEQ ID NO: 5803 - DNA, 15 bp, Homo sapiens
ggtaagggtctctgt

SEQ ID NO: 5804 - DNA, 15 bp, Homo sapiens
aggtaagggtctctg

SEQ ID NO: 5805 - DNA, 15 bp, Homo sapiens
caggtaagggtctct

SEQ ID NO: 5806 - DNA, 15 bp, Homo sapiens
ccaggtaagggtctc

SEQ ID NO: 5807 - DNA, 15 bp, Homo sapiens
tccaggtaagggtct

SEQ ID NO: 5808 - DNA, 15 bp, Homo sapiens
ctccaggtaagggtc

SEQ ID NO: 5809 - DNA, 15 bp, Homo sapiens
cctccaggtaagggt

SEQ ID NO: 5810 - DNA, 15 bp, Homo sapiens
tcctccaggtaaggg

SEQ ID NO: 5811 - DNA, 15 bp, Homo sapiens
atcctccaggtaagg

SEQ ID NO: 5812 - DNA, 15 bp, Homo sapiens
tatcctccaggtaag

SEQ ID NO: 5813 - DNA, 15 bp, Homo sapiens
ttatcctccaggtaa

SEQ ID NO: 5814 - DNA, 15 bp, Homo sapiens
attatcctccaggta

SEQ ID NO: 5815 - DNA, 15 bp, Homo sapiens
tattatcctccaggt

SEQ ID NO: 5816 - DNA, 15 bp, Homo sapiens
gtattatcctccagg

SEQ ID NO: 5817 - DNA, 15 bp, Homo sapiens
agtattatcctccag

SEQ ID NO: 5818 - DNA, 15 bp, Homo sapiens
cagtattatcctcca

SEQ ID NO: 5819 - DNA, 15 bp, Homo sapiens
gcagtattatcctcc

SEQ ID NO: 5820 - DNA, 15 bp, Homo sapiens
agcagtattatcctc

SEQ ID NO: 5821 - DNA, 15 bp, Homo sapiens
cagcagtattatcct

SEQ ID NO: 5822 - DNA, 15 bp, Homo sapiens
tcagcagtattatcc

SEQ ID NO: 5823 - DNA, 15 bp, Homo sapiens
ctcagcagtattatc

SEQ ID NO: 5824 - DNA, 15 bp, Homo sapiens
tctcagcagtattat

SEQ ID NO: 5825 - DNA, 15 bp, Homo sapiens
ttctcagcagtatta

SEQ ID NO: 5826 - DNA, 15 bp, Homo sapiens
tttctcagcagtatt

SEQ ID NO: 5827 - DNA, 15 bp, Homo sapiens
ttttctcagcagtat

SEQ ID NO: 5828 - DNA, 15 bp, Homo sapiens
tttttctcagcagta

SEQ ID NO: 5829 - DNA, 15 bp, Homo sapiens
atttttctcagcagt

SEQ ID NO: 5830 - DNA, 15 bp, Homo sapiens
tatttttctcagcag

SEQ ID NO: 5831 - DNA, 15 bp, Homo sapiens
ttatttttctcagca

SEQ ID NO: 5832 - DNA, 15 bp, Homo sapiens
tttatttttctcagc

SEQ ID NO: 5833 - DNA, 15 bp, Homo sapiens
ctttatttttctcag

SEQ ID NO: 5834 - DNA, 15 bp, Homo sapiens
gctttatttttctca

SEQ ID NO: 5835 - DNA, 15 bp, Homo sapiens
tgctttatttttctc

SEQ ID NO: 5836 - DNA, 15 bp, Homo sapiens
ttgctttatttttct

SEQ ID NO: 5837 - DNA, 15 bp, Homo sapiens
cttgctttatttttc

SEQ ID NO: 5838 - DNA, 15 bp, Homo sapiens
ccttgctttattttt

SEQ ID NO: 5839 - DNA, 15 bp, Homo sapiens
cccttgctttatttt

SEQ ID NO: 5840 - DNA, 15 bp, Homo sapiens
ccccttgctttattt

SEQ ID NO: 5841 - DNA, 15 bp, Homo sapiens
cccccttgctttatt

SEQ ID NO: 5842 - DNA, 15 bp, Homo sapiens
acccccttgctttat

SEQ ID NO: 5843 - DNA, 15 bp, Homo sapiens
aacccccttgcttta

SEQ ID NO: 5844 - DNA, 15 bp, Homo sapiens
aaacccccttgcttt

SEQ ID NO: 5845 - DNA, 15 bp, Homo sapiens
caaacccccttgctt

SEQ ID NO: 5846 - DNA, 15 bp, Homo sapiens
ccaaacccccttgct

SEQ ID NO: 5847 - DNA, 15 bp, Homo sapiens
tccaaacccccttgc

SEQ ID NO: 5848 - DNA, 15 bp, Homo sapiens
atccaaacccccttg

SEQ ID NO: 5849 - DNA, 15 bp, Homo sapiens
tatccaaaccccctt

SEQ ID NO: 5850 - DNA, 15 bp, Homo sapiens
atatccaaaccccct

SEQ ID NO: 5851 - DNA, 15 bp, Homo sapiens
gatatccaaaccccc

SEQ ID NO: 5852 - DNA, 15 bp, Homo sapiens
tgatatccaaacccc

SEQ ID NO: 5853 - DNA, 15 bp, Homo sapiens
ctgatatccaaaccc

SEQ ID NO: 5854 - DNA, 15 bp, Homo sapiens
tctgatatccaaacc

SEQ ID NO: 5855 - DNA, 15 bp, Homo sapiens
ctctgatatccaaac

SEQ ID NO: 5856 - DNA, 15 bp, Homo sapiens
actctgatatccaaa

SEQ ID NO: 5857 - DNA, 15 bp, Homo sapiens
tactctgatatccaa

SEQ ID NO: 5858 - DNA, 15 bp, Homo sapiens
atactctgatatcca

SEQ ID NO: 5859 - DNA, 15 bp, Homo sapiens
catactctgatatcc

SEQ ID NO: 5860 - DNA, 15 bp, Homo sapiens
acatactctgatatc

SEQ ID NO: 5861 - DNA, 15 bp, Homo sapiens
cacatactctgatat

SEQ ID NO: 5862 - DNA, 15 bp, Homo sapiens
tcacatactctgata

SEQ ID NO: 5863 - DNA, 15 bp, Homo sapiens
ttcacatactctgat

SEQ ID NO: 5864 - DNA, 15 bp, Homo sapiens
tttcacatactctga

SEQ ID NO: 5865 - DNA, 15 bp, Homo sapiens
ctttcacatactctg

SEQ ID NO: 5866 - DNA, 15 bp, Homo sapiens
cctttcacatactct

SEQ ID NO: 5867 - DNA, 15 bp, Homo sapiens
ccctttcacatactc

SEQ ID NO: 5868 - DNA, 15 bp, Homo sapiens
cccctttcacatact

SEQ ID NO: 5869 - DNA, 15 bp, Homo sapiens
ccccctttcacatac

SEQ ID NO: 5870 - DNA, 15 bp, Homo sapiens
tccccctttcacata

SEQ ID NO: 5871 - DNA, 15 bp, Homo sapiens
ttccccctttcacat

SEQ ID NO: 5872 - DNA, 15 bp, Homo sapiens
gttccccctttcaca

SEQ ID NO: 5873 - DNA, 15 bp, Homo sapiens
tgttccccctttcac

SEQ ID NO: 5874 - DNA, 15 bp, Homo sapiens
ctgttccccctttca

SEQ ID NO: 5875 - DNA, 15 bp, Homo sapiens
actgttccccctttc

SEQ ID NO: 5876 - DNA, 15 bp, Homo sapiens
aactgttcccccttt

SEQ ID NO: 5877 - DNA, 15 bp, Homo sapiens
aaactgttccccctt

SEQ ID NO: 5878 - DNA, 15 bp, Homo sapiens
aaaactgttccccct

SEQ ID NO: 5879 - DNA, 15 bp, Homo sapiens
gaaaactgttccccc

SEQ ID NO: 5880 - DNA, 15 bp, Homo sapiens
tgaaaactgttcccc

SEQ ID NO: 5881 - DNA, 15 bp, Homo sapiens
ttgaaaactgttccc

SEQ ID NO: 5882 - DNA, 15 bp, Homo sapiens
tttgaaaactgttcc

SEQ ID NO: 5883 - DNA, 15 bp, Homo sapiens
atttgaaaactgttc

SEQ ID NO: 5884 - DNA, 15 bp, Homo sapiens
aatttgaaaactgtt

SEQ ID NO: 5885 - DNA, 15 bp, Homo sapiens
caatttgaaaactgt

SEQ ID NO: 5886 - DNA, 15 bp, Homo sapiens
ccaatttgaaaactg

SEQ ID NO: 5887 - DNA, 15 bp, Homo sapiens
cccaatttgaaaact

SEQ ID NO: 5888 - DNA, 15 bp, Homo sapiens
acccaatttgaaaac

SEQ ID NO: 5889 - DNA, 15 bp, Homo sapiens
cacccaatttgaaaa

SEQ ID NO: 5890 - DNA, 15 bp, Homo sapiens
ccacccaatttgaaa

SEQ ID NO: 5891 - DNA, 15 bp, Homo sapiens
accacccaatttgaa

SEQ ID NO: 5892 - DNA, 15 bp, Homo sapiens
gaccacccaatttga

SEQ ID NO: 5893 - DNA, 15 bp, Homo sapiens
ggaccacccaatttg

SEQ ID NO: 5894 - DNA, 15 bp, Homo sapiens
cggaccacccaattt

SEQ ID NO: 5895 - DNA, 15 bp, Homo sapiens
ccggaccacccaatt

SEQ ID NO: 5896 - DNA, 15 bp, Homo sapiens
tccggaccacccaat

SEQ ID NO: 5897 - DNA, 15 bp, Homo sapiens
ttccggaccacccaa

SEQ ID NO: 5898 - DNA, 15 bp, Homo sapiens
tttccggaccaccca

SEQ ID NO: 5899 - DNA, 15 bp, Homo sapiens
ctttccggaccaccc

SEQ ID NO: 5900 - DNA, 15 bp, Homo sapiens
actttccggaccacc

SEQ ID NO: 5901 - DNA, 15 bp, Homo sapiens
aactttccggaccac

SEQ ID NO: 5902 - DNA, 15 bp, Homo sapiens
gaactttccggacca

SEQ ID NO: 5903 - DNA, 15 bp, Homo sapiens
agaactttccggacc

SEQ ID NO: 5904 - DNA, 15 bp, Homo sapiens
aagaactttccggac

SEQ ID NO: 5905 - DNA, 15 bp, Homo sapiens
caagaactttccgga

SEQ ID NO: 5906 - DNA, 15 bp, Homo sapiens
tcaagaactttccgg

SEQ ID NO: 5907 - DNA, 15 bp, Homo sapiens
ctcaagaactttccg

SEQ ID NO: 5908 - DNA, 15 bp, Homo sapiens
cctcaagaactttcc

SEQ ID NO: 5909 - DNA, 15 bp, Homo sapiens
tcctcaagaactttc

SEQ ID NO: 5910 - DNA, 15 bp, Homo sapiens
ttcctcaagaacttt

SEQ ID NO: 5911 - DNA, 15 bp, Homo sapiens
cttcctcaagaactt

SEQ ID NO: 5912 - DNA, 15 bp, Homo sapiens
ccttcctcaagaact

SEQ ID NO: 5913 - DNA, 15 bp, Homo sapiens
accttcctcaagaac

SEQ ID NO: 5914 - DNA, 15 bp, Homo sapiens
caccttcctcaagaa

SEQ ID NO: 5915 - DNA, 15 bp, Homo sapiens
tcaccttcctcaaga

SEQ ID NO: 5916 - DNA, 15 bp, Homo sapiens
gtcaccttcctcaag

SEQ ID NO: 5917 - DNA, 15 bp, Homo sapiens
tgtcaccttcctcaa

SEQ ID NO: 5918 - DNA, 15 bp, Homo sapiens
atgtcaccttcctca

SEQ ID NO: 5919 - DNA, 15 bp, Homo sapiens
aatgtcaccttcctc

SEQ ID NO: 5920 - DNA, 15 bp, Homo sapiens
aaatgtcaccttcct

SEQ ID NO: 5921 - DNA, 15 bp, Homo sapiens
caaatgtcaccttcc

SEQ ID NO: 5922 - DNA, 15 bp, Homo sapiens
gcaaatgtcaccttc

SEQ ID NO: 5923 - DNA, 15 bp, Homo sapiens
cgcaaatgtcacctt

SEQ ID NO: 5924 - DNA, 15 bp, Homo sapiens
tcgcaaatgtcacct

SEQ ID NO: 5925 - DNA, 15 bp, Homo sapiens
ttcgcaaatgtcacc

SEQ ID NO: 5926 - DNA, 15 bp, Homo sapiens
tttcgcaaatgtcac

SEQ ID NO: 5927 - DNA, 15 bp, Homo sapiens
ttttcgcaaatgtca

SEQ ID NO: 5928 - DNA, 15 bp, Homo sapiens
cttttcgcaaatgtc

SEQ ID NO: 5929 - DNA, 15 bp, Homo sapiens
tcttttcgcaaatgt

SEQ ID NO: 5930 - DNA, 15 bp, Homo sapiens
atcttttcgcaaatg

SEQ ID NO: 5931 - DNA, 15 bp, Homo sapiens
gatcttttcgcaaat

SEQ ID NO: 5932 - DNA, 15 bp, Homo sapiens
agatcttttcgcaaa

SEQ ID NO: 5933 - DNA, 15 bp, Homo sapiens
cagatcttttcgcaa

SEQ ID NO: 5934 - DNA, 15 bp, Homo sapiens
tcagatcttttcgca

SEQ ID NO: 5935 - DNA, 15 bp, Homo sapiens
ttcagatcttttcgc

SEQ ID NO: 5936 - DNA, 15 bp, Homo sapiens
cttcagatcttttcg

SEQ ID NO: 5937 - DNA, 15 bp, Homo sapiens
ccttcagatcttttc

SEQ ID NO: 5938 - DNA, 15 bp, Homo sapiens
tccttcagatctttt

SEQ ID NO: 5939 - DNA, 15 bp, Homo sapiens
ctccttcagatcttt

SEQ ID NO: 5940 - DNA, 15 bp, Homo sapiens
cctccttcagatctt

SEQ ID NO: 5941 - DNA, 15 bp, Homo sapiens
acctccttcagatct

SEQ ID NO: 5942 - DNA, 15 bp, Homo sapiens
cacctccttcagatc

SEQ ID NO: 5943 - DNA, 15 bp, Homo sapiens
ccacctccttcagat

SEQ ID NO: 5944 - DNA, 15 bp, Homo sapiens
cccacctccttcaga

SEQ ID NO: 5945 - DNA, 15 bp, Homo sapiens
gcccacctccttcag

SEQ ID NO: 5946 - DNA, 15 bp, Homo sapiens
tgcccacctccttca

SEQ ID NO: 5947 - DNA, 15 bp, Homo sapiens
atgcccacctccttc

SEQ ID NO: 5948 - DNA, 15 bp, Homo sapiens
aatgcccacctcctt

SEQ ID NO: 5949 - DNA, 15 bp, Homo sapiens
taatgcccacctcct

SEQ ID NO: 5950 - DNA, 15 bp, Homo sapiens
ctaatgcccacctcc

SEQ ID NO: 5951 - DNA, 15 bp, Homo sapiens
cctaatgcccacctc

SEQ ID NO: 5952 - DNA, 15 bp, Homo sapiens
ccctaatgcccacct

SEQ ID NO: 5953 - DNA, 15 bp, Homo sapiens
gccctaatgcccacc

SEQ ID NO: 5954 - DNA, 15 bp, Homo sapiens
ggccctaatgcccac

SEQ ID NO: 5955 - DNA, 15 bp, Homo sapiens
tggccctaatgccca

SEQ ID NO: 5956 - DNA, 15 bp, Homo sapiens
atggccctaatgccc

SEQ ID NO: 5957 - DNA, 15 bp, Homo sapiens
catggccctaatgcc

SEQ ID NO: 5958 - DNA, 15 bp, Homo sapiens
acatggccctaatgc

SEQ ID NO: 5959 - DNA, 15 bp, Homo sapiens
aacatggccctaatg

SEQ ID NO: 5960 - DNA, 15 bp, Homo sapiens
caacatggccctaat

SEQ ID NO: 5961 - DNA, 15 bp, Homo sapiens
ccaacatggccctaa

SEQ ID NO: 5962 - DNA, 15 bp, Homo sapiens
accaacatggcccta

SEQ ID NO: 5963 - DNA, 15 bp, Homo sapiens
gaccaacatggccct

SEQ ID NO: 5964 - DNA, 15 bp, Homo sapiens
agaccaacatggccc

SEQ ID NO: 5965 - DNA, 15 bp, Homo sapiens
gagaccaacatggcc

SEQ ID NO: 5966 - DNA, 15 bp, Homo sapiens
ggagaccaacatggc

SEQ ID NO: 5967 - DNA, 15 bp, Homo sapiens
gggagaccaacatgg

SEQ ID NO: 5968 - DNA, 15 bp, Homo sapiens
tgggagaccaacatg

SEQ ID NO: 5969 - DNA, 15 bp, Homo sapiens
atgggagaccaacat

SEQ ID NO: 5970 - DNA, 15 bp, Homo sapiens
gatgggagaccaaca

SEQ ID NO: 5971 - DNA, 15 bp, Homo sapiens
agatgggagaccaac

SEQ ID NO: 5972 - DNA, 15 bp, Homo sapiens
cagatgggagaccaa

SEQ ID NO: 5973 - DNA, 15 bp, Homo sapiens
acagatgggagacca

SEQ ID NO: 5974 - DNA, 15 bp, Homo sapiens
gacagatgggagacc

SEQ ID NO: 5975 - DNA, 15 bp, Homo sapiens
agacagatgggagac

SEQ ID NO: 5976 - DNA, 15 bp, Homo sapiens
tagacagatgggaga

SEQ ID NO: 5977 - DNA, 15 bp, Homo sapiens
ttagacagatgggag

SEQ ID NO: 5978 - DNA, 15 bp, Homo sapiens
tttagacagatggga

SEQ ID NO: 5979 - DNA, 15 bp, Homo sapiens
atttagacagatggg

SEQ ID NO: 5980 - DNA, 15 bp, Homo sapiens
gatttagacagatgg

SEQ ID NO: 5981 - DNA, 15 bp, Homo sapiens
tgatttagacagatg

SEQ ID NO: 5982 - DNA, 15 bp, Homo sapiens
atgatttagacagat

SEQ ID NO: 5983 - DNA, 15 bp, Homo sapiens
tatgatttagacaga

SEQ ID NO: 5984 - DNA, 15 bp, Homo sapiens
ttatgatttagacag

SEQ ID NO: 5985 - DNA, 15 bp, Homo sapiens
tttatgatttagaca

SEQ ID NO: 5986 - DNA, 15 bp, Homo sapiens
ctttatgatttagac

SEQ ID NO: 5987 - DNA, 15 bp, Homo sapiens
actttatgatttaga

SEQ ID NO: 5988 - DNA, 15 bp, Homo sapiens
gactttatgatttag

SEQ ID NO: 5989 - DNA, 15 bp, Homo sapiens
tgactttatgattta

SEQ ID NO: 5990 - DNA, 15 bp, Homo sapiens
atgactttatgattt

SEQ ID NO: 5991 - DNA, 15 bp, Homo sapiens
tatgactttatgatt

SEQ ID NO: 5992 - DNA, 15 bp, Homo sapiens
ttatgactttatgat

SEQ ID NO: 5993 - DNA, 15 bp, Homo sapiens
attatgactttatga

SEQ ID NO: 5994 - DNA, 15 bp, Homo sapiens
aattatgactttatg

SEQ ID NO: 5995 - DNA, 15 bp, Homo sapiens
taattatgactttat

SEQ ID NO: 5996 - DNA, 15 bp, Homo sapiens
ttaattatgacttta

SEQ ID NO: 5997 - DNA, 15 bp, Homo sapiens
attaattatgacttt

SEQ ID NO: 5998 - DNA, 15 bp, Homo sapiens
tattaattatgactt

SEQ ID NO: 5999 - DNA, 15 bp, Homo sapiens
atattaattatgact

SEQ ID NO: 6000 - DNA, 15 bp, Homo sapiens
catattaattatgac

SEQ ID NO: 6001 - DNA, 15 bp, Homo sapiens
ccatattaattatga

SEQ ID NO: 6002 - DNA, 15 bp, Homo sapiens
accatattaattatg

SEQ ID NO: 6003 - DNA, 15 bp, Homo sapiens
taccatattaattat

SEQ ID NO: 6004 - DNA, 15 bp, Homo sapiens
ttaccatattaatta

SEQ ID NO: 6005 - DNA, 15 bp, Homo sapiens
attaccatattaatt

SEQ ID NO: 6006 - DNA, 15 bp, Homo sapiens
tattaccatattaat

SEQ ID NO: 6007 - DNA, 15 bp, Homo sapiens
ttattaccatattaa

SEQ ID NO: 6008 - DNA, 15 bp, Homo sapiens
attattaccatatta

SEQ ID NO: 6009 - DNA, 15 bp, Homo sapiens
aattattaccatatt

SEQ ID NO: 6010 - DNA, 15 bp, Homo sapiens
aaattattaccatat

SEQ ID NO: 6011 - DNA, 15 bp, Homo sapiens
caaattattaccata

SEQ ID NO: 6012 - DNA, 15 bp, Homo sapiens
gcaaattattaccat

SEQ ID NO: 6013 - DNA, 15 bp, Homo sapiens
tgcaaattattacca

SEQ ID NO: 6014 - DNA, 15 bp, Homo sapiens
atgcaaattattacc

SEQ ID NO: 6015 - DNA, 15 bp, Homo sapiens
tatgcaaattattac

SEQ ID NO: 6016 - DNA, 15 bp, Homo sapiens
ctatgcaaattatta

SEQ ID NO: 6017 - DNA, 15 bp, Homo sapiens
cctatgcaaattatt

SEQ ID NO: 6018 - DNA, 15 bp, Homo sapiens
acctatgcaaattat

SEQ ID NO: 6019 - DNA, 15 bp, Homo sapiens
aacctatgcaaatta

SEQ ID NO: 6020 - DNA, 15 bp, Homo sapiens
aaacctatgcaaatt

SEQ ID NO: 6021 - DNA, 15 bp, Homo sapiens
gaaacctatgcaaat

SEQ ID NO: 6022 - DNA, 15 bp, Homo sapiens
agaaacctatgcaaa

SEQ ID NO: 6023 - DNA, 15 bp, Homo sapiens
gagaaacctatgcaa

SEQ ID NO: 6024 - DNA, 15 bp, Homo sapiens
agagaaacctatgca

SEQ ID NO: 6025 - DNA, 15 bp, Homo sapiens
tagagaaacctatgc

SEQ ID NO: 6026 - DNA, 15 bp, Homo sapiens
gtagagaaacctatg

SEQ ID NO: 6027 - DNA, 15 bp, Homo sapiens
ggtagagaaacctat

SEQ ID NO: 6028 - DNA, 15 bp, Homo sapiens
aggtagagaaaccta

SEQ ID NO: 6029 - DNA, 15 bp, Homo sapiens
aaggtagagaaacct

SEQ ID NO: 6030 - DNA, 15 bp, Homo sapiens
gaaggtagagaaacc

SEQ ID NO: 6031 - DNA, 15 bp, Homo sapiens
ggaaggtagagaaac

SEQ ID NO: 6032 - DNA, 15 bp, Homo sapiens
tggaaggtagagaaa

SEQ ID NO: 6033 - DNA, 15 bp, Homo sapiens
gtggaaggtagagaa

SEQ ID NO: 6034 - DNA, 15 bp, Homo sapiens
ggtggaaggtagaga

SEQ ID NO: 6035 - DNA, 15 bp, Homo sapiens
cggtggaaggtagag

SEQ ID NO: 6036 - DNA, 15 bp, Homo sapiens
acggtggaaggtaga

SEQ ID NO: 6037 - DNA, 15 bp, Homo sapiens
gacggtggaaggtag

SEQ ID NO: 6038 - DNA, 15 bp, Homo sapiens
cgacggtggaaggta

SEQ ID NO: 6039 - DNA, 15 bp, Homo sapiens
acgacggtggaaggt

SEQ ID NO: 6040 - DNA, 15 bp, Homo sapiens
aacgacggtggaagg

SEQ ID NO: 6041 - DNA, 15 bp, Homo sapiens
aaacgacggtggaag

SEQ ID NO: 6042 - DNA, 15 bp, Homo sapiens
gaaacgacggtggaa

SEQ ID NO: 6043 - DNA, 15 bp, Homo sapiens
ggaaacgacggtgga

SEQ ID NO: 6044 - DNA, 15 bp, Homo sapiens
gggaaacgacggtgg

SEQ ID NO: 6045 - DNA, 15 bp, Homo sapiens
tgggaaacgacggtg

SEQ ID NO: 6046 - DNA, 15 bp, Homo sapiens
atgggaaacgacggt

SEQ ID NO: 6047 - DNA, 15 bp, Homo sapiens
catgggaaacgacgg

SEQ ID NO: 6048 - DNA, 15 bp, Homo sapiens
acatgggaaacgacg

SEQ ID NO: 6049 - DNA, 15 bp, Homo sapiens
gacatgggaaacgac

SEQ ID NO: 6050 - DNA, 15 bp, Homo sapiens
tgacatgggaaacga

SEQ ID NO: 6051 - DNA, 15 bp, Homo sapiens
ctgacatgggaaacg

SEQ ID NO: 6052 - DNA, 15 bp, Homo sapiens
gctgacatgggaaac

SEQ ID NO: 6053 - DNA, 15 bp, Homo sapiens
agctgacatgggaaa

SEQ ID NO: 6054 - DNA, 15 bp, Homo sapiens
tagctgacatgggaa

SEQ ID NO: 6055 - DNA, 15 bp, Homo sapiens
gtagctgacatggga

SEQ ID NO: 6056 - DNA, 15 bp, Homo sapiens
agtagctgacatggg

SEQ ID NO: 6057 - DNA, 15 bp, Homo sapiens
aagtagctgacatgg

SEQ ID NO: 6058 - DNA, 15 bp, Homo sapiens
taagtagctgacatg

SEQ ID NO: 6059 - DNA, 15 bp, Homo sapiens
ctaagtagctgacat

SEQ ID NO: 6060 - DNA, 15 bp, Homo sapiens
tctaagtagctgaca

SEQ ID NO: 6061 - DNA, 15 bp, Homo sapiens
atctaagtagctgac

SEQ ID NO: 6062 - DNA, 15 bp, Homo sapiens
aatctaagtagctga

SEQ ID NO: 6063 - DNA, 15 bp, Homo sapiens
caatctaagtagctg

SEQ ID NO: 6064 - DNA, 15 bp, Homo sapiens
tcaatctaagtagct

SEQ ID NO: 6065 - DNA, 15 bp, Homo sapiens
gtcaatctaagtagc

SEQ ID NO: 6066 - DNA, 15 bp, Homo sapiens
ggtcaatctaagtag

SEQ ID NO: 6067 - DNA, 15 bp, Homo sapiens
gggtcaatctaagta

SEQ ID NO: 6068 - DNA, 15 bp, Homo sapiens
agggtcaatctaagt

SEQ ID NO: 6069 - DNA, 15 bp, Homo sapiens
tagggtcaatctaag

SEQ ID NO: 6070 - DNA, 15 bp, Homo sapiens
ttagggtcaatctaa

SEQ ID NO: 6071 - DNA, 15 bp, Homo sapiens
tttagggtcaatcta

SEQ ID NO: 6072 - DNA, 15 bp, Homo sapiens
ttttagggtcaatct

SEQ ID NO: 6073 - DNA, 15 bp, Homo sapiens
attttagggtcaatc

SEQ ID NO: 6074 - DNA, 15 bp, Homo sapiens
cattttagggtcaat

SEQ ID NO: 6075 - DNA, 15 bp, Homo sapiens
gcattttagggtcaa

SEQ ID NO: 6076 - DNA, 15 bp, Homo sapiens
agcattttagggtca

SEQ ID NO: 6077 - DNA, 15 bp, Homo sapiens
tagcattttagggtc

SEQ ID NO: 6078 - DNA, 15 bp, Homo sapiens
ttagcattttagggt

SEQ ID NO: 6079 - DNA, 15 bp, Homo sapiens
attagcattttaggg

SEQ ID NO: 6080 - DNA, 15 bp, Homo sapiens
tattagcattttagg

SEQ ID NO: 6081 - DNA, 15 bp, Homo sapiens
ttattagcattttag

SEQ ID NO: 6082 - DNA, 15 bp, Homo sapiens
tttattagcatttta

SEQ ID NO: 6083 - DNA, 15 bp, Homo sapiens
ttttattagcatttt

SEQ ID NO: 6084 - DNA, 15 bp, Homo sapiens
gttttattagcattt

SEQ ID NO: 6085 - DNA, 15 bp, Homo sapiens
agttttattagcatt

SEQ ID NO: 6086 - DNA, 15 bp, Homo sapiens
aagttttattagcat

SEQ ID NO: 6087 - DNA, 15 bp, Homo sapiens
aaagttttattagca

SEQ ID NO: 6088 - DNA, 15 bp, Homo sapiens
gaaagttttattagc

SEQ ID NO: 6089 - DNA, 15 bp, Homo sapiens
agaaagttttattag

SEQ ID NO: 6090 - DNA, 15 bp, Homo sapiens
tagaaagttttatta

SEQ ID NO: 6091 - DNA, 15 bp, Homo sapiens
ctagaaagttttatt

SEQ ID NO: 6092 - DNA, 15 bp, Homo sapiens
tctagaaagttttat

SEQ ID NO: 6093 - DNA, 15 bp, Homo sapiens
gtctagaaagtttta

SEQ ID NO: 6094 - DNA, 15 bp, Homo sapiens
agtctagaaagtttt

SEQ ID NO: 6095 - DNA, 15 bp, Homo sapiens
cagtctagaaagttt

SEQ ID NO: 6096 - DNA, 15 bp, Homo sapiens
acagtctagaaagtt

SEQ ID NO: 6097 - DNA, 15 bp, Homo sapiens
cacagtctagaaagt

SEQ ID NO: 6098 - DNA, 15 bp, Homo sapiens
ccacagtctagaaag

SEQ ID NO: 6099 - DNA, 15 bp, Homo sapiens
accacagtctagaaa

SEQ ID NO: 6100 - DNA, 15 bp, Homo sapiens
taccacagtctagaa

SEQ ID NO: 6101 - DNA, 15 bp, Homo sapiens
gtaccacagtctaga

SEQ ID NO: 6102 - DNA, 15 bp, Homo sapiens
agtaccacagtctag

SEQ ID NO: 6103 - DNA, 15 bp, Homo sapiens
aagtaccacagtcta

SEQ ID NO: 6104 - DNA, 15 bp, Homo sapiens
gaagtaccacagtct

SEQ ID NO: 6105 - DNA, 15 bp, Homo sapiens
agaagtaccacagtc

SEQ ID NO: 6106 - DNA, 15 bp, Homo sapiens
gagaagtaccacagt

SEQ ID NO: 6107 - DNA, 15 bp, Homo sapiens
tgagaagtaccacag

SEQ ID NO: 6108 - DNA, 15 bp, Homo sapiens
ttgagaagtaccaca

SEQ ID NO: 6109 - DNA, 15 bp, Homo sapiens
gttgagaagtaccac

SEQ ID NO: 6110 - DNA, 15 bp, Homo sapiens
ggttgagaagtacca

SEQ ID NO: 6111 - DNA, 15 bp, Homo sapiens
aggttgagaagtacc

SEQ ID NO: 6112 - DNA, 15 bp, Homo sapiens
aaggttgagaagtac

SEQ ID NO: 6113 - DNA, 15 bp, Homo sapiens
aaaggttgagaagta

SEQ ID NO: 6114 - DNA, 15 bp, Homo sapiens
taaaggttgagaagt

SEQ ID NO: 6115 - DNA, 15 bp, Homo sapiens
ctaaaggttgagaag

SEQ ID NO: 6116 - DNA, 15 bp, Homo sapiens
cctaaaggttgagaa

SEQ ID NO: 6117 - DNA, 15 bp, Homo sapiens
acctaaaggttgaga

SEQ ID NO: 6118 - DNA, 15 bp, Homo sapiens
aacctaaaggttgag

SEQ ID NO: 6119 - DNA, 15 bp, Homo sapiens
taacctaaaggttga

SEQ ID NO: 6120 - DNA, 15 bp, Homo sapiens
gtaacctaaaggttg

SEQ ID NO: 6121 - DNA, 15 bp, Homo sapiens
tgtaacctaaaggtt

SEQ ID NO: 6122 - DNA, 15 bp, Homo sapiens
atgtaacctaaaggt

SEQ ID NO: 6123 - DNA, 15 bp, Homo sapiens
aatgtaacctaaagg

SEQ ID NO: 6124 - DNA, 15 bp, Homo sapiens
aaatgtaacctaaag

SEQ ID NO: 6125 - DNA, 15 bp, Homo sapiens
caaatgtaacctaaa

SEQ ID NO: 6126 - DNA, 15 bp, Homo sapiens
tcaaatgtaacctaa

SEQ ID NO: 6127 - DNA, 15 bp, Homo sapiens
gtcaaatgtaaccta

SEQ ID NO: 6128 - DNA, 15 bp, Homo sapiens
ggtcaaatgtaacct

SEQ ID NO: 6129 - DNA, 15 bp, Homo sapiens
tggtcaaatgtaacc

SEQ ID NO: 6130 - DNA, 15 bp, Homo sapiens
atggtcaaatgtaac

SEQ ID NO: 6131 - DNA, 15 bp, Homo sapiens
aatggtcaaatgtaa

SEQ ID NO: 6132 - DNA, 15 bp, Homo sapiens
aaatggtcaaatgta

SEQ ID NO: 6133 - DNA, 15 bp, Homo sapiens
caaatggtcaaatgt

SEQ ID NO: 6134 - DNA, 15 bp, Homo sapiens
gcaaatggtcaaatg

SEQ ID NO: 6135 - DNA, 15 bp, Homo sapiens
tgcaaatggtcaaat

SEQ ID NO: 6136 - DNA, 15 bp, Homo sapiens
atgcaaatggtcaaa

SEQ ID NO: 6137 - DNA, 15 bp, Homo sapiens
catgcaaatggtcaa

SEQ ID NO: 6138 - DNA, 15 bp, Homo sapiens
acatgcaaatggtca

SEQ ID NO: 6139 - DNA, 15 bp, Homo sapiens
cacatgcaaatggtc

SEQ ID NO: 6140 - DNA, 15 bp, Homo sapiens
acacatgcaaatggt

SEQ ID NO: 6141 - DNA, 15 bp, Homo sapiens
cacacatgcaaatgg

SEQ ID NO: 6142 - DNA, 15 bp, Homo sapiens
acacacatgcaaatg

SEQ ID NO: 6143 - DNA, 15 bp, Homo sapiens
cacacacatgcaaat

SEQ ID NO: 6144 - DNA, 15 bp, Homo sapiens
acacacacatgcaaa

SEQ ID NO: 6145 - DNA, 15 bp, Homo sapiens
gacacacacatgcaa

SEQ ID NO: 6146 - DNA, 15 bp, Homo sapiens
agacacacacatgca

SEQ ID NO: 6147 - DNA, 15 bp, Homo sapiens
gagacacacacatgc

SEQ ID NO: 6148 - DNA, 15 bp, Homo sapiens
agagacacacacatg

SEQ ID NO: 6149 - DNA, 15 bp, Homo sapiens
aagagacacacacat

SEQ ID NO: 6150 - DNA, 15 bp, Homo sapiens
aaagagacacacaca

SEQ ID NO: 6151 - DNA, 15 bp, Homo sapiens
aaaagagacacacac

SEQ ID NO: 6152 - DNA, 15 bp, Homo sapiens
gaaaagagacacaca

SEQ ID NO: 6153 - DNA, 15 bp, Homo sapiens
agaaaagagacacac

SEQ ID NO: 6154 - DNA, 15 bp, Homo sapiens
aagaaaagagacaca

SEQ ID NO: 6155 - DNA, 15 bp, Homo sapiens
gaagaaaagagacac

SEQ ID NO: 6156 - DNA, 15 bp, Homo sapiens
ggaagaaaagagaca

SEQ ID NO: 6157 - DNA, 15 bp, Homo sapiens
aggaagaaaagagac

SEQ ID NO: 6158 - DNA, 15 bp, Homo sapiens
taggaagaaaagaga

SEQ ID NO: 6159 - DNA, 15 bp, Homo sapiens
gtaggaagaaaagag

SEQ ID NO: 6160 - DNA, 15 bp, Homo sapiens
agtaggaagaaaaga

SEQ ID NO: 6161 - DNA, 15 bp, Homo sapiens
tagtaggaagaaaag

SEQ ID NO: 6162 - DNA, 15 bp, Homo sapiens
ctagtaggaagaaaa

SEQ ID NO: 6163 - DNA, 15 bp, Homo sapiens
tctagtaggaagaaa

SEQ ID NO: 6164 - DNA, 15 bp, Homo sapiens
gtctagtaggaagaa

SEQ ID NO: 6165 - DNA, 15 bp, Homo sapiens
ggtctagtaggaaga

SEQ ID NO: 6166 - DNA, 15 bp, Homo sapiens
gggtctagtaggaag

SEQ ID NO: 6167 - DNA, 15 bp, Homo sapiens
ggggtctagtaggaa

SEQ ID NO: 6168 - DNA, 15 bp, Homo sapiens
gggggtctagtagga

SEQ ID NO: 6169 - DNA, 15 bp, Homo sapiens
agggggtctagtagg

SEQ ID NO: 6170 - DNA, 15 bp, Homo sapiens
aagggggtctagtag

SEQ ID NO: 6171 - DNA, 15 bp, Homo sapiens
caagggggtctagta

SEQ ID NO: 6172 - DNA, 15 bp, Homo sapiens
tcaagggggtctagt

SEQ ID NO: 6173 - DNA, 15 bp, Homo sapiens
ctcaagggggtctag

SEQ ID NO: 6174 - DNA, 15 bp, Homo sapiens
actcaagggggtcta

SEQ ID NO: 6175 - DNA, 15 bp, Homo sapiens
aactcaagggggtct

SEQ ID NO: 6176 - DNA, 15 bp, Homo sapiens
taactcaagggggtc

SEQ ID NO: 6177 - DNA, 15 bp, Homo sapiens
ctaactcaagggggt

SEQ ID NO: 6178 - DNA, 15 bp, Homo sapiens
actaactcaaggggg

SEQ ID NO: 6179 - DNA, 15 bp, Homo sapiens
cactaactcaagggg

SEQ ID NO: 6180 - DNA, 15 bp, Homo sapiens
gcactaactcaaggg

SEQ ID NO: 6181 - DNA, 15 bp, Homo sapiens
agcactaactcaagg

SEQ ID NO: 6182 - DNA, 15 bp, Homo sapiens
aagcactaactcaag

SEQ ID NO: 6183 - DNA, 15 bp, Homo sapiens
aaagcactaactcaa

SEQ ID NO: 6184 - DNA, 15 bp, Homo sapiens
aaaagcactaactca

SEQ ID NO: 6185 - DNA, 15 bp, Homo sapiens
aaaaagcactaactc

SEQ ID NO: 6186 - DNA, 15 bp, Homo sapiens
aaaaaagcactaact

SEQ ID NO: 6187 - DNA, 15 bp, Homo sapiens
aaaaaaagcactaac

SEQ ID NO: 6188 - DNA, 15 bp, Homo sapiens
aaaaaaaagcactaa

SEQ ID NO: 6189 - DNA, 15 bp, Homo sapiens
aaaaaaaaagcacta

SEQ ID NO: 6190 - DNA, 15 bp, Homo sapiens
aaaaaaaaaagcact

SEQ ID NO: 6191 - DNA, 15 bp, Homo sapiens
aaaaaaaaaaagcac

SEQ ID NO: 6192 - DNA, 15 bp, Homo sapiens
aaaaaaaaaaaagca

SEQ ID NO: 6193 - DNA, 15 bp, Homo sapiens
taaaaaaaaaaaaaa

SEQ ID NO: 6194 - DNA, 15 bp, Homo sapiens
ttaaaaaaaaaaaaa

SEQ ID NO: 6195 - DNA, 15 bp, Homo sapiens
tttaaaaaaaaaaaa

SEQ ID NO: 6196 - DNA, 15 bp, Homo sapiens
atttaaaaaaaaaaa

SEQ ID NO: 6197 - DNA, 15 bp, Homo sapiens
catttaaaaaaaaaa

SEQ ID NO: 6198 - DNA, 15 bp, Homo sapiens
acatttaaaaaaaaa

SEQ ID NO: 6199 - DNA, 15 bp, Homo sapiens
tacatttaaaaaaaa

SEQ ID NO: 6200 - DNA, 15 bp, Homo sapiens
ctacatttaaaaaaa

SEQ ID NO: 6201 - DNA, 15 bp, Homo sapiens
tctacatttaaaaaa

SEQ ID NO: 6202 - DNA, 15 bp, Homo sapiens
atctacatttaaaaa

SEQ ID NO: 6203 - DNA, 15 bp, Homo sapiens
catctacatttaaaa

SEQ ID NO: 6204 - DNA, 15 bp, Homo sapiens
ccatctacatttaaa

SEQ ID NO: 6205 - DNA, 15 bp, Homo sapiens
tccatctacatttaa

SEQ ID NO: 6206 - DNA, 15 bp, Homo sapiens
ctccatctacattta

SEQ ID NO: 6207 - DNA, 15 bp, Homo sapiens
actccatctacattt

SEQ ID NO: 6208 - DNA, 15 bp, Homo sapiens
gactccatctacatt

SEQ ID NO: 6209 - DNA, 15 bp, Homo sapiens
agactccatctacat

SEQ ID NO: 6210 - DNA, 15 bp, Homo sapiens
gagactccatctaca

SEQ ID NO: 6211 - DNA, 15 bp, Homo sapiens
tgagactccatctac

SEQ ID NO: 6212 - DNA, 15 bp, Homo sapiens
gtgagactccatcta

SEQ ID NO: 6213 - DNA, 15 bp, Homo sapiens
agtgagactccatct

SEQ ID NO: 6214 - DNA, 15 bp, Homo sapiens
gagtgagactccatc

SEQ ID NO: 6215 - DNA, 15 bp, Homo sapiens
agagtgagactccat

SEQ ID NO: 6216 - DNA, 15 bp, Homo sapiens
aagagtgagactcca

SEQ ID NO: 6217 - DNA, 15 bp, Homo sapiens
caagagtgagactcc

SEQ ID NO: 6218 - DNA, 15 bp, Homo sapiens
acaagagtgagactc

SEQ ID NO: 6219 - DNA, 15 bp, Homo sapiens
aacaagagtgagact

SEQ ID NO: 6220 - DNA, 15 bp, Homo sapiens
caacaagagtgagac

SEQ ID NO: 6221 - DNA, 15 bp, Homo sapiens
gcaacaagagtgaga

SEQ ID NO: 6222 - DNA, 15 bp, Homo sapiens
ggcaacaagagtgag

SEQ ID NO: 6223 - DNA, 15 bp, Homo sapiens
gggcaacaagagtga

SEQ ID NO: 6224 - DNA, 15 bp, Homo sapiens
cgggcaacaagagtg

SEQ ID NO: 6225 - DNA, 15 bp, Homo sapiens
ccgggcaacaagagt

SEQ ID NO: 6226 - DNA, 15 bp, Homo sapiens
cccgggcaacaagag

SEQ ID NO: 6227 - DNA, 15 bp, Homo sapiens
gcccgggcaacaaga

SEQ ID NO: 6228 - DNA, 15 bp, Homo sapiens
agcccgggcaacaag

SEQ ID NO: 6229 - DNA, 15 bp, Homo sapiens
cagcccgggcaacaa

SEQ ID NO: 6230 - DNA, 15 bp, Homo sapiens
ccagcccgggcaaca

SEQ ID NO: 6231 - DNA, 15 bp, Homo sapiens
tccagcccgggcaac

SEQ ID NO: 6232 - DNA, 15 bp, Homo sapiens
ctccagcccgggcaa

SEQ ID NO: 6233 - DNA, 15 bp, Homo sapiens
gctccagcccgggca

SEQ ID NO: 6234 - DNA, 15 bp, Homo sapiens
cgctccagcccgggc

SEQ ID NO: 6235 - DNA, 15 bp, Homo sapiens
gcgctccagcccggg

SEQ ID NO: 6236 - DNA, 15 bp, Homo sapiens
tgcgctccagcccgg

SEQ ID NO: 6237 - DNA, 15 bp, Homo sapiens
ctgcgctccagcccg

SEQ ID NO: 6238 - DNA, 15 bp, Homo sapiens
actgcgctccagccc

SEQ ID NO: 6239 - DNA, 15 bp, Homo sapiens
cactgcgctccagcc

SEQ ID NO: 6240 - DNA, 15 bp, Homo sapiens
ccactgcgctccagc

SEQ ID NO: 6241 - DNA, 15 bp, Homo sapiens
accactgcgctccag

SEQ ID NO: 6242 - DNA, 15 bp, Homo sapiens
caccactgcgctcca

SEQ ID NO: 6243 - DNA, 15 bp, Homo sapiens
gcaccactgcgctcc

SEQ ID NO: 6244 - DNA, 15 bp, Homo sapiens
tgcaccactgcgctc

SEQ ID NO: 6245 - DNA, 15 bp, Homo sapiens
ttgcaccactgcgct

SEQ ID NO: 6246 - DNA, 15 bp, Homo sapiens
attgcaccactgcgc

SEQ ID NO: 6247 - DNA, 15 bp, Homo sapiens
gattgcaccactgcg

SEQ ID NO: 6248 - DNA, 15 bp, Homo sapiens
agattgcaccactgc

SEQ ID NO: 6249 - DNA, 15 bp, Homo sapiens
gagattgcaccactg

SEQ ID NO: 6250 - DNA, 15 bp, Homo sapiens
cgagattgcaccact

SEQ ID NO: 6251 - DNA, 15 bp, Homo sapiens
ccgagattgcaccac

SEQ ID NO: 6252 - DNA, 15 bp, Homo sapiens
gccgagattgcacca

SEQ ID NO: 6253 - DNA, 15 bp, Homo sapiens
agccgagattgcacc

SEQ ID NO: 6254 - DNA, 15 bp, Homo sapiens
gagccgagattgcac

SEQ ID NO: 6255 - DNA, 15 bp, Homo sapiens
tgagccgagattgca

SEQ ID NO: 6256 - DNA, 15 bp, Homo sapiens
gtgagccgagattgc

SEQ ID NO: 6257 - DNA, 15 bp, Homo sapiens
acttgaacccaggag

SEQ ID NO: 6258 - DNA, 15 bp, Homo sapiens
cacttgaacccagga

SEQ ID NO: 6259 - DNA, 15 bp, Homo sapiens
tcacttgaacccagg

SEQ ID NO: 6260 - DNA, 15 bp, Homo sapiens
atcacttgaacccag

SEQ ID NO: 6261 - DNA, 15 bp, Homo sapiens
aatcacttgaaccca

SEQ ID NO: 6262 - DNA, 15 bp, Homo sapiens
gaatcacttgaaccc

SEQ ID NO: 6263 - DNA, 15 bp, Homo sapiens
agaatcacttgaacc

SEQ ID NO: 6264 - DNA, 15 bp, Homo sapiens
gagaatcacttgaac

SEQ ID NO: 6265 - DNA, 15 bp, Homo sapiens
ggagaatcacttgaa

SEQ ID NO: 6266 - DNA, 15 bp, Homo sapiens
aggagaatcacttga

SEQ ID NO: 6267 - DNA, 15 bp, Homo sapiens
caggagaatcacttg

SEQ ID NO: 6268 - DNA, 15 bp, Homo sapiens
gcaggagaatcactt

SEQ ID NO: 6269 - DNA, 15 bp, Homo sapiens
ggcaggagaatcact

SEQ ID NO: 6270 - DNA, 15 bp, Homo sapiens
aggcaggagaatcac

SEQ ID NO: 6271 - DNA, 15 bp, Homo sapiens
gaggcaggagaatca

SEQ ID NO: 6272 - DNA, 15 bp, Homo sapiens
tgaggcaggagaatc

SEQ ID NO: 6273 - DNA, 15 bp, Homo sapiens
ctgaggcaggagaat

SEQ ID NO: 6274 - DNA, 15 bp, Homo sapiens
gctgaggcaggagaa

SEQ ID NO: 6275 - DNA, 15 bp, Homo sapiens
ggctgaggcaggaga

SEQ ID NO: 6276 - DNA, 15 bp, Homo sapiens
aggaggctgaggcag

SEQ ID NO: 6277 - DNA, 15 bp, Homo sapiens
caggaggctgaggca

SEQ ID NO: 6278 - DNA, 15 bp, Homo sapiens
tcaggaggctgaggc

SEQ ID NO: 6279 - DNA, 15 bp, Homo sapiens
ctcaggaggctgagg

SEQ ID NO: 6280 - DNA, 15 bp, Homo sapiens
actcaggaggctgag

SEQ ID NO: 6281 - DNA, 15 bp, Homo sapiens
tactcaggaggctga

SEQ ID NO: 6282 - DNA, 15 bp, Homo sapiens
ctactcaggaggctg

SEQ ID NO: 6283 - DNA, 15 bp, Homo sapiens
atcccagctactcag

SEQ ID NO: 6284 - DNA, 15 bp, Homo sapiens
tctgtaatcccagct

SEQ ID NO: 6285 - DNA, 15 bp, Homo sapiens
atctgtaatcccagc

SEQ ID NO: 6286 - DNA, 15 bp, Homo sapiens
catctgtaatcccag

SEQ ID NO: 6287 - DNA, 15 bp, Homo sapiens
acatctgtaatccca

SEQ ID NO: 6288 - DNA, 15 bp, Homo sapiens
gacatctgtaatccc

SEQ ID NO: 6289 - DNA, 15 bp, Homo sapiens
ggacatctgtaatcc

SEQ ID NO: 6290 - DNA, 15 bp, Homo sapiens
tggacatctgtaatc

SEQ ID NO: 6291 - DNA, 15 bp, Homo sapiens
gtggacatctgtaat

SEQ ID NO: 6292 - DNA, 15 bp, Homo sapiens
ggtggacatctgtaa

SEQ ID NO: 6293 - DNA, 15 bp, Homo sapiens
tggtggacatctgta

SEQ ID NO: 6294 - DNA, 15 bp, Homo sapiens
gtggtggacatctgt

SEQ ID NO: 6295 - DNA, 15 bp, Homo sapiens
ggtggtggacatctg

SEQ ID NO: 6296 - DNA, 15 bp, Homo sapiens
tggtggtggacatct

SEQ ID NO: 6297 - DNA, 15 bp, Homo sapiens
gtggtggtggacatc

SEQ ID NO: 6298 - DNA, 15 bp, Homo sapiens
cgtggtggtggacat

SEQ ID NO: 6299 - DNA, 15 bp, Homo sapiens
gcgtggtggtggaca

SEQ ID NO: 6300 - DNA, 15 bp, Homo sapiens
ggcgtggtggtggac

SEQ ID NO: 6301 - DNA, 15 bp, Homo sapiens
gggcgtggtggtgga

SEQ ID NO: 6302 - DNA, 15 bp, Homo sapiens
cgggcgtggtggtgg

SEQ ID NO: 6303 - DNA, 15 bp, Homo sapiens
ccgggcgtggtggtg

SEQ ID NO: 6304 - DNA, 15 bp, Homo sapiens
gccgggcgtggtggt

SEQ ID NO: 6305 - DNA, 15 bp, Homo sapiens
agccgggcgtggtgg

SEQ ID NO: 6306 - DNA, 15 bp, Homo sapiens
tagccgggcgtggtg

SEQ ID NO: 6307 - DNA, 15 bp, Homo sapiens
ttagccgggcgtggt

SEQ ID NO: 6308 - DNA, 15 bp, Homo sapiens
attagccgggcgtgg

SEQ ID NO: 6309 - DNA, 15 bp, Homo sapiens
aattagccgggcgtg

SEQ ID NO: 6310 - DNA, 15 bp, Homo sapiens
aaattagccgggcgt

SEQ ID NO: 6311 - DNA, 15 bp, Homo sapiens
aaaattagccgggcg

SEQ ID NO: 6312 - DNA, 15 bp, Homo sapiens
aaaaattagccgggc

SEQ ID NO: 6313 - DNA, 15 bp, Homo sapiens
caaaaattagccggg

SEQ ID NO: 6314 - DNA, 15 bp, Homo sapiens
acaaaaattagccgg

SEQ ID NO: 6315 - DNA, 15 bp, Homo sapiens
tacaaaaattagccg

SEQ ID NO: 6316 - DNA, 15 bp, Homo sapiens
taaaccccatctcta

SEQ ID NO: 6317 - DNA, 15 bp, Homo sapiens
gtaaaccccatctct

SEQ ID NO: 6318 - DNA, 15 bp, Homo sapiens
ggtaaaccccatctc

SEQ ID NO: 6319 - DNA, 15 bp, Homo sapiens
aggtaaaccccatct

SEQ ID NO: 6320 - DNA, 15 bp, Homo sapiens
aaggtaaaccccatc

SEQ ID NO: 6321 - DNA, 15 bp, Homo sapiens
aaaggtaaaccccat

SEQ ID NO: 6322 - DNA, 15 bp, Homo sapiens
caaaggtaaacccca

SEQ ID NO: 6323 - DNA, 15 bp, Homo sapiens
acaaaggtaaacccc

SEQ ID NO: 6324 - DNA, 15 bp, Homo sapiens
aacaaaggtaaaccc

SEQ ID NO: 6325 - DNA, 15 bp, Homo sapiens
caacaaaggtaaacc

SEQ ID NO: 6326 - DNA, 15 bp, Homo sapiens
ccaacaaaggtaaac

SEQ ID NO: 6327 - DNA, 15 bp, Homo sapiens
gccaacaaaggtaaa

SEQ ID NO: 6328 - DNA, 15 bp, Homo sapiens
ggccaacaaaggtaa

SEQ ID NO: 6329 - DNA, 15 bp, Homo sapiens
tggccaacaaaggta

SEQ ID NO: 6330 - DNA, 15 bp, Homo sapiens
ctggccaacaaaggt

SEQ ID NO: 6331 - DNA, 15 bp, Homo sapiens
cctggccaacaaagg

SEQ ID NO: 6332 - DNA, 15 bp, Homo sapiens
gcctggccaacaaag

SEQ ID NO: 6333 - DNA, 15 bp, Homo sapiens
agcctggccaacaaa

SEQ ID NO: 6334 - DNA, 15 bp, Homo sapiens
cagcctggccaacaa

SEQ ID NO: 6335 - DNA, 15 bp, Homo sapiens
gaggtcaggagttcg

SEQ ID NO: 6336 - DNA, 15 bp, Homo sapiens
aacctgaggtcagga

SEQ ID NO: 6337 - DNA, 15 bp, Homo sapiens
taacctgaggtcagg

SEQ ID NO: 6338 - DNA, 15 bp, Homo sapiens
ataacctgaggtcag

SEQ ID NO: 6339 - DNA, 15 bp, Homo sapiens
gataacctgaggtca

SEQ ID NO: 6340 - DNA, 15 bp, Homo sapiens
tgataacctgaggtc

SEQ ID NO: 6341 - DNA, 15 bp, Homo sapiens
gtgataacctgaggt

SEQ ID NO: 6342 - DNA, 15 bp, Homo sapiens
ggtgataacctgagg

SEQ ID NO: 6343 - DNA, 15 bp, Homo sapiens
aggtgataacctgag

SEQ ID NO: 6344 - DNA, 15 bp, Homo sapiens
caggtgataacctga

SEQ ID NO: 6345 - DNA, 15 bp, Homo sapiens
gcaggtgataacctg

SEQ ID NO: 6346 - DNA, 15 bp, Homo sapiens
ggcaggtgataacct

SEQ ID NO: 6347 - DNA, 15 bp, Homo sapiens
aggcaggtgataacc

SEQ ID NO: 6348 - DNA, 15 bp, Homo sapiens
gaggcaggtgataac

SEQ ID NO: 6349 - DNA, 15 bp, Homo sapiens
tgaggcaggtgataa

SEQ ID NO: 6350 - DNA, 15 bp, Homo sapiens
ctgaggcaggtgata

SEQ ID NO: 6351 - DNA, 15 bp, Homo sapiens
gctgaggcaggtgat

SEQ ID NO: 6352 - DNA, 15 bp, Homo sapiens
ggctgaggcaggtga

SEQ ID NO: 6353 - DNA, 15 bp, Homo sapiens
aggctgaggcaggtg

SEQ ID NO: 6354 - DNA, 15 bp, Homo sapiens
gaggctgaggcaggt

SEQ ID NO: 6355 - DNA, 15 bp, Homo sapiens
catgcctgtaatccc

SEQ ID NO: 6356 - DNA, 15 bp, Homo sapiens
tcatgcctgtaatcc

SEQ ID NO: 6357 - DNA, 15 bp, Homo sapiens
ttcatgcctgtaatc

SEQ ID NO: 6358 - DNA, 15 bp, Homo sapiens
gttcatgcctgtaat

SEQ ID NO: 6359 - DNA, 15 bp, Homo sapiens
ggttcatgcctgtaa

SEQ ID NO: 6360 - DNA, 15 bp, Homo sapiens
tggttcatgcctgta

SEQ ID NO: 6361 - DNA, 15 bp, Homo sapiens
gtggttcatgcctgt

SEQ ID NO: 6362 - DNA, 15 bp, Homo sapiens
agtggttcatgcctg

SEQ ID NO: 6363 - DNA, 15 bp, Homo sapiens
cagtggttcatgcct

SEQ ID NO: 6364 - DNA, 15 bp, Homo sapiens
gcagtggttcatgcc

SEQ ID NO: 6365 - DNA, 15 bp, Homo sapiens
cgcagtggttcatgc

SEQ ID NO: 6366 - DNA, 15 bp, Homo sapiens
gcgcagtggttcatg

SEQ ID NO: 6367 - DNA, 15 bp, Homo sapiens
ggcgcagtggttcat

SEQ ID NO: 6368 - DNA, 15 bp, Homo sapiens
aggcgcagtggttca

SEQ ID NO: 6369 - DNA, 15 bp, Homo sapiens
caggcgcagtggttc

SEQ ID NO: 6370 - DNA, 15 bp, Homo sapiens
ccaggcgcagtggtt

SEQ ID NO: 6371 - DNA, 15 bp, Homo sapiens
gccaggcgcagtggt

SEQ ID NO: 6372 - DNA, 15 bp, Homo sapiens
ggccaggcgcagtgg

SEQ ID NO: 6373 - DNA, 15 bp, Homo sapiens
aggccaggcgcagtg

SEQ ID NO: 6374 - DNA, 15 bp, Homo sapiens
taggccaggcgcagt

SEQ ID NO: 6375 - DNA, 15 bp, Homo sapiens
ttaggccaggcgcag

SEQ ID NO: 6376 - DNA, 15 bp, Homo sapiens
cttaggccaggcgca

SEQ ID NO: 6377 - DNA, 15 bp, Homo sapiens
acttaggccaggcgc

SEQ ID NO: 6378 - DNA, 15 bp, Homo sapiens
aacttaggccaggcg

SEQ ID NO: 6379 - DNA, 15 bp, Homo sapiens
taacttaggccaggc

SEQ ID NO: 6380 - DNA, 15 bp, Homo sapiens
ctaacttaggccagg

SEQ ID NO: 6381 - DNA, 15 bp, Homo sapiens
actaacttaggccag

SEQ ID NO: 6382 - DNA, 15 bp, Homo sapiens
cactaacttaggcca

SEQ ID NO: 6383 - DNA, 15 bp, Homo sapiens
gcactaacttaggcc

SEQ ID NO: 6384 - DNA, 15 bp, Homo sapiens
agcactaacttaggc

SEQ ID NO: 6385 - DNA, 15 bp, Homo sapiens
aagcactaacttagg

SEQ ID NO: 6386 - DNA, 15 bp, Homo sapiens
aaagcactaacttag

SEQ ID NO: 6387 - DNA, 15 bp, Homo sapiens
aaaagcactaactta

SEQ ID NO: 6388 - DNA, 15 bp, Homo sapiens
caaaagcactaactt

SEQ ID NO: 6389 - DNA, 15 bp, Homo sapiens
tcaaaagcactaact

SEQ ID NO: 6390 - DNA, 15 bp, Homo sapiens
atcaaaagcactaac

SEQ ID NO: 6391 - DNA, 15 bp, Homo sapiens
catcaaaagcactaa

SEQ ID NO: 6392 - DNA, 15 bp, Homo sapiens
acatcaaaagcacta

SEQ ID NO: 6393 - DNA, 15 bp, Homo sapiens
gacatcaaaagcact

SEQ ID NO: 6394 - DNA, 15 bp, Homo sapiens
tgacatcaaaagcac

SEQ ID NO: 6395 - DNA, 15 bp, Homo sapiens
gtgacatcaaaagca

SEQ ID NO: 6396 - DNA, 15 bp, Homo sapiens
tgtgacatcaaaagc

SEQ ID NO: 6397 - DNA, 15 bp, Homo sapiens
ttgtgacatcaaaag

SEQ ID NO: 6398 - DNA, 15 bp, Homo sapiens
tttgtgacatcaaaa

SEQ ID NO: 6399 - DNA, 15 bp, Homo sapiens
ttttgtgacatcaaa

SEQ ID NO: 6400 - DNA, 15 bp, Homo sapiens
tttttgtgacatcaa

SEQ ID NO: 6401 - DNA, 15 bp, Homo sapiens
gtttttgtgacatca

SEQ ID NO: 6402 - DNA, 15 bp, Homo sapiens
agtttttgtgacatc

SEQ ID NO: 6403 - DNA, 15 bp, Homo sapiens
aagtttttgtgacat

SEQ ID NO: 6404 - DNA, 15 bp, Homo sapiens
caagtttttgtgaca

SEQ ID NO: 6405 - DNA, 15 bp, Homo sapiens
ccaagtttttgtgac

SEQ ID NO: 6406 - DNA, 15 bp, Homo sapiens
cccaagtttttgtga

SEQ ID NO: 6407 - DNA, 15 bp, Homo sapiens
acccaagtttttgtg

SEQ ID NO: 6408 - DNA, 15 bp, Homo sapiens
cacccaagtttttgt

SEQ ID NO: 6409 - DNA, 15 bp, Homo sapiens
tcacccaagtttttg

SEQ ID NO: 6410 - DNA, 15 bp, Homo sapiens
ctcacccaagttttt

SEQ ID NO: 6411 - DNA, 15 bp, Homo sapiens
actcacccaagtttt

SEQ ID NO: 6412 - DNA, 15 bp, Homo sapiens
aactcacccaagttt

SEQ ID NO: 6413 - DNA, 15 bp, Homo sapiens
aaactcacccaagtt

SEQ ID NO: 6414 - DNA, 15 bp, Homo sapiens
caaactcacccaagt

SEQ ID NO: 6415 - DNA, 15 bp, Homo sapiens
acaaactcacccaag

SEQ ID NO: 6416 - DNA, 15 bp, Homo sapiens
aacaaactcacccaa

SEQ ID NO: 6417 - DNA, 15 bp, Homo sapiens
aaacaaactcaccca

SEQ ID NO: 6418 - DNA, 15 bp, Homo sapiens
gaaacaaactcaccc

SEQ ID NO: 6419 - DNA, 15 bp, Homo sapiens
tgaaacaaactcacc

SEQ ID NO: 6420 - DNA, 15 bp, Homo sapiens
ctgaaacaaactcac

SEQ ID NO: 6421 - DNA, 15 bp, Homo sapiens
actgaaacaaactca

SEQ ID NO: 6422 - DNA, 15 bp, Homo sapiens
tactgaaacaaactc

SEQ ID NO: 6423 - DNA, 15 bp, Homo sapiens
ctactgaaacaaact

SEQ ID NO: 6424 - DNA, 15 bp, Homo sapiens
tctactgaaacaaac

SEQ ID NO: 6425 - DNA, 15 bp, Homo sapiens
ttctactgaaacaaa

SEQ ID NO: 6426 - DNA, 15 bp, Homo sapiens
attctactgaaacaa

SEQ ID NO: 6427 - DNA, 15 bp, Homo sapiens
aattctactgaaaca

SEQ ID NO: 6428 - DNA, 15 bp, Homo sapiens
aaattctactgaaac

SEQ ID NO: 6429 - DNA, 15 bp, Homo sapiens
aaaattctactgaaa

SEQ ID NO: 6430 - DNA, 15 bp, Homo sapiens
gaaaattctactgaa

SEQ ID NO: 6431 - DNA, 15 bp, Homo sapiens
agaaaattctactga

SEQ ID NO: 6432 - DNA, 15 bp, Homo sapiens
cagaaaattctactg

SEQ ID NO: 6433 - DNA, 15 bp, Homo sapiens
tcagaaaattctact

SEQ ID NO: 6434 - DNA, 15 bp, Homo sapiens
ttcagaaaattctac

SEQ ID NO: 6435 - DNA, 15 bp, Homo sapiens
tttcagaaaattcta

SEQ ID NO: 6436 - DNA, 15 bp, Homo sapiens
ttttcagaaaattct

SEQ ID NO: 6437 - DNA, 15 bp, Homo sapiens
attttcagaaaattc

SEQ ID NO: 6438 - DNA, 15 bp, Homo sapiens
tattttcagaaaatt

SEQ ID NO: 6439 - DNA, 15 bp, Homo sapiens
gtattttcagaaaat

SEQ ID NO: 6440 - DNA, 15 bp, Homo sapiens
tgtattttcagaaaa

SEQ ID NO: 6441 - DNA, 15 bp, Homo sapiens
atgtattttcagaaa

SEQ ID NO: 6442 - DNA, 15 bp, Homo sapiens
catgtattttcagaa

SEQ ID NO: 6443 - DNA, 15 bp, Homo sapiens
tcatgtattttcaga

SEQ ID NO: 6444 - DNA, 15 bp, Homo sapiens
ctcatgtattttcag

SEQ ID NO: 6445 - DNA, 15 bp, Homo sapiens
tctcatgtattttca

SEQ ID NO: 6446 - DNA, 15 bp, Homo sapiens
atctcatgtattttc

SEQ ID NO: 6447 - DNA, 15 bp, Homo sapiens
gatctcatgtatttt

SEQ ID NO: 6448 - DNA, 15 bp, Homo sapiens
agatctcatgtattt

SEQ ID NO: 6449 - DNA, 15 bp, Homo sapiens
aagatctcatgtatt

SEQ ID NO: 6450 - DNA, 15 bp, Homo sapiens
aaagatctcatgtat

SEQ ID NO: 6451 - DNA, 15 bp, Homo sapiens
aaaagatctcatgta

SEQ ID NO: 6452 - DNA, 15 bp, Homo sapiens
aaaaagatctcatgt

SEQ ID NO: 6453 - DNA, 15 bp, Homo sapiens
taaaaagatctcatg

SEQ ID NO: 6454 - DNA, 15 bp, Homo sapiens
gtaaaaagatctcat

SEQ ID NO: 6455 - DNA, 15 bp, Homo sapiens
agtaaaaagatctca

SEQ ID NO: 6456 - DNA, 15 bp, Homo sapiens
cagtaaaaagatctc

SEQ ID NO: 6457 - DNA, 15 bp, Homo sapiens
acagtaaaaagatct

SEQ ID NO: 6458 - DNA, 15 bp, Homo sapiens
tacagtaaaaagatc

SEQ ID NO: 6459 - DNA, 15 bp, Homo sapiens
ctacagtaaaaagat

SEQ ID NO: 6460 - DNA, 15 bp, Homo sapiens
actacagtaaaaaga

SEQ ID NO: 6461 - DNA, 15 bp, Homo sapiens
aactacagtaaaaag

SEQ ID NO: 6462 - DNA, 15 bp, Homo sapiens
aaactacagtaaaaa

SEQ ID NO: 6463 - DNA, 15 bp, Homo sapiens
gaaactacagtaaaa

SEQ ID NO: 6464 - DNA, 15 bp, Homo sapiens
agaaactacagtaaa

SEQ ID NO: 6465 - DNA, 15 bp, Homo sapiens
gagaaactacagtaa

SEQ ID NO: 6466 - DNA, 15 bp, Homo sapiens
tgagaaactacagta

SEQ ID NO: 6467 - DNA, 15 bp, Homo sapiens
ctgagaaactacagt

SEQ ID NO: 6468 - DNA, 15 bp, Homo sapiens
tctgagaaactacag

SEQ ID NO: 6469 - DNA, 15 bp, Homo sapiens
ttctgagaaactaca

SEQ ID NO: 6470 - DNA, 15 bp, Homo sapiens
cttctgagaaactac

SEQ ID NO: 6471 - DNA, 15 bp, Homo sapiens
tcttctgagaaacta

SEQ ID NO: 6472 - DNA, 15 bp, Homo sapiens
ctcttctgagaaact

SEQ ID NO: 6473 - DNA, 15 bp, Homo sapiens
tctcttctgagaaac

SEQ ID NO: 6474 - DNA, 15 bp, Homo sapiens
ttctcttctgagaaa

SEQ ID NO: 6475 - DNA, 15 bp, Homo sapiens
attctcttctgagaa

SEQ ID NO: 6476 - DNA, 15 bp, Homo sapiens
tattctcttctgaga

SEQ ID NO: 6477 - DNA, 15 bp, Homo sapiens
gtattctcttctgag

SEQ ID NO: 6478 - DNA, 15 bp, Homo sapiens
agtattctcttctga

SEQ ID NO: 6479 - DNA, 15 bp, Homo sapiens
gagtattctcttctg

SEQ ID NO: 6480 - DNA, 15 bp, Homo sapiens
tgagtattctcttct

SEQ ID NO: 6481 - DNA, 15 bp, Homo sapiens
ttgagtattctcttc

SEQ ID NO: 6482 - DNA, 15 bp, Homo sapiens
tttgagtattctctt

SEQ ID NO: 6483 - DNA, 15 bp, Homo sapiens
ctttgagtattctct

SEQ ID NO: 6484 - DNA, 15 bp, Homo sapiens
gctttgagtattctc

SEQ ID NO: 6485 - DNA, 15 bp, Homo sapiens
tgctttgagtattct

SEQ ID NO: 6486 - DNA, 15 bp, Homo sapiens
atgctttgagtattc

SEQ ID NO: 6487 - DNA, 15 bp, Homo sapiens
aatgctttgagtatt

SEQ ID NO: 6488 - DNA, 15 bp, Homo sapiens
aaatgctttgagtat

SEQ ID NO: 6489 - DNA, 15 bp, Homo sapiens
caaatgctttgagta

SEQ ID NO: 6490 - DNA, 15 bp, Homo sapiens
tcaaatgctttgagt

SEQ ID NO: 6491 - DNA, 15 bp, Homo sapiens
atcaaatgctttgag

SEQ ID NO: 6492 - DNA, 15 bp, Homo sapiens
tatcaaatgctttga

SEQ ID NO: 6493 - DNA, 15 bp, Homo sapiens
gtatcaaatgctttg

SEQ ID NO: 6494 - DNA, 15 bp, Homo sapiens
agtatcaaatgcttt

SEQ ID NO: 6495 - DNA, 15 bp, Homo sapiens
cagtatcaaatgctt

SEQ ID NO: 6496 - DNA, 15 bp, Homo sapiens
ccagtatcaaatgct

SEQ ID NO: 6497 - DNA, 15 bp, Homo sapiens
tccagtatcaaatgc

SEQ ID NO: 6498 - DNA, 15 bp, Homo sapiens
atccagtatcaaatg

SEQ ID NO: 6499 - DNA, 15 bp, Homo sapiens
aatccagtatcaaat

SEQ ID NO: 6500 - DNA, 15 bp, Homo sapiens
aaatccagtatcaaa

SEQ ID NO: 6501 - DNA, 15 bp, Homo sapiens
caaatccagtatcaa

SEQ ID NO: 6502 - DNA, 15 bp, Homo sapiens
acaaatccagtatca

SEQ ID NO: 6503 - DNA, 15 bp, Homo sapiens
tacaaatccagtatc

SEQ ID NO: 6504 - DNA, 15 bp, Homo sapiens
ctacaaatccagtat

SEQ ID NO: 6505 - DNA, 15 bp, Homo sapiens
actacaaatccagta

SEQ ID NO: 6506 - DNA, 15 bp, Homo sapiens
cactacaaatccagt

SEQ ID NO: 6507 - DNA, 15 bp, Homo sapiens
tcactacaaatccag

SEQ ID NO: 6508 - DNA, 15 bp, Homo sapiens
atcactacaaatcca

SEQ ID NO: 6509 - DNA, 15 bp, Homo sapiens
aatcactacaaatcc

SEQ ID NO: 6510 - DNA, 15 bp, Homo sapiens
aaatcactacaaatc

SEQ ID NO: 6511 - DNA, 15 bp, Homo sapiens
aaaatcactacaaat

SEQ ID NO: 6512 - DNA, 15 bp, Homo sapiens
taaaatcactacaaa

SEQ ID NO: 6513 - DNA, 15 bp, Homo sapiens
ttaaaatcactacaa

SEQ ID NO: 6514 - DNA, 15 bp, Homo sapiens
attaaaatcactaca

SEQ ID NO: 6515 - DNA, 15 bp, Homo sapiens
aattaaaatcactac

SEQ ID NO: 6516 - DNA, 15 bp, Homo sapiens
aaattaaaatcacta

SEQ ID NO: 6517 - DNA, 15 bp, Homo sapiens
aaaattaaaatcact

SEQ ID NO: 6518 - DNA, 15 bp, Homo sapiens
gaaaattaaaatcac

SEQ ID NO: 6519 - DNA, 15 bp, Homo sapiens
agaaaattaaaatca

SEQ ID NO: 6520 - DNA, 15 bp, Homo sapiens
aagaaaattaaaatc

SEQ ID NO: 6521 - DNA, 15 bp, Homo sapiens
gaagaaaattaaaat

SEQ ID NO: 6522 - DNA, 15 bp, Homo sapiens
agaagaaaattaaaa

SEQ ID NO: 6523 - DNA, 15 bp, Homo sapiens
cagaagaaaattaaa

SEQ ID NO: 6524 - DNA, 15 bp, Homo sapiens
acagaagaaaattaa

SEQ ID NO: 6525 - DNA, 15 bp, Homo sapiens
tacagaagaaaatta

SEQ ID NO: 6526 - DNA, 15 bp, Homo sapiens
atacagaagaaaatt

SEQ ID NO: 6527 - DNA, 15 bp, Homo sapiens
gatacagaagaaaat

SEQ ID NO: 6528 - DNA, 15 bp, Homo sapiens
agatacagaagaaaa

SEQ ID NO: 6529 - DNA, 15 bp, Homo sapiens
aagatacagaagaaa

SEQ ID NO: 6530 - DNA, 15 bp, Homo sapiens
aaagatacagaagaa

SEQ ID NO: 6531 - DNA, 15 bp, Homo sapiens
aaaagatacagaaga

SEQ ID NO: 6532 - DNA, 15 bp, Homo sapiens
taaaagatacagaag

SEQ ID NO: 6533 - DNA, 15 bp, Homo sapiens
ttaaaagatacagaa

SEQ ID NO: 6534 - DNA, 15 bp, Homo sapiens
attaaaagatacaga

SEQ ID NO: 6535 - DNA, 15 bp, Homo sapiens
aattaaaagatacag

SEQ ID NO: 6536 - DNA, 15 bp, Homo sapiens
aaattaaaagataca

SEQ ID NO: 6537 - DNA, 15 bp, Homo sapiens
aaaattaaaagatac

SEQ ID NO: 6538 - DNA, 15 bp, Homo sapiens
aaaaattaaaagata

SEQ ID NO: 6539 - DNA, 15 bp, Homo sapiens
caaaaattaaaagat

SEQ ID NO: 6540 - DNA, 15 bp, Homo sapiens
tcaaaaattaaaaga

SEQ ID NO: 6541 - DNA, 15 bp, Homo sapiens
atcaaaaattaaaag

SEQ ID NO: 6542 - DNA, 15 bp, Homo sapiens
aatcaaaaattaaaa

SEQ ID NO: 6543 - DNA, 15 bp, Homo sapiens
aaatcaaaaattaaa

SEQ ID NO: 6544 - DNA, 15 bp, Homo sapiens
aaaatcaaaaattaa

SEQ ID NO: 6545 - DNA, 15 bp, Homo sapiens
taaaatcaaaaatta

SEQ ID NO: 6546 - DNA, 15 bp, Homo sapiens
ttaaaatcaaaaatt

SEQ ID NO: 6547 - DNA, 15 bp, Homo sapiens
tttaaaatcaaaaat

SEQ ID NO: 6548 - DNA, 15 bp, Homo sapiens
ttttaaaatcaaaaa

SEQ ID NO: 6549 - DNA, 15 bp, Homo sapiens
tttttaaaatcaaaa

SEQ ID NO: 6550 - DNA, 15 bp, Homo sapiens
atttttaaaatcaaa

SEQ ID NO: 6551 - DNA, 15 bp, Homo sapiens
catttttaaaatcaa

SEQ ID NO: 6552 - DNA, 15 bp, Homo sapiens
ccatttttaaaatca

SEQ ID NO: 6553 - DNA, 15 bp, Homo sapiens
cccatttttaaaatc

SEQ ID NO: 6554 - DNA, 15 bp, Homo sapiens
tcccatttttaaaat

SEQ ID NO: 6555 - DNA, 15 bp, Homo sapiens
atcccatttttaaaa

SEQ ID NO: 6556 - DNA, 15 bp, Homo sapiens
tatcccatttttaaa

SEQ ID NO: 6557 - DNA, 15 bp, Homo sapiens
ttatcccatttttaa

SEQ ID NO: 6558 - DNA, 15 bp, Homo sapiens
cttatcccattttta

SEQ ID NO: 6559 - DNA, 15 bp, Homo sapiens
tcttatcccattttt

SEQ ID NO: 6560 - DNA, 15 bp, Homo sapiens
ttcttatcccatttt

SEQ ID NO: 6561 - DNA, 15 bp, Homo sapiens
cttcttatcccattt

SEQ ID NO: 6562 - DNA, 15 bp, Homo sapiens
ccttcttatcccatt

SEQ ID NO: 6563 - DNA, 15 bp, Homo sapiens
cccttcttatcccat

SEQ ID NO: 6564 - DNA, 15 bp, Homo sapiens
gcccttcttatccca

SEQ ID NO: 6565 - DNA, 15 bp, Homo sapiens
tgcccttcttatccc

SEQ ID NO: 6566 - DNA, 15 bp, Homo sapiens
ttgcccttcttatcc

SEQ ID NO: 6567 - DNA, 15 bp, Homo sapiens
tttgcccttcttatc

SEQ ID NO: 6568 - DNA, 15 bp, Homo sapiens
atttgcccttcttat

SEQ ID NO: 6569 - DNA, 15 bp, Homo sapiens
aatttgcccttctta

SEQ ID NO: 6570 - DNA, 15 bp, Homo sapiens
taatttgcccttctt

SEQ ID NO: 6571 - DNA, 15 bp, Homo sapiens
gtaatttgcccttct

SEQ ID NO: 6572 - DNA, 15 bp, Homo sapiens
agtaatttgcccttc

SEQ ID NO: 6573 - DNA, 15 bp, Homo sapiens
cagtaatttgccctt

SEQ ID NO: 6574 - DNA, 15 bp, Homo sapiens
tcagtaatttgccct

SEQ ID NO: 6575 - DNA, 15 bp, Homo sapiens
atcagtaatttgccc

SEQ ID NO: 6576 - DNA, 15 bp, Homo sapiens
aatcagtaatttgcc

SEQ ID NO: 6577 - DNA, 15 bp, Homo sapiens
caatcagtaatttgc

SEQ ID NO: 6578 - DNA, 15 bp, Homo sapiens
ccaatcagtaatttg

SEQ ID NO: 6579 - DNA, 15 bp, Homo sapiens
accaatcagtaattt

SEQ ID NO: 6580 - DNA, 15 bp, Homo sapiens
aaccaatcagtaatt

SEQ ID NO: 6581 - DNA, 15 bp, Homo sapiens
aaaccaatcagtaat

SEQ ID NO: 6582 - DNA, 15 bp, Homo sapiens
taaaccaatcagtaa

SEQ ID NO: 6583 - DNA, 15 bp, Homo sapiens
ttaaaccaatcagta

SEQ ID NO: 6584 - DNA, 15 bp, Homo sapiens
gttaaaccaatcagt

SEQ ID NO: 6585 - DNA, 15 bp, Homo sapiens
agttaaaccaatcag

SEQ ID NO: 6586 - DNA, 15 bp, Homo sapiens
tagttaaaccaatca

SEQ ID NO: 6587 - DNA, 15 bp, Homo sapiens
ctagttaaaccaatc

SEQ ID NO: 6588 - DNA, 15 bp, Homo sapiens
actagttaaaccaat

SEQ ID NO: 6589 - DNA, 15 bp, Homo sapiens
aactagttaaaccaa

SEQ ID NO: 6590 - DNA, 15 bp, Homo sapiens
aaactagttaaacca

SEQ ID NO: 6591 - DNA, 15 bp, Homo sapiens
taaactagttaaacc

SEQ ID NO: 6592 - DNA, 15 bp, Homo sapiens
ataaactagttaaac

SEQ ID NO: 6593 - DNA, 15 bp, Homo sapiens
aataaactagttaaa

SEQ ID NO: 6594 - DNA, 15 bp, Homo sapiens
gaataaactagttaa

SEQ ID NO: 6595 - DNA, 15 bp, Homo sapiens
tgaataaactagtta

SEQ ID NO: 6596 - DNA, 15 bp, Homo sapiens
ctgaataaactagtt

SEQ ID NO: 6597 - DNA, 15 bp, Homo sapiens
tctgaataaactagt

SEQ ID NO: 6598 - DNA, 15 bp, Homo sapiens
ctctgaataaactag

SEQ ID NO: 6599 - DNA, 15 bp, Homo sapiens
gctctgaataaacta

SEQ ID NO: 6600 - DNA, 15 bp, Homo sapiens
agctctgaataaact

SEQ ID NO: 6601 - DNA, 15 bp, Homo sapiens
aagctctgaataaac

SEQ ID NO: 6602 - DNA, 15 bp, Homo sapiens
aaagctctgaataaa

SEQ ID NO: 6603 - DNA, 15 bp, Homo sapiens
aaaagctctgaataa

SEQ ID NO: 6604 - DNA, 15 bp, Homo sapiens
gaaaagctctgaata

SEQ ID NO: 6605 - DNA, 15 bp, Homo sapiens
agaaaagctctgaat

SEQ ID NO: 6606 - DNA, 15 bp, Homo sapiens
aagaaaagctctgaa

SEQ ID NO: 6607 - DNA, 15 bp, Homo sapiens
taagaaaagctctga

SEQ ID NO: 6608 - DNA, 15 bp, Homo sapiens
ttaagaaaagctctg

SEQ ID NO: 6609 - DNA, 15 bp, Homo sapiens
tttaagaaaagctct

SEQ ID NO: 6610 - DNA, 15 bp, Homo sapiens
ttttaagaaaagctc

SEQ ID NO: 6611 - DNA, 15 bp, Homo sapiens
attttaagaaaagct

SEQ ID NO: 6612 - DNA, 15 bp, Homo sapiens
tattttaagaaaagc

SEQ ID NO: 6613 - DNA, 15 bp, Homo sapiens
ttattttaagaaaag

SEQ ID NO: 6614 - DNA, 15 bp, Homo sapiens
attattttaagaaaa

SEQ ID NO: 6615 - DNA, 15 bp, Homo sapiens
cattattttaagaaa

SEQ ID NO: 6616 - DNA, 15 bp, Homo sapiens
tcattattttaagaa

SEQ ID NO: 6617 - DNA, 15 bp, Homo sapiens
gtcattattttaaga

SEQ ID NO: 6618 - DNA, 15 bp, Homo sapiens
agtcattattttaag

SEQ ID NO: 6619 - DNA, 15 bp, Homo sapiens
aagtcattattttaa

SEQ ID NO: 6620 - DNA, 15 bp, Homo sapiens
caagtcattatttta

SEQ ID NO: 6621 - DNA, 15 bp, Homo sapiens
tcaagtcattatttt

SEQ ID NO: 6622 - DNA, 15 bp, Homo sapiens
ttcaagtcattattt

SEQ ID NO: 6623 - DNA, 15 bp, Homo sapiens
tttcaagtcattatt

SEQ ID NO: 6624 - DNA, 15 bp, Homo sapiens
ctttcaagtcattat

SEQ ID NO: 6625 - DNA, 15 bp, Homo sapiens
cctttcaagtcatta

SEQ ID NO: 6626 - DNA, 15 bp, Homo sapiens
acctttcaagtcatt

SEQ ID NO: 6627 - DNA, 15 bp, Homo sapiens
cacctttcaagtcat

SEQ ID NO: 6628 - DNA, 15 bp, Homo sapiens
ccacctttcaagtca

SEQ ID NO: 6629 - DNA, 15 bp, Homo sapiens
tccacctttcaagtc

SEQ ID NO: 6630 - DNA, 15 bp, Homo sapiens
atccacctttcaagt

SEQ ID NO: 6631 - DNA, 15 bp, Homo sapiens
aatccacctttcaag

SEQ ID NO: 6632 - DNA, 15 bp, Homo sapiens
aaatccacctttcaa

SEQ ID NO: 6633 - DNA, 15 bp, Homo sapiens
taaatccacctttca

SEQ ID NO: 6634 - DNA, 15 bp, Homo sapiens
ttaaatccacctttc

SEQ ID NO: 6635 - DNA, 15 bp, Homo sapiens
attaaatccaccttt

SEQ ID NO: 6636 - DNA, 15 bp, Homo sapiens
tattaaatccacctt

SEQ ID NO: 6637 - DNA, 15 bp, Homo sapiens
ctattaaatccacct

SEQ ID NO: 6638 - DNA, 15 bp, Homo sapiens
tctattaaatccacc

SEQ ID NO: 6639 - DNA, 15 bp, Homo sapiens
ctctattaaatccac

SEQ ID NO: 6640 - DNA, 15 bp, Homo sapiens
actctattaaatcca

SEQ ID NO: 6641 - DNA, 15 bp, Homo sapiens
tactctattaaatcc

SEQ ID NO: 6642 - DNA, 15 bp, Homo sapiens
gtactctattaaatc

SEQ ID NO: 6643 - DNA, 15 bp, Homo sapiens
agtactctattaaat

SEQ ID NO: 6644 - DNA, 15 bp, Homo sapiens
aagtactctattaaa

SEQ ID NO: 6645 - DNA, 15 bp, Homo sapiens
aaagtactctattaa

SEQ ID NO: 6646 - DNA, 15 bp, Homo sapiens
aaaagtactctatta

SEQ ID NO: 6647 - DNA, 15 bp, Homo sapiens
aaaaagtactctatt

SEQ ID NO: 6648 - DNA, 15 bp, Homo sapiens
taaaaagtactctat

SEQ ID NO: 6649 - DNA, 15 bp, Homo sapiens
ttaaaaagtactcta

SEQ ID NO: 6650 - DNA, 15 bp, Homo sapiens
tttaaaaagtactct

SEQ ID NO: 6651 - DNA, 15 bp, Homo sapiens
ttttaaaaagtactc

SEQ ID NO: 6652 - DNA, 15 bp, Homo sapiens
tttttaaaaagtact

SEQ ID NO: 6653 - DNA, 15 bp, Homo sapiens
ctttttaaaaagtac

SEQ ID NO: 6654 - DNA, 15 bp, Homo sapiens
tctttttaaaaagta

SEQ ID NO: 6655 - DNA, 15 bp, Homo sapiens
atctttttaaaaagt

SEQ ID NO: 6656 - DNA, 15 bp, Homo sapiens
aatctttttaaaaag

SEQ ID NO: 6657 - DNA, 15 bp, Homo sapiens
caatctttttaaaaa

SEQ ID NO: 6658 - DNA, 15 bp, Homo sapiens
acaatctttttaaaa

SEQ ID NO: 6659 - DNA, 15 bp, Homo sapiens
aacaatctttttaaa

SEQ ID NO: 6660 - DNA, 15 bp, Homo sapiens
aaacaatctttttaa

SEQ ID NO: 6661 - DNA, 15 bp, Homo sapiens
aaaacaatcttttta

SEQ ID NO: 6662 - DNA, 15 bp, Homo sapiens
gaaaacaatcttttt

SEQ ID NO: 6663 - DNA, 15 bp, Homo sapiens
agaaaacaatctttt

SEQ ID NO: 6664 - DNA, 15 bp, Homo sapiens
gagaaaacaatcttt

SEQ ID NO: 6665 - DNA, 15 bp, Homo sapiens
tgagaaaacaatctt

SEQ ID NO: 6666 - DNA, 15 bp, Homo sapiens
atgagaaaacaatct

SEQ ID NO: 6667 - DNA, 15 bp, Homo sapiens
catgagaaaacaatc

SEQ ID NO: 6668 - DNA, 15 bp, Homo sapiens
gcatgagaaaacaat

SEQ ID NO: 6669 - DNA, 15 bp, Homo sapiens
ggcatgagaaaacaa

SEQ ID NO: 6670 - DNA, 15 bp, Homo sapiens
aggcatgagaaaaca

SEQ ID NO: 6671 - DNA, 15 bp, Homo sapiens
caggcatgagaaaac

SEQ ID NO: 6672 - DNA, 15 bp, Homo sapiens
tcaggcatgagaaaa

SEQ ID NO: 6673 - DNA, 15 bp, Homo sapiens
ttcaggcatgagaaa

SEQ ID NO: 6674 - DNA, 15 bp, Homo sapiens
tttcaggcatgagaa

SEQ ID NO: 6675 - DNA, 15 bp, Homo sapiens
ctttcaggcatgaga

SEQ ID NO: 6676 - DNA, 15 bp, Homo sapiens
gctttcaggcatgag

SEQ ID NO: 6677 - DNA, 15 bp, Homo sapiens
tgctttcaggcatga

SEQ ID NO: 6678 - DNA, 15 bp, Homo sapiens
atgctttcaggcatg

SEQ ID NO: 6679 - DNA, 15 bp, Homo sapiens
aatgctttcaggcat

SEQ ID NO: 6680 - DNA, 15 bp, Homo sapiens
caatgctttcaggca

SEQ ID NO: 6681 - DNA, 15 bp, Homo sapiens
tcaatgctttcaggc

SEQ ID NO: 6682 - DNA, 15 bp, Homo sapiens
ttcaatgctttcagg

SEQ ID NO: 6683 - DNA, 15 bp, Homo sapiens
attcaatgctttcag

SEQ ID NO: 6684 - DNA, 15 bp, Homo sapiens
cattcaatgctttca

SEQ ID NO: 6685 - DNA, 15 bp, Homo sapiens
acattcaatgctttc

SEQ ID NO: 6686 - DNA, 15 bp, Homo sapiens
aacattcaatgcttt

SEQ ID NO: 6687 - DNA, 15 bp, Homo sapiens
aaacattcaatgctt

SEQ ID NO: 6688 - DNA, 15 bp, Homo sapiens
aaaacattcaatgct

SEQ ID NO: 6689 - DNA, 15 bp, Homo sapiens
aaaaacattcaatgc

SEQ ID NO: 6690 - DNA, 15 bp, Homo sapiens
taaaaacattcaatg

SEQ ID NO: 6691 - DNA, 15 bp, Homo sapiens
gtaaaaacattcaat

SEQ ID NO: 6692 - DNA, 15 bp, Homo sapiens
tgtaaaaacattcaa

SEQ ID NO: 6693 - DNA, 15 bp, Homo sapiens
atgtaaaaacattca

SEQ ID NO: 6694 - DNA, 15 bp, Homo sapiens
tatgtaaaaacattc

SEQ ID NO: 6695 - DNA, 15 bp, Homo sapiens
ctatgtaaaaacatt

SEQ ID NO: 6696 - DNA, 15 bp, Homo sapiens
gctatgtaaaaacat

SEQ ID NO: 6697 - DNA, 15 bp, Homo sapiens
agctatgtaaaaaca

SEQ ID NO: 6698 - DNA, 15 bp, Homo sapiens
aagctatgtaaaaac

SEQ ID NO: 6699 - DNA, 15 bp, Homo sapiens
aaagctatgtaaaaa

SEQ ID NO: 6700 - DNA, 15 bp, Homo sapiens
taaagctatgtaaaa

SEQ ID NO: 6701 - DNA, 15 bp, Homo sapiens
ataaagctatgtaaa

SEQ ID NO: 6702 - DNA, 15 bp, Homo sapiens
tataaagctatgtaa

SEQ ID NO: 6703 - DNA, 15 bp, Homo sapiens
atataaagctatgta

SEQ ID NO: 6704 - DNA, 15 bp, Homo sapiens
gatataaagctatgt

SEQ ID NO: 6705 - DNA, 15 bp, Homo sapiens
agatataaagctatg

SEQ ID NO: 6706 - DNA, 15 bp, Homo sapiens
cagatataaagctat

SEQ ID NO: 6707 - DNA, 15 bp, Homo sapiens
ccagatataaagcta

SEQ ID NO: 6708 - DNA, 15 bp, Homo sapiens
tccagatataaagct

SEQ ID NO: 6709 - DNA, 15 bp, Homo sapiens
atccagatataaagc

SEQ ID NO: 6710 - DNA, 15 bp, Homo sapiens
gatccagatataaag

SEQ ID NO: 6711 - DNA, 15 bp, Homo sapiens
tgatccagatataaa

SEQ ID NO: 6712 - DNA, 15 bp, Homo sapiens
ctgatccagatataa

SEQ ID NO: 6713 - DNA, 15 bp, Homo sapiens
tctgatccagatata

SEQ ID NO: 6714 - DNA, 15 bp, Homo sapiens
ttctgatccagatat

SEQ ID NO: 6715 - DNA, 15 bp, Homo sapiens
cttctgatccagata

SEQ ID NO: 6716 - DNA, 15 bp, Homo sapiens
ccttctgatccagat

SEQ ID NO: 6717 - DNA, 15 bp, Homo sapiens
cccttctgatccaga

SEQ ID NO: 6718 - DNA, 15 bp, Homo sapiens
tcccttctgatccag

SEQ ID NO: 6719 - DNA, 15 bp, Homo sapiens
ttcccttctgatcca

SEQ ID NO: 6720 - DNA, 15 bp, Homo sapiens
gttcccttctgatcc

SEQ ID NO: 6721 - DNA, 15 bp, Homo sapiens
cgttcccttctgatc

SEQ ID NO: 6722 - DNA, 15 bp, Homo sapiens
tcgttcccttctgat

SEQ ID NO: 6723 - DNA, 15 bp, Homo sapiens
ctcgttcccttctga

SEQ ID NO: 6724 - DNA, 15 bp, Homo sapiens
actcgttcccttctg

SEQ ID NO: 6725 - DNA, 15 bp, Homo sapiens
aactcgttcccttct

SEQ ID NO: 6726 - DNA, 15 bp, Homo sapiens
gaactcgttcccttc

SEQ ID NO: 6727 - DNA, 15 bp, Homo sapiens
agaactcgttccctt

SEQ ID NO: 6728 - DNA, 15 bp, Homo sapiens
tagaactcgttccct

SEQ ID NO: 6729 - DNA, 15 bp, Homo sapiens
ttagaactcgttccc

SEQ ID NO: 6730 - DNA, 15 bp, Homo sapiens
attagaactcgttcc

SEQ ID NO: 6731 - DNA, 15 bp, Homo sapiens
aattagaactcgttc

SEQ ID NO: 6732 - DNA, 15 bp, Homo sapiens
gaattagaactcgtt

SEQ ID NO: 6733 - DNA, 15 bp, Homo sapiens
tgaattagaactcgt

SEQ ID NO: 6734 - DNA, 15 bp, Homo sapiens
atgaattagaactcg

SEQ ID NO: 6735 - DNA, 15 bp, Homo sapiens
catgaattagaactc

SEQ ID NO: 6736 - DNA, 15 bp, Homo sapiens
gcatgaattagaact

SEQ ID NO: 6737 - DNA, 15 bp, Homo sapiens
agcatgaattagaac

SEQ ID NO: 6738 - DNA, 15 bp, Homo sapiens
aagcatgaattagaa

SEQ ID NO: 6739 - DNA, 15 bp, Homo sapiens
aaagcatgaattaga

SEQ ID NO: 6740 - DNA, 15 bp, Homo sapiens
aaaagcatgaattag

SEQ ID NO: 6741 - DNA, 15 bp, Homo sapiens
aaaaagcatgaatta

SEQ ID NO: 6742 - DNA, 15 bp, Homo sapiens
aaaaaagcatgaatt

SEQ ID NO: 6743 - DNA, 15 bp, Homo sapiens
aaaaaaagcatgaat

SEQ ID NO: 6744 - DNA, 15 bp, Homo sapiens
aaaaaaaagcatgaa

SEQ ID NO: 6745 - DNA, 15 bp, Homo sapiens
gaaaaaaaagcatga

SEQ ID NO: 6746 - DNA, 15 bp, Homo sapiens
ggaaaaaaaagcatg

SEQ ID NO: 6747 - DNA, 15 bp, Homo sapiens
cggaaaaaaaagcat

SEQ ID NO: 6748 - DNA, 15 bp, Homo sapiens
acggaaaaaaaagca

SEQ ID NO: 6749 - DNA, 15 bp, Homo sapiens
aacggaaaaaaaagc

SEQ ID NO: 6750 - DNA, 15 bp, Homo sapiens
aaacggaaaaaaaag

SEQ ID NO: 6751 - DNA, 15 bp, Homo sapiens
aaaacggaaaaaaaa

SEQ ID NO: 6752 - DNA, 15 bp, Homo sapiens
taaaacggaaaaaaa

SEQ ID NO: 6753 - DNA, 15 bp, Homo sapiens
ataaaacggaaaaaa

SEQ ID NO: 6754 - DNA, 15 bp, Homo sapiens
aataaaacggaaaaa

SEQ ID NO: 6755 - DNA, 15 bp, Homo sapiens
taataaaacggaaaa

SEQ ID NO: 6756 - DNA, 15 bp, Homo sapiens
ttaataaaacggaaa

SEQ ID NO: 6757 - DNA, 15 bp, Homo sapiens
attaataaaacggaa

SEQ ID NO: 6758 - DNA, 15 bp, Homo sapiens
cattaataaaacgga

SEQ ID NO: 6759 - DNA, 15 bp, Homo sapiens
tcattaataaaacgg

SEQ ID NO: 6760 - DNA, 15 bp, Homo sapiens
gtcattaataaaacg

SEQ ID NO: 6761 - DNA, 15 bp, Homo sapiens
agtcattaataaaac

SEQ ID NO: 6762 - DNA, 15 bp, Homo sapiens
cagtcattaataaaa

SEQ ID NO: 6763 - DNA, 15 bp, Homo sapiens
tcagtcattaataaa

SEQ ID NO: 6764 - DNA, 15 bp, Homo sapiens
ttcagtcattaataa

SEQ ID NO: 6765 - DNA, 15 bp, Homo sapiens
tttcagtcattaata

SEQ ID NO: 6766 - DNA, 15 bp, Homo sapiens
ctttcagtcattaat

SEQ ID NO: 6767 - DNA, 15 bp, Homo sapiens
actttcagtcattaa

SEQ ID NO: 6768 - DNA, 15 bp, Homo sapiens
gactttcagtcatta

SEQ ID NO: 6769 - DNA, 15 bp, Homo sapiens
ggactttcagtcatt

SEQ ID NO: 6770 - DNA, 15 bp, Homo sapiens
aggactttcagtcat

SEQ ID NO: 6771 - DNA, 15 bp, Homo sapiens
gaggactttcagtca

SEQ ID NO: 6772 - DNA, 15 bp, Homo sapiens
ggaggactttcagtc

SEQ ID NO: 6773 - DNA, 15 bp, Homo sapiens
gggaggactttcagt

SEQ ID NO: 6774 - DNA, 15 bp, Homo sapiens
ggggaggactttcag

SEQ ID NO: 6775 - DNA, 15 bp, Homo sapiens
gggggaggactttca

SEQ ID NO: 6776 - DNA, 15 bp, Homo sapiens
tgggggaggactttc

SEQ ID NO: 6777 - DNA, 15 bp, Homo sapiens
ctgggggaggacttt

SEQ ID NO: 6778 - DNA, 15 bp, Homo sapiens
tctgggggaggactt

SEQ ID NO: 6779 - DNA, 15 bp, Homo sapiens
ttctgggggaggact

SEQ ID NO: 6780 - DNA, 15 bp, Homo sapiens
tttctgggggaggac

SEQ ID NO: 6781 - DNA, 15 bp, Homo sapiens
atttctgggggagga

SEQ ID NO: 6782 - DNA, 15 bp, Homo sapiens
aatttctgggggagg

SEQ ID NO: 6783 - DNA, 15 bp, Homo sapiens
taatttctgggggag

SEQ ID NO: 6784 - DNA, 15 bp, Homo sapiens
ataatttctggggga

SEQ ID NO: 6785 - DNA, 15 bp, Homo sapiens
gataatttctggggg

SEQ ID NO: 6786 - DNA, 15 bp, Homo sapiens
cgataatttctgggg

SEQ ID NO: 6787 - DNA, 15 bp, Homo sapiens
acgataatttctggg

SEQ ID NO: 6788 - DNA, 15 bp, Homo sapiens
tacgataatttctgg

SEQ ID NO: 6789 - DNA, 15 bp, Homo sapiens
ttacgataatttctg

SEQ ID NO: 6790 - DNA, 15 bp, Homo sapiens
gttacgataatttct

SEQ ID NO: 6791 - DNA, 15 bp, Homo sapiens
cgttacgataatttc

SEQ ID NO: 6792 - DNA, 15 bp, Homo sapiens
acgttacgataattt

SEQ ID NO: 6793 - DNA, 15 bp, Homo sapiens
aacgttacgataatt

SEQ ID NO: 6794 - DNA, 15 bp, Homo sapiens
aaacgttacgataat

SEQ ID NO: 6795 - DNA, 15 bp, Homo sapiens
taaacgttacgataa

SEQ ID NO: 6796 - DNA, 15 bp, Homo sapiens
ataaacgttacgata

SEQ ID NO: 6797 - DNA, 15 bp, Homo sapiens
aataaacgttacgat

SEQ ID NO: 6798 - DNA, 15 bp, Homo sapiens
caataaacgttacga

SEQ ID NO: 6799 - DNA, 15 bp, Homo sapiens
ccaataaacgttacg

SEQ ID NO: 6800 - DNA, 15 bp, Homo sapiens
accaataaacgttac

SEQ ID NO: 6801 - DNA, 15 bp, Homo sapiens
taccaataaacgtta

SEQ ID NO: 6802 - DNA, 15 bp, Homo sapiens
ttaccaataaacgtt

SEQ ID NO: 6803 - DNA, 15 bp, Homo sapiens
attaccaataaacgt

SEQ ID NO: 6804 - DNA, 15 bp, Homo sapiens
aattaccaataaacg

SEQ ID NO: 6805 - DNA, 15 bp, Homo sapiens
gaattaccaataaac

SEQ ID NO: 6806 - DNA, 15 bp, Homo sapiens
agaattaccaataaa

SEQ ID NO: 6807 - DNA, 15 bp, Homo sapiens
gagaattaccaataa

SEQ ID NO: 6808 - DNA, 15 bp, Homo sapiens
agagaattaccaata

SEQ ID NO: 6809 - DNA, 15 bp, Homo sapiens
cagagaattaccaat

SEQ ID NO: 6810 - DNA, 15 bp, Homo sapiens
acagagaattaccaa

SEQ ID NO: 6811 - DNA, 15 bp, Homo sapiens
tacagagaattacca

SEQ ID NO: 6812 - DNA, 15 bp, Homo sapiens
atacagagaattacc

SEQ ID NO: 6813 - DNA, 15 bp, Homo sapiens
gatacagagaattac

SEQ ID NO: 6814 - DNA, 15 bp, Homo sapiens
tgatacagagaatta

SEQ ID NO: 6815 - DNA, 15 bp, Homo sapiens
atgatacagagaatt

SEQ ID NO: 6816 - DNA, 15 bp, Homo sapiens
aatgatacagagaat

SEQ ID NO: 6817 - DNA, 15 bp, Homo sapiens
gaatgatacagagaa

SEQ ID NO: 6818 - DNA, 15 bp, Homo sapiens
agaatgatacagaga

SEQ ID NO: 6819 - DNA, 15 bp, Homo sapiens
gagaatgatacagag

SEQ ID NO: 6820 - DNA, 15 bp, Homo sapiens
cgagaatgatacaga

SEQ ID NO: 6821 - DNA, 15 bp, Homo sapiens
tcgagaatgatacag

SEQ ID NO: 6822 - DNA, 15 bp, Homo sapiens
ttcgagaatgataca

SEQ ID NO: 6823 - DNA, 15 bp, Homo sapiens
tttcgagaatgatac

SEQ ID NO: 6824 - DNA, 15 bp, Homo sapiens
atttcgagaatgata

SEQ ID NO: 6825 - DNA, 15 bp, Homo sapiens
catttcgagaatgat

SEQ ID NO: 6826 - DNA, 15 bp, Homo sapiens
acatttcgagaatga

SEQ ID NO: 6827 - DNA, 15 bp, Homo sapiens
aacatttcgagaatg

SEQ ID NO: 6828 - DNA, 15 bp, Homo sapiens
aaacatttcgagaat

SEQ ID NO: 6829 - DNA, 15 bp, Homo sapiens
taaacatttcgagaa

SEQ ID NO: 6830 - DNA, 15 bp, Homo sapiens
ttaaacatttcgaga

SEQ ID NO: 6831 - DNA, 15 bp, Homo sapiens
attaaacatttcgag

SEQ ID NO: 6832 - DNA, 15 bp, Homo sapiens
aattaaacatttcga

SEQ ID NO: 6833 - DNA, 15 bp, Homo sapiens
aaattaaacatttcg

SEQ ID NO: 6834 - DNA, 15 bp, Homo sapiens
gaaattaaacatttc

SEQ ID NO: 6835 - DNA, 15 bp, Homo sapiens
ggaaattaaacattt

SEQ ID NO: 6836 - DNA, 15 bp, Homo sapiens
tggaaattaaacatt

SEQ ID NO: 6837 - DNA, 15 bp, Homo sapiens
atggaaattaaacat

SEQ ID NO: 6838 - DNA, 15 bp, Homo sapiens
aatggaaattaaaca

SEQ ID NO: 6839 - DNA, 15 bp, Homo sapiens
aaatggaaattaaac

SEQ ID NO: 6840 - DNA, 15 bp, Homo sapiens
gaaatggaaattaaa

SEQ ID NO: 6841 - DNA, 15 bp, Homo sapiens
ggaaatggaaattaa

SEQ ID NO: 6842 - DNA, 15 bp, Homo sapiens
aggaaatggaaatta

SEQ ID NO: 6843 - DNA, 15 bp, Homo sapiens
gaggaaatggaaatt

SEQ ID NO: 6844 - DNA, 15 bp, Homo sapiens
agaggaaatggaaat

SEQ ID NO: 6845 - DNA, 15 bp, Homo sapiens
aagaggaaatggaaa

SEQ ID NO: 6846 - DNA, 15 bp, Homo sapiens
aaagaggaaatggaa

SEQ ID NO: 6847 - DNA, 15 bp, Homo sapiens
taaagaggaaatgga

SEQ ID NO: 6848 - DNA, 15 bp, Homo sapiens
ataaagaggaaatgg

SEQ ID NO: 6849 - DNA, 15 bp, Homo sapiens
aataaagaggaaatg

SEQ ID NO: 6850 - DNA, 15 bp, Homo sapiens
aaataaagaggaaat

SEQ ID NO: 6851 - DNA, 15 bp, Homo sapiens
taaataaagaggaaa

SEQ ID NO: 6852 - DNA, 15 bp, Homo sapiens
ttaaataaagaggaa

SEQ ID NO: 6853 - DNA, 15 bp, Homo sapiens
tttaaataaagagga

SEQ ID NO: 6854 - DNA, 15 bp, Homo sapiens
ttttaaataaagagg

SEQ ID NO: 6855 - DNA, 15 bp, Homo sapiens
tttttaaataaagag

SEQ ID NO: 6856 - DNA, 15 bp, Homo sapiens
ttttttaaataaaga

SEQ ID NO: 6857 - DNA, 15 bp, Homo sapiens
tttttttaaataaag

SEQ ID NO: 6858 - DNA, 15 bp, Homo sapiens
ttttttttaaataaa

SEQ ID NO: 6859 - DNA, 15 bp, Homo sapiens
tttttttttaaataa

SEQ ID NO: 6860 - DNA, 15 bp, Homo sapiens
ttttttttttaaata

SEQ ID NO: 6861 - DNA, 15 bp, Homo sapiens
tttttttttttaaat

SEQ ID NO: 6862 - DNA, 15 bp, Homo sapiens
ttttttttttttaaa

SEQ ID NO: 6863 - DNA, 15 bp, Homo sapiens
tttttttttttttaa

SEQ ID NO: 6864 - DNA, 15 bp, Homo sapiens
tttttttttttttta

SEQ ID NO: 6865 - DNA, 15 bp, Homo sapiens
ttttttttttttttt

SEQ ID NO: 6866 - DNA, 15 bp, Homo sapiens
gtttttttttttttt

SEQ ID NO: 6867 - DNA, 15 bp, Homo sapiens
agttttttttttttt

SEQ ID NO: 6868 - DNA, 15 bp, Homo sapiens
aagtttttttttttt

SEQ ID NO: 6869 - DNA, 15 bp, Homo sapiens
caagttttttttttt

SEQ ID NO: 6870 - DNA, 15 bp, Homo sapiens
tcaagtttttttttt

SEQ ID NO: 6871 - DNA, 15 bp, Homo sapiens
atcaagttttttttt

SEQ ID NO: 6872 - DNA, 15 bp, Homo sapiens
catcaagtttttttt

SEQ ID NO: 6873 - DNA, 15 bp, Homo sapiens
acatcaagttttttt

SEQ ID NO: 6874 - DNA, 15 bp, Homo sapiens
tacatcaagtttttt

SEQ ID NO: 6875 - DNA, 15 bp, Homo sapiens
ttacatcaagttttt

SEQ ID NO: 6876 - DNA, 15 bp, Homo sapiens
tttacatcaagtttt

SEQ ID NO: 6877 - DNA, 15 bp, Homo sapiens
atttacatcaagttt

SEQ ID NO: 6878 - DNA, 15 bp, Homo sapiens
aatttacatcaagtt

SEQ ID NO: 6879 - DNA, 15 bp, Homo sapiens
aaatttacatcaagt

SEQ ID NO: 6880 - DNA, 15 bp, Homo sapiens
gaaatttacatcaag

SEQ ID NO: 6881 - DNA, 15 bp, Homo sapiens
agaaatttacatcaa

SEQ ID NO: 6882 - DNA, 15 bp, Homo sapiens
aagaaatttacatca

SEQ ID NO: 6883 - DNA, 15 bp, Homo sapiens
gaagaaatttacatc

SEQ ID NO: 6884 - DNA, 15 bp, Homo sapiens
tgaagaaatttacat

SEQ ID NO: 6885 - DNA, 15 bp, Homo sapiens
atgaagaaatttaca

SEQ ID NO: 6886 - DNA, 15 bp, Homo sapiens
aatgaagaaatttac

SEQ ID NO: 6887 - DNA, 15 bp, Homo sapiens
aaatgaagaaattta

SEQ ID NO: 6888 - DNA, 15 bp, Homo sapiens
taaatgaagaaattt

SEQ ID NO: 6889 - DNA, 15 bp, Homo sapiens
ataaatgaagaaatt

SEQ ID NO: 6890 - DNA, 15 bp, Homo sapiens
aataaatgaagaaat

SEQ ID NO: 6891 - DNA, 15 bp, Homo sapiens
caataaatgaagaaa

SEQ ID NO: 6892 - DNA, 15 bp, Homo sapiens
tcaataaatgaagaa

SEQ ID NO: 6893 - DNA, 15 bp, Homo sapiens
ctcaataaatgaaga

SEQ ID NO: 6894 - DNA, 15 bp, Homo sapiens
gctcaataaatgaag

SEQ ID NO: 6895 - DNA, 15 bp, Homo sapiens
tgctcaataaatgaa

SEQ ID NO: 6896 - DNA, 15 bp, Homo sapiens
ttgctcaataaatga

SEQ ID NO: 6897 - DNA, 15 bp, Homo sapiens
attgctcaataaatg

SEQ ID NO: 6898 - DNA, 15 bp, Homo sapiens
aattgctcaataaat

SEQ ID NO: 6899 - DNA, 15 bp, Homo sapiens
caattgctcaataaa

SEQ ID NO: 6900 - DNA, 15 bp, Homo sapiens
acaattgctcaataa

SEQ ID NO: 6901 - DNA, 15 bp, Homo sapiens
aacaattgctcaata

SEQ ID NO: 6902 - DNA, 15 bp, Homo sapiens
aaacaattgctcaat

SEQ ID NO: 6903 - DNA, 15 bp, Homo sapiens
caaacaattgctcaa

SEQ ID NO: 6904 - DNA, 15 bp, Homo sapiens
tcaaacaattgctca

SEQ ID NO: 6905 - DNA, 15 bp, Homo sapiens
ctcaaacaattgctc

SEQ ID NO: 6906 - DNA, 15 bp, Homo sapiens
cctcaaacaattgct

SEQ ID NO: 6907 - DNA, 15 bp, Homo sapiens
ccctcaaacaattgc

SEQ ID NO: 6908 - DNA, 15 bp, Homo sapiens
gccctcaaacaattg

SEQ ID NO: 6909 - DNA, 15 bp, Homo sapiens
ggccctcaaacaatt

SEQ ID NO: 6910 - DNA, 15 bp, Homo sapiens
gggccctcaaacaat

SEQ ID NO: 6911 - DNA, 15 bp, Homo sapiens
tgggccctcaaacaa

SEQ ID NO: 6912 - DNA, 15 bp, Homo sapiens
ttgggccctcaaaca

SEQ ID NO: 6913 - DNA, 15 bp, Homo sapiens
tttgggccctcaaac

SEQ ID NO: 6914 - DNA, 15 bp, Homo sapiens
ctttgggccctcaaa

SEQ ID NO: 6915 - DNA, 15 bp, Homo sapiens
cctttgggccctcaa

SEQ ID NO: 6916 - DNA, 15 bp, Homo sapiens
gcctttgggccctca

SEQ ID NO: 6917 - DNA, 15 bp, Homo sapiens
tgcctttgggccctc

SEQ ID NO: 6918 - DNA, 15 bp, Homo sapiens
gtgcctttgggccct

SEQ ID NO: 6919 - DNA, 15 bp, Homo sapiens
tgtgcctttgggccc

SEQ ID NO: 6920 - DNA, 15 bp, Homo sapiens
ctgtgcctttgggcc

SEQ ID NO: 6921 - DNA, 15 bp, Homo sapiens
actgtgcctttgggc

SEQ ID NO: 6922 - DNA, 15 bp, Homo sapiens
cactgtgcctttggg

SEQ ID NO: 6923 - DNA, 15 bp, Homo sapiens
gcactgtgcctttgg

SEQ ID NO: 6924 - DNA, 15 bp, Homo sapiens
tgcactgtgcctttg

SEQ ID NO: 6925 - DNA, 15 bp, Homo sapiens
ttgcactgtgccttt

SEQ ID NO: 6926 - DNA, 15 bp, Homo sapiens
cttgcactgtgcctt

SEQ ID NO: 6927 - DNA, 15 bp, Homo sapiens
acttgcactgtgcct

SEQ ID NO: 6928 - DNA, 15 bp, Homo sapiens
aacttgcactgtgcc

SEQ ID NO: 6929 - DNA, 15 bp, Homo sapiens
aaacttgcactgtgc

SEQ ID NO: 6930 - DNA, 15 bp, Homo sapiens
gaaacttgcactgtg

SEQ ID NO: 6931 - DNA, 15 bp, Homo sapiens
agaaacttgcactgt

SEQ ID NO: 6932 - DNA, 15 bp, Homo sapiens
cagaaacttgcactg

SEQ ID NO: 6933 - DNA, 15 bp, Homo sapiens
tcagaaacttgcact

SEQ ID NO: 6934 - DNA, 15 bp, Homo sapiens
ctcagaaacttgcac

SEQ ID NO: 6935 - DNA, 15 bp, Homo sapiens
tctcagaaacttgca

SEQ ID NO: 6936 - DNA, 15 bp, Homo sapiens
ttctcagaaacttgc

SEQ ID NO: 6937 - DNA, 15 bp, Homo sapiens
attctcagaaacttg

SEQ ID NO: 6938 - DNA, 15 bp, Homo sapiens
tattctcagaaactt

SEQ ID NO: 6939 - DNA, 15 bp, Homo sapiens
gtattctcagaaact

SEQ ID NO: 6940 - DNA, 15 bp, Homo sapiens
agtattctcagaaac

SEQ ID NO: 6941 - DNA, 15 bp, Homo sapiens
tagtattctcagaaa

SEQ ID NO: 6942 - DNA, 15 bp, Homo sapiens
ctagtattctcagaa

SEQ ID NO: 6943 - DNA, 15 bp, Homo sapiens
cctagtattctcaga

SEQ ID NO: 6944 - DNA, 15 bp, Homo sapiens
tcctagtattctcag

SEQ ID NO: 6945 - DNA, 15 bp, Homo sapiens
ctcctagtattctca

SEQ ID NO: 6946 - DNA, 15 bp, Homo sapiens
gctcctagtattctc

SEQ ID NO: 6947 - DNA, 15 bp, Homo sapiens
tgctcctagtattct

SEQ ID NO: 6948 - DNA, 15 bp, Homo sapiens
ttgctcctagtattc

SEQ ID NO: 6949 - DNA, 15 bp, Homo sapiens
tttgctcctagtatt

SEQ ID NO: 6950 - DNA, 15 bp, Homo sapiens
ttttgctcctagtat

SEQ ID NO: 6951 - DNA, 15 bp, Homo sapiens
attttgctcctagta

SEQ ID NO: 6952 - DNA, 15 bp, Homo sapiens
cattttgctcctagt

SEQ ID NO: 6953 - DNA, 15 bp, Homo sapiens
acattttgctcctag

SEQ ID NO: 6954 - DNA, 15 bp, Homo sapiens
cacattttgctccta

SEQ ID NO: 6955 - DNA, 15 bp, Homo sapiens
gcacattttgctcct

SEQ ID NO: 6956 - DNA, 15 bp, Homo sapiens
agcacattttgctcc

SEQ ID NO: 6957 - DNA, 15 bp, Homo sapiens
aagcacattttgctc

SEQ ID NO: 6958 - DNA, 15 bp, Homo sapiens
taagcacattttgct

SEQ ID NO: 6959 - DNA, 15 bp, Homo sapiens
ataagcacattttgc

SEQ ID NO: 6960 - DNA, 15 bp, Homo sapiens
cataagcacattttg

SEQ ID NO: 6961 - DNA, 15 bp, Homo sapiens
tcataagcacatttt

SEQ ID NO: 6962 - DNA, 15 bp, Homo sapiens
atcataagcacattt

SEQ ID NO: 6963 - DNA, 15 bp, Homo sapiens
gatcataagcacatt

SEQ ID NO: 6964 - DNA, 15 bp, Homo sapiens
agatcataagcacat

SEQ ID NO: 6965 - DNA, 15 bp, Homo sapiens
aagatcataagcaca

SEQ ID NO: 6966 - DNA, 15 bp, Homo sapiens
aaagatcataagcac

SEQ ID NO: 6967 - DNA, 15 bp, Homo sapiens
aaaagatcataagca

SEQ ID NO: 6968 - DNA, 15 bp, Homo sapiens
aaaaagatcataagc

SEQ ID NO: 6969 - DNA, 15 bp, Homo sapiens
taaaaagatcataag

SEQ ID NO: 6970 - DNA, 15 bp, Homo sapiens
ttaaaaagatcataa

SEQ ID NO: 6971 - DNA, 15 bp, Homo sapiens
cttaaaaagatcata

SEQ ID NO: 6972 - DNA, 15 bp, Homo sapiens
gcttaaaaagatcat

SEQ ID NO: 6973 - DNA, 15 bp, Homo sapiens
tgcttaaaaagatca

SEQ ID NO: 6974 - DNA, 15 bp, Homo sapiens
gtgcttaaaaagatc

SEQ ID NO: 6975 - DNA, 15 bp, Homo sapiens
agtgcttaaaaagat

SEQ ID NO: 6976 - DNA, 15 bp, Homo sapiens
aagtgcttaaaaaga

SEQ ID NO: 6977 - DNA, 15 bp, Homo sapiens
aaagtgcttaaaaag

SEQ ID NO: 6978 - DNA, 15 bp, Homo sapiens
aaaagtgcttaaaaa

SEQ ID NO: 6979 - DNA, 15 bp, Homo sapiens
aaaaagtgcttaaaa

SEQ ID NO: 6980 - DNA, 15 bp, Homo sapiens
aaaaaagtgcttaaa

SEQ ID NO: 6981 - DNA, 15 bp, Homo sapiens
gaaaaaagtgcttaa

SEQ ID NO: 6982 - DNA, 15 bp, Homo sapiens
agaaaaaagtgctta

SEQ ID NO: 6983 - DNA, 15 bp, Homo sapiens
aagaaaaaagtgctt

SEQ ID NO: 6984 - DNA, 15 bp, Homo sapiens
aaagaaaaaagtgct

SEQ ID NO: 6985 - DNA, 15 bp, Homo sapiens
gaaagaaaaaagtgc

SEQ ID NO: 6986 - DNA, 15 bp, Homo sapiens
cgaaagaaaaaagtg

SEQ ID NO: 6987 - DNA, 15 bp, Homo sapiens
acgaaagaaaaaagt

SEQ ID NO: 6988 - DNA, 15 bp, Homo sapiens
aacgaaagaaaaaag

SEQ ID NO: 6989 - DNA, 15 bp, Homo sapiens
aaacgaaagaaaaaa

SEQ ID NO: 6990 - DNA, 15 bp, Homo sapiens
aaaacgaaagaaaaa

SEQ ID NO: 6991 - DNA, 15 bp, Homo sapiens
gaaaacgaaagaaaa

SEQ ID NO: 6992 - DNA, 15 bp, Homo sapiens
agaaaacgaaagaaa

SEQ ID NO: 6993 - DNA, 15 bp, Homo sapiens
aagaaaacgaaagaa

SEQ ID NO: 6994 - DNA, 15 bp, Homo sapiens
aaagaaaacgaaaga

SEQ ID NO: 6995 - DNA, 15 bp, Homo sapiens
aaaagaaaacgaaag

SEQ ID NO: 6996 - DNA, 15 bp, Homo sapiens
aaaaagaaaacgaaa

SEQ ID NO: 6997 - DNA, 15 bp, Homo sapiens
taaaaagaaaacgaa

SEQ ID NO: 6998 - DNA, 15 bp, Homo sapiens
ataaaaagaaaacga

SEQ ID NO: 6999 - DNA, 15 bp, Homo sapiens
cataaaaagaaaacg

SEQ ID NO: 7000 - DNA, 15 bp, Homo sapiens
tcataaaaagaaaac

SEQ ID NO: 7001 - DNA, 15 bp, Homo sapiens
atcataaaaagaaaa

SEQ ID NO: 7002 - DNA, 15 bp, Homo sapiens
tatcataaaaagaaa

SEQ ID NO: 7003 - DNA, 15 bp, Homo sapiens
gtatcataaaaagaa

SEQ ID NO: 7004 - DNA, 15 bp, Homo sapiens
agtatcataaaaaga

SEQ ID NO: 7005 - DNA, 15 bp, Homo sapiens
tagtatcataaaaag

SEQ ID NO: 7006 - DNA, 15 bp, Homo sapiens
ttagtatcataaaaa

SEQ ID NO: 7007 - DNA, 15 bp, Homo sapiens
cttagtatcataaaa

SEQ ID NO: 7008 - DNA, 15 bp, Homo sapiens
tcttagtatcataaa

SEQ ID NO: 7009 - DNA, 15 bp, Homo sapiens
ctcttagtatcataa

SEQ ID NO: 7010 - DNA, 15 bp, Homo sapiens
gctcttagtatcata

SEQ ID NO: 7011 - DNA, 15 bp, Homo sapiens
agctcttagtatcat

SEQ ID NO: 7012 - DNA, 15 bp, Homo sapiens
gagctcttagtatca

SEQ ID NO: 7013 - DNA, 15 bp, Homo sapiens
agagctcttagtatc

SEQ ID NO: 7014 - DNA, 15 bp, Homo sapiens
aagagctcttagtat

SEQ ID NO: 7015 - DNA, 15 bp, Homo sapiens
gaagagctcttagta

SEQ ID NO: 7016 - DNA, 15 bp, Homo sapiens
ggaagagctcttagt

SEQ ID NO: 7017 - DNA, 15 bp, Homo sapiens
aggaagagctcttag

SEQ ID NO: 7018 - DNA, 15 bp, Homo sapiens
taggaagagctctta

SEQ ID NO: 7019 - DNA, 15 bp, Homo sapiens
ataggaagagctctt

SEQ ID NO: 7020 - DNA, 15 bp, Homo sapiens
aataggaagagctct

SEQ ID NO: 7021 - DNA, 15 bp, Homo sapiens
taataggaagagctc

SEQ ID NO: 7022 - DNA, 15 bp, Homo sapiens
ataataggaagagct

SEQ ID NO: 7023 - DNA, 15 bp, Homo sapiens
gataataggaagagc

SEQ ID NO: 7024 - DNA, 15 bp, Homo sapiens
tgataataggaagag

SEQ ID NO: 7025 - DNA, 15 bp, Homo sapiens
gtgataataggaaga

SEQ ID NO: 7026 - DNA, 15 bp, Homo sapiens
tgtgataataggaag

SEQ ID NO: 7027 - DNA, 15 bp, Homo sapiens
ctgtgataataggaa

SEQ ID NO: 7028 - DNA, 15 bp, Homo sapiens
actgtgataatagga

SEQ ID NO: 7029 - DNA, 15 bp, Homo sapiens
cactgtgataatagg

SEQ ID NO: 7030 - DNA, 15 bp, Homo sapiens
acactgtgataatag

SEQ ID NO: 7031 - DNA, 15 bp, Homo sapiens
tacactgtgataata

SEQ ID NO: 7032 - DNA, 15 bp, Homo sapiens
atacactgtgataat

SEQ ID NO: 7033 - DNA, 15 bp, Homo sapiens
tatacactgtgataa

SEQ ID NO: 7034 - DNA, 15 bp, Homo sapiens
ctatacactgtgata

SEQ ID NO: 7035 - DNA, 15 bp, Homo sapiens
tctatacactgtgat

SEQ ID NO: 7036 - DNA, 15 bp, Homo sapiens
atctatacactgtga

SEQ ID NO: 7037 - DNA, 15 bp, Homo sapiens
tatctatacactgtg

SEQ ID NO: 7038 - DNA, 15 bp, Homo sapiens
atatctatacactgt

SEQ ID NO: 7039 - DNA, 15 bp, Homo sapiens
gatatctatacactg

SEQ ID NO: 7040 - DNA, 15 bp, Homo sapiens
agatatctatacact

SEQ ID NO: 7041 - DNA, 15 bp, Homo sapiens
cagatatctatacac

SEQ ID NO: 7042 - DNA, 15 bp, Homo sapiens
tcagatatctataca

SEQ ID NO: 7043 - DNA, 15 bp, Homo sapiens
ctcagatatctatac

SEQ ID NO: 7044 - DNA, 15 bp, Homo sapiens
actcagatatctata

SEQ ID NO: 7045 - DNA, 15 bp, Homo sapiens
gactcagatatctat

SEQ ID NO: 7046 - DNA, 15 bp, Homo sapiens
tgactcagatatcta

SEQ ID NO: 7047 - DNA, 15 bp, Homo sapiens
gtgactcagatatct

SEQ ID NO: 7048 - DNA, 15 bp, Homo sapiens
tgtgactcagatatc

SEQ ID NO: 7049 - DNA, 15 bp, Homo sapiens
ttgtgactcagatat

SEQ ID NO: 7050 - DNA, 15 bp, Homo sapiens
attgtgactcagata

SEQ ID NO: 7051 - DNA, 15 bp, Homo sapiens
tattgtgactcagat

SEQ ID NO: 7052 - DNA, 15 bp, Homo sapiens
atattgtgactcaga

SEQ ID NO: 7053 - DNA, 15 bp, Homo sapiens
gatattgtgactcag

SEQ ID NO: 7054 - DNA, 15 bp, Homo sapiens
tgatattgtgactca

SEQ ID NO: 7055 - DNA, 15 bp, Homo sapiens
atgatattgtgactc

SEQ ID NO: 7056 - DNA, 15 bp, Homo sapiens
catgatattgtgact

SEQ ID NO: 7057 - DNA, 15 bp, Homo sapiens
tcatgatattgtgac

SEQ ID NO: 7058 - DNA, 15 bp, Homo sapiens
gtcatgatattgtga

SEQ ID NO: 7059 - DNA, 15 bp, Homo sapiens
agtcatgatattgtg

SEQ ID NO: 7060 - DNA, 15 bp, Homo sapiens
cagtcatgatattgt

SEQ ID NO: 7061 - DNA, 15 bp, Homo sapiens
acagtcatgatattg

SEQ ID NO: 7062 - DNA, 15 bp, Homo sapiens
gacagtcatgatatt

SEQ ID NO: 7063 - DNA, 15 bp, Homo sapiens
agacagtcatgatat

SEQ ID NO: 7064 - DNA, 15 bp, Homo sapiens
gagacagtcatgata

SEQ ID NO: 7065 - DNA, 15 bp, Homo sapiens
ggagacagtcatgat

SEQ ID NO: 7066 - DNA, 15 bp, Homo sapiens
gggagacagtcatga

SEQ ID NO: 7067 - DNA, 15 bp, Homo sapiens
tgggagacagtcatg

SEQ ID NO: 7068 - DNA, 15 bp, Homo sapiens
ctgggagacagtcat

SEQ ID NO: 7069 - DNA, 15 bp, Homo sapiens
actgggagacagtca

SEQ ID NO: 7070 - DNA, 15 bp, Homo sapiens
aactgggagacagtc

SEQ ID NO: 7071 - DNA, 15 bp, Homo sapiens
aaactgggagacagt

SEQ ID NO: 7072 - DNA, 15 bp, Homo sapiens
taaactgggagacag

SEQ ID NO: 7073 - DNA, 15 bp, Homo sapiens
gtaaactgggagaca

SEQ ID NO: 7074 - DNA, 15 bp, Homo sapiens
tgtaaactgggagac

SEQ ID NO: 7075 - DNA, 15 bp, Homo sapiens
ctgtaaactgggaga

SEQ ID NO: 7076 - DNA, 15 bp, Homo sapiens
gctgtaaactgggag

SEQ ID NO: 7077 - DNA, 15 bp, Homo sapiens
tgctgtaaactggga

SEQ ID NO: 7078 - DNA, 15 bp, Homo sapiens
ctgctgtaaactggg

SEQ ID NO: 7079 - DNA, 15 bp, Homo sapiens
tctgctgtaaactgg

SEQ ID NO: 7080 - DNA, 15 bp, Homo sapiens
ttctgctgtaaactg

SEQ ID NO: 7081 - DNA, 15 bp, Homo sapiens
gttctgctgtaaact

SEQ ID NO: 7082 - DNA, 15 bp, Homo sapiens
cgttctgctgtaaac

SEQ ID NO: 7083 - DNA, 15 bp, Homo sapiens
acgttctgctgtaaa

SEQ ID NO: 7084 - DNA, 15 bp, Homo sapiens
cacgttctgctgtaa

SEQ ID NO: 7085 - DNA, 15 bp, Homo sapiens
gcacgttctgctgta

SEQ ID NO: 7086 - DNA, 15 bp, Homo sapiens
agcacgttctgctgt

SEQ ID NO: 7087 - DNA, 15 bp, Homo sapiens
aagcacgttctgctg

SEQ ID NO: 7088 - DNA, 15 bp, Homo sapiens
aaagcacgttctgct

SEQ ID NO: 7089 - DNA, 15 bp, Homo sapiens
aaaagcacgttctgc

SEQ ID NO: 7090 - DNA, 15 bp, Homo sapiens
aaaaagcacgttctg

SEQ ID NO: 7091 - DNA, 15 bp, Homo sapiens
taaaaagcacgttct

SEQ ID NO: 7092 - DNA, 15 bp, Homo sapiens
gtaaaaagcacgttc

SEQ ID NO: 7093 - DNA, 15 bp, Homo sapiens
ggtaaaaagcacgtt

SEQ ID NO: 7094 - DNA, 15 bp, Homo sapiens
aggtaaaaagcacgt

SEQ ID NO: 7095 - DNA, 15 bp, Homo sapiens
aaggtaaaaagcacg

SEQ ID NO: 7096 - DNA, 15 bp, Homo sapiens
caaggtaaaaagcac

SEQ ID NO: 7097 - DNA, 15 bp, Homo sapiens
ccaaggtaaaaagca

SEQ ID NO: 7098 - DNA, 15 bp, Homo sapiens
tccaaggtaaaaagc

SEQ ID NO: 7099 - DNA, 15 bp, Homo sapiens
atccaaggtaaaaag

SEQ ID NO: 7100 - DNA, 15 bp, Homo sapiens
aatccaaggtaaaaa

SEQ ID NO: 7101 - DNA, 15 bp, Homo sapiens
taatccaaggtaaaa

SEQ ID NO: 7102 - DNA, 15 bp, Homo sapiens
ttaatccaaggtaaa

SEQ ID NO: 7103 - DNA, 15 bp, Homo sapiens
tttaatccaaggtaa

SEQ ID NO: 7104 - DNA, 15 bp, Homo sapiens
ttttaatccaaggta

SEQ ID NO: 7105 - DNA, 15 bp, Homo sapiens
attttaatccaaggt

SEQ ID NO: 7106 - DNA, 15 bp, Homo sapiens
aattttaatccaagg

SEQ ID NO: 7107 - DNA, 15 bp, Homo sapiens
aaattttaatccaag

SEQ ID NO: 7108 - DNA, 15 bp, Homo sapiens
caaattttaatccaa

SEQ ID NO: 7109 - DNA, 15 bp, Homo sapiens
gcaaattttaatcca

SEQ ID NO: 7110 - DNA, 15 bp, Homo sapiens
agcaaattttaatcc

SEQ ID NO: 7111 - DNA, 15 bp, Homo sapiens
aagcaaattttaatc

SEQ ID NO: 7112 - DNA, 15 bp, Homo sapiens
aaagcaaattttaat

SEQ ID NO: 7113 - DNA, 15 bp, Homo sapiens
taaagcaaattttaa

SEQ ID NO: 7114 - DNA, 15 bp, Homo sapiens
ataaagcaaatttta

SEQ ID NO: 7115 - DNA, 15 bp, Homo sapiens
aataaagcaaatttt

SEQ ID NO: 7116 - DNA, 15 bp, Homo sapiens
aaataaagcaaattt

SEQ ID NO: 7117 - DNA, 15 bp, Homo sapiens
caaataaagcaaatt

SEQ ID NO: 7118 - DNA, 15 bp, Homo sapiens
ccaaataaagcaaat

SEQ ID NO: 7119 - DNA, 15 bp, Homo sapiens
gccaaataaagcaaa

SEQ ID NO: 7120 - DNA, 15 bp, Homo sapiens
ggccaaataaagcaa

SEQ ID NO: 7121 - DNA, 15 bp, Homo sapiens
cggccaaataaagca

SEQ ID NO: 7122 - DNA, 15 bp, Homo sapiens
ccggccaaataaagc

SEQ ID NO: 7123 - DNA, 15 bp, Homo sapiens
cccggccaaataaag

SEQ ID NO: 7124 - DNA, 15 bp, Homo sapiens
acccggccaaataaa

SEQ ID NO: 7125 - DNA, 15 bp, Homo sapiens
cacccggccaaataa

SEQ ID NO: 7126 - DNA, 15 bp, Homo sapiens
gcacccggccaaata

SEQ ID NO: 7127 - DNA, 15 bp, Homo sapiens
tgcacccggccaaat

SEQ ID NO: 7128 - DNA, 15 bp, Homo sapiens
ctgcacccggccaaa

SEQ ID NO: 7129 - DNA, 15 bp, Homo sapiens
actgcacccggccaa

SEQ ID NO: 7130 - DNA, 15 bp, Homo sapiens
cactgcacccggcca

SEQ ID NO: 7131 - DNA, 15 bp, Homo sapiens
tcactgcacccggcc

SEQ ID NO: 7132 - DNA, 15 bp, Homo sapiens
ctcactgcacccggc

SEQ ID NO: 7133 - DNA, 15 bp, Homo sapiens
actcactgcacccgg

SEQ ID NO: 7134 - DNA, 15 bp, Homo sapiens
cactcactgcacccg

SEQ ID NO: 7135 - DNA, 15 bp, Homo sapiens
ccactcactgcaccc

SEQ ID NO: 7136 - DNA, 15 bp, Homo sapiens
gccactcactgcacc

SEQ ID NO: 7137 - DNA, 15 bp, Homo sapiens
agccactcactgcac

SEQ ID NO: 7138 - DNA, 15 bp, Homo sapiens
gagccactcactgca

SEQ ID NO: 7139 - DNA, 15 bp, Homo sapiens
tgagccactcactgc

SEQ ID NO: 7140 - DNA, 15 bp, Homo sapiens
atgagccactcactg

SEQ ID NO: 7141 - DNA, 15 bp, Homo sapiens
catgagccactcact

SEQ ID NO: 7142 - DNA, 15 bp, Homo sapiens
gcatgagccactcac

SEQ ID NO: 7143 - DNA, 15 bp, Homo sapiens
ggcatgagccactca

SEQ ID NO: 7144 - DNA, 15 bp, Homo sapiens
aggcatgagccactc

SEQ ID NO: 7145 - DNA, 15 bp, Homo sapiens
tcaaagtgctgggat

SEQ ID NO: 7146 - DNA, 15 bp, Homo sapiens
ctcaaagtgctggga

SEQ ID NO: 7147 - DNA, 15 bp, Homo sapiens
tctcaaagtgctggg

SEQ ID NO: 7148 - DNA, 15 bp, Homo sapiens
ctctcaaagtgctgg

SEQ ID NO: 7149 - DNA, 15 bp, Homo sapiens
cctctcaaagtgctg

SEQ ID NO: 7150 - DNA, 15 bp, Homo sapiens
gcctctcaaagtgct

SEQ ID NO: 7151 - DNA, 15 bp, Homo sapiens
ggcctctcaaagtgc

SEQ ID NO: 7152 - DNA, 15 bp, Homo sapiens
cggcctctcaaagtg

SEQ ID NO: 7153 - DNA, 15 bp, Homo sapiens
tcggcctctcaaagt

SEQ ID NO: 7154 - DNA, 15 bp, Homo sapiens
ctcggcctctcaaag

SEQ ID NO: 7155 - DNA, 15 bp, Homo sapiens
cctcggcctctcaaa

SEQ ID NO: 7156 - DNA, 15 bp, Homo sapiens
acctcggcctctcaa

SEQ ID NO: 7157 - DNA, 15 bp, Homo sapiens
cacctcggcctctca

SEQ ID NO: 7158 - DNA, 15 bp, Homo sapiens
ccacctcggcctctc

SEQ ID NO: 7159 - DNA, 15 bp, Homo sapiens
cccacctcggcctct

SEQ ID NO: 7160 - DNA, 15 bp, Homo sapiens
atgatccacccacct

SEQ ID NO: 7161 - DNA, 15 bp, Homo sapiens
aatgatccacccacc

SEQ ID NO: 7162 - DNA, 15 bp, Homo sapiens
aaatgatccacccac

SEQ ID NO: 7163 - DNA, 15 bp, Homo sapiens
caaatgatccaccca

SEQ ID NO: 7164 - DNA, 15 bp, Homo sapiens
tcaaatgatccaccc

SEQ ID NO: 7165 - DNA, 15 bp, Homo sapiens
ctgacctcaaatgat

SEQ ID NO: 7166 - DNA, 15 bp, Homo sapiens
cctgacctcaaatga

SEQ ID NO: 7167 - DNA, 15 bp, Homo sapiens
tcctgacctcaaatg

SEQ ID NO: 7168 - DNA, 15 bp, Homo sapiens
ctcctgacctcaaat

SEQ ID NO: 7169 - DNA, 15 bp, Homo sapiens
actcctgacctcaaa

SEQ ID NO: 7170 - DNA, 15 bp, Homo sapiens
aactcctgacctcaa

SEQ ID NO: 7171 - DNA, 15 bp, Homo sapiens
cgaactcctgacctc

SEQ ID NO: 7172 - DNA, 15 bp, Homo sapiens
tcgaactcctgacct

SEQ ID NO: 7173 - DNA, 15 bp, Homo sapiens
ctcgaactcctgacc

SEQ ID NO: 7174 - DNA, 15 bp, Homo sapiens
tctcgaactcctgac

SEQ ID NO: 7175 - DNA, 15 bp, Homo sapiens
gtctcgaactcctga

SEQ ID NO: 7176 - DNA, 15 bp, Homo sapiens
ggtctcgaactcctg

SEQ ID NO: 7177 - DNA, 15 bp, Homo sapiens
tggtctcgaactcct

SEQ ID NO: 7178 - DNA, 15 bp, Homo sapiens
ctggtctcgaactcc

SEQ ID NO: 7179 - DNA, 15 bp, Homo sapiens
gctggtctcgaactc

SEQ ID NO: 7180 - DNA, 15 bp, Homo sapiens
ggctggtctcgaact

SEQ ID NO: 7181 - DNA, 15 bp, Homo sapiens
aggctggtctcgaac

SEQ ID NO: 7182 - DNA, 15 bp, Homo sapiens
caggctggtctcgaa

SEQ ID NO: 7183 - DNA, 15 bp, Homo sapiens
ccaggctggtctcga

SEQ ID NO: 7184 - DNA, 15 bp, Homo sapiens
gccaggctggtctcg

SEQ ID NO: 7185 - DNA, 15 bp, Homo sapiens
ggccaggctggtctc

SEQ ID NO: 7186 - DNA, 15 bp, Homo sapiens
gtggggtttcaccat

SEQ ID NO: 7187 - DNA, 15 bp, Homo sapiens
ggtggggtttcacca

SEQ ID NO: 7188 - DNA, 15 bp, Homo sapiens
aggtggggtttcacc

SEQ ID NO: 7189 - DNA, 15 bp, Homo sapiens
caggtggggtttcac

SEQ ID NO: 7190 - DNA, 15 bp, Homo sapiens
acaggtggggtttca

SEQ ID NO: 7191 - DNA, 15 bp, Homo sapiens
tacaggtggggtttc

SEQ ID NO: 7192 - DNA, 15 bp, Homo sapiens
gtacaggtggggttt

SEQ ID NO: 7193 - DNA, 15 bp, Homo sapiens
agtacaggtggggtt

SEQ ID NO: 7194 - DNA, 15 bp, Homo sapiens
tagtacaggtggggt

SEQ ID NO: 7195 - DNA, 15 bp, Homo sapiens
ttagtacaggtgggg

SEQ ID NO: 7196 - DNA, 15 bp, Homo sapiens
tttagtacaggtggg

SEQ ID NO: 7197 - DNA, 15 bp, Homo sapiens
ttttagtacaggtgg

SEQ ID NO: 7198 - DNA, 15 bp, Homo sapiens
tttttagtacaggtg

SEQ ID NO: 7199 - DNA, 15 bp, Homo sapiens
atttttagtacaggt

SEQ ID NO: 7200 - DNA, 15 bp, Homo sapiens
tatttttagtacagg

SEQ ID NO: 7201 - DNA, 15 bp, Homo sapiens
gtatttttagtacag

SEQ ID NO: 7202 - DNA, 15 bp, Homo sapiens
tgtatttttagtaca

SEQ ID NO: 7203 - DNA, 15 bp, Homo sapiens
ttgtatttttagtac

SEQ ID NO: 7204 - DNA, 15 bp, Homo sapiens
ggctaatttttgtat

SEQ ID NO: 7205 - DNA, 15 bp, Homo sapiens
tggctaatttttgta

SEQ ID NO: 7206 - DNA, 15 bp, Homo sapiens
ctggctaatttttgt

SEQ ID NO: 7207 - DNA, 15 bp, Homo sapiens
cctggctaatttttg

SEQ ID NO: 7208 - DNA, 15 bp, Homo sapiens
gcctggctaattttt

SEQ ID NO: 7209 - DNA, 15 bp, Homo sapiens
ccacgcctggctaat

SEQ ID NO: 7210 - DNA, 15 bp, Homo sapiens
accaccacgcctggc

SEQ ID NO: 7211 - DNA, 15 bp, Homo sapiens
caccaccacgcctgg

SEQ ID NO: 7212 - DNA, 15 bp, Homo sapiens
ccaccaccacgcctg

SEQ ID NO: 7213 - DNA, 15 bp, Homo sapiens
cccaccaccacgcct

SEQ ID NO: 7214 - DNA, 15 bp, Homo sapiens
acccaccaccacgcc

SEQ ID NO: 7215 - DNA, 15 bp, Homo sapiens
gacccaccaccacgc

SEQ ID NO: 7216 - DNA, 15 bp, Homo sapiens
ggacccaccaccacg

SEQ ID NO: 7217 - DNA, 15 bp, Homo sapiens
gggacccaccaccac

SEQ ID NO: 7218 - DNA, 15 bp, Homo sapiens
agggacccaccacca

SEQ ID NO: 7219 - DNA, 15 bp, Homo sapiens
cagggacccaccacc

SEQ ID NO: 7220 - DNA, 15 bp, Homo sapiens
acagggacccaccac

SEQ ID NO: 7221 - DNA, 15 bp, Homo sapiens
tacagggacccacca

SEQ ID NO: 7222 - DNA, 15 bp, Homo sapiens
ttacagggacccacc

SEQ ID NO: 7223 - DNA, 15 bp, Homo sapiens
attacagggacccac

SEQ ID NO: 7224 - DNA, 15 bp, Homo sapiens
gattacagggaccca

SEQ ID NO: 7225 - DNA, 15 bp, Homo sapiens
ggattacagggaccc

SEQ ID NO: 7226 - DNA, 15 bp, Homo sapiens
gggattacagggacc

SEQ ID NO: 7227 - DNA, 15 bp, Homo sapiens
tgggattacagggac

SEQ ID NO: 7228 - DNA, 15 bp, Homo sapiens
ctgggattacaggga

SEQ ID NO: 7229 - DNA, 15 bp, Homo sapiens
gctgggattacaggg

SEQ ID NO: 7230 - DNA, 15 bp, Homo sapiens
cgggttcaagcgatt

SEQ ID NO: 7231 - DNA, 15 bp, Homo sapiens
ccgggttcaagcgat

SEQ ID NO: 7232 - DNA, 15 bp, Homo sapiens
cccgggttcaagcga

SEQ ID NO: 7233 - DNA, 15 bp, Homo sapiens
tcccgggttcaagcg

SEQ ID NO: 7234 - DNA, 15 bp, Homo sapiens
ctcccgggttcaagc

SEQ ID NO: 7235 - DNA, 15 bp, Homo sapiens
cctcccgggttcaag

SEQ ID NO: 7236 - DNA, 15 bp, Homo sapiens
gcctcccgggttcaa

SEQ ID NO: 7237 - DNA, 15 bp, Homo sapiens
cgcctcccgggttca

SEQ ID NO: 7238 - DNA, 15 bp, Homo sapiens
ccgcctcccgggttc

SEQ ID NO: 7239 - DNA, 15 bp, Homo sapiens
tccgcctcccgggtt

SEQ ID NO: 7240 - DNA, 15 bp, Homo sapiens
atccgcctcccgggt

SEQ ID NO: 7241 - DNA, 15 bp, Homo sapiens
catccgcctcccggg

SEQ ID NO: 7242 - DNA, 15 bp, Homo sapiens
acatccgcctcccgg

SEQ ID NO: 7243 - DNA, 15 bp, Homo sapiens
aacatccgcctcccg

SEQ ID NO: 7244 - DNA, 15 bp, Homo sapiens
caacatccgcctccc

SEQ ID NO: 7245 - DNA, 15 bp, Homo sapiens
gcaacatccgcctcc

SEQ ID NO: 7246 - DNA, 15 bp, Homo sapiens
tgcaacatccgcctc

SEQ ID NO: 7247 - DNA, 15 bp, Homo sapiens
ctgcaacatccgcct

SEQ ID NO: 7248 - DNA, 15 bp, Homo sapiens
actgcaacatccgcc

SEQ ID NO: 7249 - DNA, 15 bp, Homo sapiens
cactgcaacatccgc

SEQ ID NO: 7250 - DNA, 15 bp, Homo sapiens
tcactgcaacatccg

SEQ ID NO: 7251 - DNA, 15 bp, Homo sapiens
ctcactgcaacatcc

SEQ ID NO: 7252 - DNA, 15 bp, Homo sapiens
gctcactgcaacatc

SEQ ID NO: 7253 - DNA, 15 bp, Homo sapiens
ggctcactgcaacat

SEQ ID NO: 7254 - DNA, 15 bp, Homo sapiens
cggctcactgcaaca

SEQ ID NO: 7255 - DNA, 15 bp, Homo sapiens
aatctcggctcactg

SEQ ID NO: 7256 - DNA, 15 bp, Homo sapiens
caatctcggctcact

SEQ ID NO: 7257 - DNA, 15 bp, Homo sapiens
gcaatctcggctcac

SEQ ID NO: 7258 - DNA, 15 bp, Homo sapiens
cgcaatctcggctca

SEQ ID NO: 7259 - DNA, 15 bp, Homo sapiens
gcgcaatctcggctc

SEQ ID NO: 7260 - DNA, 15 bp, Homo sapiens
ggcgcaatctcggct

SEQ ID NO: 7261 - DNA, 15 bp, Homo sapiens
tggcgcaatctcggc

SEQ ID NO: 7262 - DNA, 15 bp, Homo sapiens
gtggcgcaatctcgg

SEQ ID NO: 7263 - DNA, 15 bp, Homo sapiens
agtggcgcaatctcg

SEQ ID NO: 7264 - DNA, 15 bp, Homo sapiens
cagtggcgcaatctc

SEQ ID NO: 7265 - DNA, 15 bp, Homo sapiens
gcagtggcgcaatct

SEQ ID NO: 7266 - DNA, 15 bp, Homo sapiens
tgcagtggcgcaatc

SEQ ID NO: 7267 - DNA, 15 bp, Homo sapiens
gtgcagtggcgcaat

SEQ ID NO: 7268 - DNA, 15 bp, Homo sapiens
agtgcagtggcgcaa

SEQ ID NO: 7269 - DNA, 15 bp, Homo sapiens
gagtgcagtggcgca

SEQ ID NO: 7270 - DNA, 15 bp, Homo sapiens
tcaggctggagtgca

SEQ ID NO: 7271 - DNA, 15 bp, Homo sapiens
ctcaggctggagtgc

SEQ ID NO: 7272 - DNA, 15 bp, Homo sapiens
actcaggctggagtg

SEQ ID NO: 7273 - DNA, 15 bp, Homo sapiens
cactcaggctggagt

SEQ ID NO: 7274 - DNA, 15 bp, Homo sapiens
tcactcaggctggag

SEQ ID NO: 7275 - DNA, 15 bp, Homo sapiens
gtcactcaggctgga

SEQ ID NO: 7276 - DNA, 15 bp, Homo sapiens
tgtcactcaggctgg

SEQ ID NO: 7277 - DNA, 15 bp, Homo sapiens
ttgtcactcaggctg

SEQ ID NO: 7278 - DNA, 15 bp, Homo sapiens
tttgtcactcaggct

SEQ ID NO: 7279 - DNA, 15 bp, Homo sapiens
ctttgtcactcaggc

SEQ ID NO: 7280 - DNA, 15 bp, Homo sapiens
actttgtcactcagg

SEQ ID NO: 7281 - DNA, 15 bp, Homo sapiens
cactttgtcactcag

SEQ ID NO: 7282 - DNA, 15 bp, Homo sapiens
tcactttgtcactca

SEQ ID NO: 7283 - DNA, 15 bp, Homo sapiens
ctcactttgtcactc

SEQ ID NO: 7284 - DNA, 15 bp, Homo sapiens
tctcactttgtcact

SEQ ID NO: 7285 - DNA, 15 bp, Homo sapiens
gtctcactttgtcac

SEQ ID NO: 7286 - DNA, 15 bp, Homo sapiens
agtctcactttgtca

SEQ ID NO: 7287 - DNA, 15 bp, Homo sapiens
gagtctcactttgtc

SEQ ID NO: 7288 - DNA, 15 bp, Homo sapiens
ggagtctcactttgt

SEQ ID NO: 7289 - DNA, 15 bp, Homo sapiens
cggagtctcactttg

SEQ ID NO: 7290 - DNA, 15 bp, Homo sapiens
acggagtctcacttt

SEQ ID NO: 7291 - DNA, 15 bp, Homo sapiens
gacggagtctcactt

SEQ ID NO: 7292 - DNA, 15 bp, Homo sapiens
agacggagtctcact

SEQ ID NO: 7293 - DNA, 15 bp, Homo sapiens
gagacggagtctcac

SEQ ID NO: 7294 - DNA, 15 bp, Homo sapiens
tgagacggagtctca

SEQ ID NO: 7295 - DNA, 15 bp, Homo sapiens
ttgagacggagtctc

SEQ ID NO: 7296 - DNA, 15 bp, Homo sapiens
tttgagacggagtct

SEQ ID NO: 7297 - DNA, 15 bp, Homo sapiens
ttttgagacggagtc

SEQ ID NO: 7298 - DNA, 15 bp, Homo sapiens
tttttgagacggagt

SEQ ID NO: 7299 - DNA, 15 bp, Homo sapiens
ttttttgagacggag

SEQ ID NO: 7300 - DNA, 15 bp, Homo sapiens
tttttttgagacgga

SEQ ID NO: 7301 - DNA, 15 bp, Homo sapiens
ttttttttgagacgg

SEQ ID NO: 7302 - DNA, 15 bp, Homo sapiens
tttttttttgagacg

SEQ ID NO: 7303 - DNA, 15 bp, Homo sapiens
atttttttttgagac

SEQ ID NO: 7304 - DNA, 15 bp, Homo sapiens
aatttttttttgaga

SEQ ID NO: 7305 - DNA, 15 bp, Homo sapiens
aaatttttttttgag

SEQ ID NO: 7306 - DNA, 15 bp, Homo sapiens
aaaatttttttttga

SEQ ID NO: 7307 - DNA, 15 bp, Homo sapiens
aaaaatttttttttg

SEQ ID NO: 7308 - DNA, 15 bp, Homo sapiens
aaaaaattttttttt

SEQ ID NO: 7309 - DNA, 15 bp, Homo sapiens
aaaaaaatttttttt

SEQ ID NO: 7310 - DNA, 15 bp, Homo sapiens
aaaaaaaattttttt

SEQ ID NO: 7311 - DNA, 15 bp, Homo sapiens
aaaaaaaaatttttt

SEQ ID NO: 7312 - DNA, 15 bp, Homo sapiens
aaaaaaaaaattttt

SEQ ID NO: 7313 - DNA, 15 bp, Homo sapiens
caaaaaaaaaatttt

SEQ ID NO: 7314 - DNA, 15 bp, Homo sapiens
gcaaaaaaaaaattt

SEQ ID NO: 7315 - DNA, 15 bp, Homo sapiens
agcaaaaaaaaaatt

SEQ ID NO: 7316 - DNA, 15 bp, Homo sapiens
aagcaaaaaaaaaat

SEQ ID NO: 7317 - DNA, 15 bp, Homo sapiens
aaagcaaaaaaaaaa

SEQ ID NO: 7318 - DNA, 15 bp, Homo sapiens
taaagcaaaaaaaaa

SEQ ID NO: 7319 - DNA, 15 bp, Homo sapiens
ctaaagcaaaaaaaa

SEQ ID NO: 7320 - DNA, 15 bp, Homo sapiens
actaaagcaaaaaaa

SEQ ID NO: 7321 - DNA, 15 bp, Homo sapiens
tactaaagcaaaaaa

SEQ ID NO: 7322 - DNA, 15 bp, Homo sapiens
atactaaagcaaaaa

SEQ ID NO: 7323 - DNA, 15 bp, Homo sapiens
tatactaaagcaaaa

SEQ ID NO: 7324 - DNA, 15 bp, Homo sapiens
gtatactaaagcaaa

SEQ ID NO: 7325 - DNA, 15 bp, Homo sapiens
agtatactaaagcaa

SEQ ID NO: 7326 - DNA, 15 bp, Homo sapiens
aagtatactaaagca

SEQ ID NO: 7327 - DNA, 15 bp, Homo sapiens
taagtatactaaagc

SEQ ID NO: 7328 - DNA, 15 bp, Homo sapiens
ataagtatactaaag

SEQ ID NO: 7329 - DNA, 15 bp, Homo sapiens
gataagtatactaaa

SEQ ID NO: 7330 - DNA, 15 bp, Homo sapiens
tgataagtatactaa

SEQ ID NO: 7331 - DNA, 15 bp, Homo sapiens
ctgataagtatacta

SEQ ID NO: 7332 - DNA, 15 bp, Homo sapiens
tctgataagtatact

SEQ ID NO: 7333 - DNA, 15 bp, Homo sapiens
ttctgataagtatac

SEQ ID NO: 7334 - DNA, 15 bp, Homo sapiens
cttctgataagtata

SEQ ID NO: 7335 - DNA, 15 bp, Homo sapiens
acttctgataagtat

SEQ ID NO: 7336 - DNA, 15 bp, Homo sapiens
tacttctgataagta

SEQ ID NO: 7337 - DNA, 15 bp, Homo sapiens
atacttctgataagt

SEQ ID NO: 7338 - DNA, 15 bp, Homo sapiens
tatacttctgataag

SEQ ID NO: 7339 - DNA, 15 bp, Homo sapiens
ttatacttctgataa

SEQ ID NO: 7340 - DNA, 15 bp, Homo sapiens
attatacttctgata

SEQ ID NO: 7341 - DNA, 15 bp, Homo sapiens
cattatacttctgat

SEQ ID NO: 7342 - DNA, 15 bp, Homo sapiens
gcattatacttctga

SEQ ID NO: 7343 - DNA, 15 bp, Homo sapiens
tgcattatacttctg

SEQ ID NO: 7344 - DNA, 15 bp, Homo sapiens
ctgcattatacttct

SEQ ID NO: 7345 - DNA, 15 bp, Homo sapiens
actgcattatacttc

SEQ ID NO: 7346 - DNA, 15 bp, Homo sapiens
tactgcattatactt

SEQ ID NO: 7347 - DNA, 15 bp, Homo sapiens
gtactgcattatact

SEQ ID NO: 7348 - DNA, 15 bp, Homo sapiens
tgtactgcattatac

SEQ ID NO: 7349 - DNA, 15 bp, Homo sapiens
ctgtactgcattata

SEQ ID NO: 7350 - DNA, 15 bp, Homo sapiens
tctgtactgcattat

SEQ ID NO: 7351 - DNA, 15 bp, Homo sapiens
ctctgtactgcatta

SEQ ID NO: 7352 - DNA, 15 bp, Homo sapiens
actctgtactgcatt

SEQ ID NO: 7353 - DNA, 15 bp, Homo sapiens
cactctgtactgcat

SEQ ID NO: 7354 - DNA, 15 bp, Homo sapiens
acactctgtactgca

SEQ ID NO: 7355 - DNA, 15 bp, Homo sapiens
aacactctgtactgc

SEQ ID NO: 7356 - DNA, 15 bp, Homo sapiens
caacactctgtactg

SEQ ID NO: 7357 - DNA, 15 bp, Homo sapiens
acaacactctgtact

SEQ ID NO: 7358 - DNA, 15 bp, Homo sapiens
tacaacactctgtac

SEQ ID NO: 7359 - DNA, 15 bp, Homo sapiens
gtacaacactctgta

SEQ ID NO: 7360 - DNA, 15 bp, Homo sapiens
tgtacaacactctgt

SEQ ID NO: 7361 - DNA, 15 bp, Homo sapiens
ctgtacaacactctg

SEQ ID NO: 7362 - DNA, 15 bp, Homo sapiens
actgtacaacactct

SEQ ID NO: 7363 - DNA, 15 bp, Homo sapiens
tactgtacaacactc

SEQ ID NO: 7364 - DNA, 15 bp, Homo sapiens
atactgtacaacact

SEQ ID NO: 7365 - DNA, 15 bp, Homo sapiens
aatactgtacaacac

SEQ ID NO: 7366 - DNA, 15 bp, Homo sapiens
aaatactgtacaaca

SEQ ID NO: 7367 - DNA, 15 bp, Homo sapiens
gaaatactgtacaac

SEQ ID NO: 7368 - DNA, 15 bp, Homo sapiens
tgaaatactgtacaa

SEQ ID NO: 7369 - DNA, 15 bp, Homo sapiens
ctgaaatactgtaca

SEQ ID NO: 7370 - DNA, 15 bp, Homo sapiens
actgaaatactgtac

SEQ ID NO: 7371 - DNA, 15 bp, Homo sapiens
cactgaaatactgta

SEQ ID NO: 7372 - DNA, 15 bp, Homo sapiens
gcactgaaatactgt

SEQ ID NO: 7373 - DNA, 15 bp, Homo sapiens
agcactgaaatactg

SEQ ID NO: 7374 - DNA, 15 bp, Homo sapiens
cagcactgaaatact

SEQ ID NO: 7375 - DNA, 15 bp, Homo sapiens
acagcactgaaatac

SEQ ID NO: 7376 - DNA, 15 bp, Homo sapiens
tacagcactgaaata

SEQ ID NO: 7377 - DNA, 15 bp, Homo sapiens
gtacagcactgaaat

SEQ ID NO: 7378 - DNA, 15 bp, Homo sapiens
tgtacagcactgaaa

SEQ ID NO: 7379 - DNA, 15 bp, Homo sapiens
ctgtacagcactgaa

SEQ ID NO: 7380 - DNA, 15 bp, Homo sapiens
tctgtacagcactga

SEQ ID NO: 7381 - DNA, 15 bp, Homo sapiens
ctctgtacagcactg

SEQ ID NO: 7382 - DNA, 15 bp, Homo sapiens
tctctgtacagcact

SEQ ID NO: 7383 - DNA, 15 bp, Homo sapiens
atctctgtacagcac

SEQ ID NO: 7384 - DNA, 15 bp, Homo sapiens
aatctctgtacagca

SEQ ID NO: 7385 - DNA, 15 bp, Homo sapiens
taatctctgtacagc

SEQ ID NO: 7386 - DNA, 15 bp, Homo sapiens
ttaatctctgtacag

SEQ ID NO: 7387 - DNA, 15 bp, Homo sapiens
attaatctctgtaca

SEQ ID NO: 7388 - DNA, 15 bp, Homo sapiens
gattaatctctgtac

SEQ ID NO: 7389 - DNA, 15 bp, Homo sapiens
agattaatctctgta

SEQ ID NO: 7390 - DNA, 15 bp, Homo sapiens
aagattaatctctgt

SEQ ID NO: 7391 - DNA, 15 bp, Homo sapiens
caagattaatctctg

SEQ ID NO: 7392 - DNA, 15 bp, Homo sapiens
acaagattaatctct

SEQ ID NO: 7393 - DNA, 15 bp, Homo sapiens
cacaagattaatctc

SEQ ID NO: 7394 - DNA, 15 bp, Homo sapiens
ccacaagattaatct

SEQ ID NO: 7395 - DNA, 15 bp, Homo sapiens
tccacaagattaatc

SEQ ID NO: 7396 - DNA, 15 bp, Homo sapiens
atccacaagattaat

SEQ ID NO: 7397 - DNA, 15 bp, Homo sapiens
tatccacaagattaa

SEQ ID NO: 7398 - DNA, 15 bp, Homo sapiens
ttatccacaagatta

SEQ ID NO: 7399 - DNA, 15 bp, Homo sapiens
attatccacaagatt

SEQ ID NO: 7400 - DNA, 15 bp, Homo sapiens
tattatccacaagat

SEQ ID NO: 7401 - DNA, 15 bp, Homo sapiens
ttattatccacaaga

SEQ ID NO: 7402 - DNA, 15 bp, Homo sapiens
attattatccacaag

SEQ ID NO: 7403 - DNA, 15 bp, Homo sapiens
aattattatccacaa

SEQ ID NO: 7404 - DNA, 15 bp, Homo sapiens
caattattatccaca

SEQ ID NO: 7405 - DNA, 15 bp, Homo sapiens
ccaattattatccac

SEQ ID NO: 7406 - DNA, 15 bp, Homo sapiens
cccaattattatcca

SEQ ID NO: 7407 - DNA, 15 bp, Homo sapiens
tcccaattattatcc

SEQ ID NO: 7408 - DNA, 15 bp, Homo sapiens
ctcccaattattatc

SEQ ID NO: 7409 - DNA, 15 bp, Homo sapiens
tctcccaattattat

SEQ ID NO: 7410 - DNA, 15 bp, Homo sapiens
atctcccaattatta

SEQ ID NO: 7411 - DNA, 15 bp, Homo sapiens
tatctcccaattatt

SEQ ID NO: 7412 - DNA, 15 bp, Homo sapiens
gtatctcccaattat

SEQ ID NO: 7413 - DNA, 15 bp, Homo sapiens
agtatctcccaatta

SEQ ID NO: 7414 - DNA, 15 bp, Homo sapiens
gagtatctcccaatt

SEQ ID NO: 7415 - DNA, 15 bp, Homo sapiens
agagtatctcccaat

SEQ ID NO: 7416 - DNA, 15 bp, Homo sapiens
tagagtatctcccaa

SEQ ID NO: 7417 - DNA, 15 bp, Homo sapiens
atagagtatctccca

SEQ ID NO: 7418 - DNA, 15 bp, Homo sapiens
gatagagtatctccc

SEQ ID NO: 7419 - DNA, 15 bp, Homo sapiens
ggatagagtatctcc

SEQ ID NO: 7420 - DNA, 15 bp, Homo sapiens
gggatagagtatctc

SEQ ID NO: 7421 - DNA, 15 bp, Homo sapiens
agggatagagtatct

SEQ ID NO: 7422 - DNA, 15 bp, Homo sapiens
tagggatagagtatc

SEQ ID NO: 7423 - DNA, 15 bp, Homo sapiens
gtagggatagagtat

SEQ ID NO: 7424 - DNA, 15 bp, Homo sapiens
agtagggatagagta

SEQ ID NO: 7425 - DNA, 15 bp, Homo sapiens
gagtagggatagagt

SEQ ID NO: 7426 - DNA, 15 bp, Homo sapiens
agagtagggatagag

SEQ ID NO: 7427 - DNA, 15 bp, Homo sapiens
tagagtagggataga

SEQ ID NO: 7428 - DNA, 15 bp, Homo sapiens
atagagtagggatag

SEQ ID NO: 7429 - DNA, 15 bp, Homo sapiens
aatagagtagggata

SEQ ID NO: 7430 - DNA, 15 bp, Homo sapiens
aaatagagtagggat

SEQ ID NO: 7431 - DNA, 15 bp, Homo sapiens
aaaatagagtaggga

SEQ ID NO: 7432 - DNA, 15 bp, Homo sapiens
aaaaatagagtaggg

SEQ ID NO: 7433 - DNA, 15 bp, Homo sapiens
taaaaatagagtagg

SEQ ID NO: 7434 - DNA, 15 bp, Homo sapiens
ttaaaaatagagtag

SEQ ID NO: 7435 - DNA, 15 bp, Homo sapiens
gttaaaaatagagta

SEQ ID NO: 7436 - DNA, 15 bp, Homo sapiens
tgttaaaaatagagt

SEQ ID NO: 7437 - DNA, 15 bp, Homo sapiens
ctgttaaaaatagag

SEQ ID NO: 7438 - DNA, 15 bp, Homo sapiens
actgttaaaaataga

SEQ ID NO: 7439 - DNA, 15 bp, Homo sapiens
aactgttaaaaatag

SEQ ID NO: 7440 - DNA, 15 bp, Homo sapiens
aaactgttaaaaata

SEQ ID NO: 7441 - DNA, 15 bp, Homo sapiens
taaactgttaaaaat

SEQ ID NO: 7442 - DNA, 15 bp, Homo sapiens
ttaaactgttaaaaa

SEQ ID NO: 7443 - DNA, 15 bp, Homo sapiens
attaaactgttaaaa

SEQ ID NO: 7444 - DNA, 15 bp, Homo sapiens
cattaaactgttaaa

SEQ ID NO: 7445 - DNA, 15 bp, Homo sapiens
acattaaactgttaa

SEQ ID NO: 7446 - DNA, 15 bp, Homo sapiens
tacattaaactgtta

SEQ ID NO: 7447 - DNA, 15 bp, Homo sapiens
ctacattaaactgtt

SEQ ID NO: 7448 - DNA, 15 bp, Homo sapiens
actacattaaactgt

SEQ ID NO: 7449 - DNA, 15 bp, Homo sapiens
aactacattaaactg

SEQ ID NO: 7450 - DNA, 15 bp, Homo sapiens
caactacattaaact

SEQ ID NO: 7451 - DNA, 15 bp, Homo sapiens
tcaactacattaaac

SEQ ID NO: 7452 - DNA, 15 bp, Homo sapiens
ctcaactacattaaa

SEQ ID NO: 7453 - DNA, 15 bp, Homo sapiens
actcaactacattaa

SEQ ID NO: 7454 - DNA, 15 bp, Homo sapiens
cactcaactacatta

SEQ ID NO: 7455 - DNA, 15 bp, Homo sapiens
acactcaactacatt

SEQ ID NO: 7456 - DNA, 15 bp, Homo sapiens
aacactcaactacat

SEQ ID NO: 7457 - DNA, 15 bp, Homo sapiens
gaacactcaactaca

SEQ ID NO: 7458 - DNA, 15 bp, Homo sapiens
tgaacactcaactac

SEQ ID NO: 7459 - DNA, 15 bp, Homo sapiens
atgaacactcaacta

SEQ ID NO: 7460 - DNA, 15 bp, Homo sapiens
aatgaacactcaact

SEQ ID NO: 7461 - DNA, 15 bp, Homo sapiens
taatgaacactcaac

SEQ ID NO: 7462 - DNA, 15 bp, Homo sapiens
ctaatgaacactcaa

SEQ ID NO: 7463 - DNA, 15 bp, Homo sapiens
gctaatgaacactca

SEQ ID NO: 7464 - DNA, 15 bp, Homo sapiens
tgctaatgaacactc

SEQ ID NO: 7465 - DNA, 15 bp, Homo sapiens
ttgctaatgaacact

SEQ ID NO: 7466 - DNA, 15 bp, Homo sapiens
cttgctaatgaacac

SEQ ID NO: 7467 - DNA, 15 bp, Homo sapiens
acttgctaatgaaca

SEQ ID NO: 7468 - DNA, 15 bp, Homo sapiens
cacttgctaatgaac

SEQ ID NO: 7469 - DNA, 15 bp, Homo sapiens
ccacttgctaatgaa

SEQ ID NO: 7470 - DNA, 15 bp, Homo sapiens
accacttgctaatga

SEQ ID NO: 7471 - DNA, 15 bp, Homo sapiens
aaccacttgctaatg

SEQ ID NO: 7472 - DNA, 15 bp, Homo sapiens
taaccacttgctaat

SEQ ID NO: 7473 - DNA, 15 bp, Homo sapiens
gtaaccacttgctaa

SEQ ID NO: 7474 - DNA, 15 bp, Homo sapiens
agtaaccacttgcta

SEQ ID NO: 7475 - DNA, 15 bp, Homo sapiens
aagtaaccacttgct

SEQ ID NO: 7476 - DNA, 15 bp, Homo sapiens
aaagtaaccacttgc

SEQ ID NO: 7477 - DNA, 15 bp, Homo sapiens
caaagtaaccacttg

SEQ ID NO: 7478 - DNA, 15 bp, Homo sapiens
tcaaagtaaccactt

SEQ ID NO: 7479 - DNA, 15 bp, Homo sapiens
ttcaaagtaaccact

SEQ ID NO: 7480 - DNA, 15 bp, Homo sapiens
attcaaagtaaccac

SEQ ID NO: 7481 - DNA, 15 bp, Homo sapiens
tattcaaagtaacca

SEQ ID NO: 7482 - DNA, 15 bp, Homo sapiens
ttattcaaagtaacc

SEQ ID NO: 7483 - DNA, 15 bp, Homo sapiens
attattcaaagtaac

SEQ ID NO: 7484 - DNA, 15 bp, Homo sapiens
tattattcaaagtaa

SEQ ID NO: 7485 - DNA, 15 bp, Homo sapiens
gtattattcaaagta

SEQ ID NO: 7486 - DNA, 15 bp, Homo sapiens
agtattattcaaagt

SEQ ID NO: 7487 - DNA, 15 bp, Homo sapiens
cagtattattcaaag

SEQ ID NO: 7488 - DNA, 15 bp, Homo sapiens
ccagtattattcaaa

SEQ ID NO: 7489 - DNA, 15 bp, Homo sapiens
gccagtattattcaa

SEQ ID NO: 7490 - DNA, 15 bp, Homo sapiens
tgccagtattattca

SEQ ID NO: 7491 - DNA, 15 bp, Homo sapiens
gtgccagtattattc

SEQ ID NO: 7492 - DNA, 15 bp, Homo sapiens
tgtgccagtattatt

SEQ ID NO: 7493 - DNA, 15 bp, Homo sapiens
atgtgccagtattat

SEQ ID NO: 7494 - DNA, 15 bp, Homo sapiens
aatgtgccagtatta

SEQ ID NO: 7495 - DNA, 15 bp, Homo sapiens
aaatgtgccagtatt

SEQ ID NO: 7496 - DNA, 15 bp, Homo sapiens
caaatgtgccagtat

SEQ ID NO: 7497 - DNA, 15 bp, Homo sapiens
tcaaatgtgccagta

SEQ ID NO: 7498 - DNA, 15 bp, Homo sapiens
ttcaaatgtgccagt

SEQ ID NO: 7499 - DNA, 15 bp, Homo sapiens
cttcaaatgtgccag

SEQ ID NO: 7500 - DNA, 15 bp, Homo sapiens
gcttcaaatgtgcca

SEQ ID NO: 7501 - DNA, 15 bp, Homo sapiens
tgcttcaaatgtgcc

SEQ ID NO: 7502 - DNA, 15 bp, Homo sapiens
atgcttcaaatgtgc

SEQ ID NO: 7503 - DNA, 15 bp, Homo sapiens
aatgcttcaaatgtg

SEQ ID NO: 7504 - DNA, 15 bp, Homo sapiens
caatgcttcaaatgt

SEQ ID NO: 7505 - DNA, 15 bp, Homo sapiens
tcaatgcttcaaatg

SEQ ID NO: 7506 - DNA, 15 bp, Homo sapiens
ttcaatgcttcaaat

SEQ ID NO: 7507 - DNA, 15 bp, Homo sapiens
gttcaatgcttcaaa

SEQ ID NO: 7508 - DNA, 15 bp, Homo sapiens
agttcaatgcttcaa

SEQ ID NO: 7509 - DNA, 15 bp, Homo sapiens
aagttcaatgcttca

SEQ ID NO: 7510 - DNA, 15 bp, Homo sapiens
caagttcaatgcttc

SEQ ID NO: 7511 - DNA, 15 bp, Homo sapiens
acaagttcaatgctt

SEQ ID NO: 7512 - DNA, 15 bp, Homo sapiens
aacaagttcaatgct

SEQ ID NO: 7513 - DNA, 15 bp, Homo sapiens
aaacaagttcaatgc

SEQ ID NO: 7514 - DNA, 15 bp, Homo sapiens
caaacaagttcaatg

SEQ ID NO: 7515 - DNA, 15 bp, Homo sapiens
tcaaacaagttcaat

SEQ ID NO: 7516 - DNA, 15 bp, Homo sapiens
atcaaacaagttcaa

SEQ ID NO: 7517 - DNA, 15 bp, Homo sapiens
tatcaaacaagttca

SEQ ID NO: 7518 - DNA, 15 bp, Homo sapiens
ttatcaaacaagttc

SEQ ID NO: 7519 - DNA, 15 bp, Homo sapiens
attatcaaacaagtt

SEQ ID NO: 7520 - DNA, 15 bp, Homo sapiens
cattatcaaacaagt

SEQ ID NO: 7521 - DNA, 15 bp, Homo sapiens
acattatcaaacaag

SEQ ID NO: 7522 - DNA, 15 bp, Homo sapiens
tacattatcaaacaa

SEQ ID NO: 7523 - DNA, 15 bp, Homo sapiens
atacattatcaaaca

SEQ ID NO: 7524 - DNA, 15 bp, Homo sapiens
catacattatcaaac

SEQ ID NO: 7525 - DNA, 15 bp, Homo sapiens
acatacattatcaaa

SEQ ID NO: 7526 - DNA, 15 bp, Homo sapiens
gacatacattatcaa

SEQ ID NO: 7527 - DNA, 15 bp, Homo sapiens
ggacatacattatca

SEQ ID NO: 7528 - DNA, 15 bp, Homo sapiens
gggacatacattatc

SEQ ID NO: 7529 - DNA, 15 bp, Homo sapiens
tgggacatacattat

SEQ ID NO: 7530 - DNA, 15 bp, Homo sapiens
ctgggacatacatta

SEQ ID NO: 7531 - DNA, 15 bp, Homo sapiens
tctgggacatacatt

SEQ ID NO: 7532 - DNA, 15 bp, Homo sapiens
ttctgggacatacat

SEQ ID NO: 7533 - DNA, 15 bp, Homo sapiens
cttctgggacataca

SEQ ID NO: 7534 - DNA, 15 bp, Homo sapiens
tcttctgggacatac

SEQ ID NO: 7535 - DNA, 15 bp, Homo sapiens
gtcttctgggacata

SEQ ID NO: 7536 - DNA, 15 bp, Homo sapiens
tgtcttctgggacat

SEQ ID NO: 7537 - DNA, 15 bp, Homo sapiens
ctgtcttctgggaca

SEQ ID NO: 7538 - DNA, 15 bp, Homo sapiens
cctgtcttctgggac

SEQ ID NO: 7539 - DNA, 15 bp, Homo sapiens
acctgtcttctggga

SEQ ID NO: 7540 - DNA, 15 bp, Homo sapiens
tacctgtcttctggg

SEQ ID NO: 7541 - DNA, 15 bp, Homo sapiens
atacctgtcttctgg

SEQ ID NO: 7542 - DNA, 15 bp, Homo sapiens
aatacctgtcttctg

SEQ ID NO: 7543 - DNA, 15 bp, Homo sapiens
taatacctgtcttct

SEQ ID NO: 7544 - DNA, 15 bp, Homo sapiens
ataatacctgtcttc

SEQ ID NO: 7545 - DNA, 15 bp, Homo sapiens
aataatacctgtctt

SEQ ID NO: 7546 - DNA, 15 bp, Homo sapiens
caataatacctgtct

SEQ ID NO: 7547 - DNA, 15 bp, Homo sapiens
acaataatacctgtc

SEQ ID NO: 7548 - DNA, 15 bp, Homo sapiens
tacaataatacctgt

SEQ ID NO: 7549 - DNA, 15 bp, Homo sapiens
atacaataatacctg

SEQ ID NO: 7550 - DNA, 15 bp, Homo sapiens
aatacaataatacct

SEQ ID NO: 7551 - DNA, 15 bp, Homo sapiens
aaatacaataatacc

SEQ ID NO: 7552 - DNA, 15 bp, Homo sapiens
taaatacaataatac

SEQ ID NO: 7553 - DNA, 15 bp, Homo sapiens
ctaaatacaataata

SEQ ID NO: 7554 - DNA, 15 bp, Homo sapiens
gctaaatacaataat

SEQ ID NO: 7555 - DNA, 15 bp, Homo sapiens
tgctaaatacaataa

SEQ ID NO: 7556 - DNA, 15 bp, Homo sapiens
gtgctaaatacaata

SEQ ID NO: 7557 - DNA, 15 bp, Homo sapiens
tgtgctaaatacaat

SEQ ID NO: 7558 - DNA, 15 bp, Homo sapiens
ttgtgctaaatacaa

SEQ ID NO: 7559 - DNA, 15 bp, Homo sapiens
tttgtgctaaataca

SEQ ID NO: 7560 - DNA, 15 bp, Homo sapiens
ctttgtgctaaatac

SEQ ID NO: 7561 - DNA, 15 bp, Homo sapiens
gctttgtgctaaata

SEQ ID NO: 7562 - DNA, 15 bp, Homo sapiens
tgctttgtgctaaat

SEQ ID NO: 7563 - DNA, 15 bp, Homo sapiens
ttgctttgtgctaaa

SEQ ID NO: 7564 - DNA, 15 bp, Homo sapiens
tttgctttgtgctaa

SEQ ID NO: 7565 - DNA, 15 bp, Homo sapiens
ctttgctttgtgcta

SEQ ID NO: 7566 - DNA, 15 bp, Homo sapiens
cctttgctttgtgct

SEQ ID NO: 7567 - DNA, 15 bp, Homo sapiens
ccctttgctttgtgc

SEQ ID NO: 7568 - DNA, 15 bp, Homo sapiens
tccctttgctttgtg

SEQ ID NO: 7569 - DNA, 15 bp, Homo sapiens
ttccctttgctttgt

SEQ ID NO: 7570 - DNA, 15 bp, Homo sapiens
cttccctttgctttg

SEQ ID NO: 7571 - DNA, 15 bp, Homo sapiens
tcttccctttgcttt

SEQ ID NO: 7572 - DNA, 15 bp, Homo sapiens
ttcttccctttgctt

SEQ ID NO: 7573 - DNA, 15 bp, Homo sapiens
cttcttccctttgct

SEQ ID NO: 7574 - DNA, 15 bp, Homo sapiens
tcttcttccctttgc

SEQ ID NO: 7575 - DNA, 15 bp, Homo sapiens
ttcttcttccctttg

SEQ ID NO: 7576 - DNA, 15 bp, Homo sapiens
tttcttcttcccttt

SEQ ID NO: 7577 - DNA, 15 bp, Homo sapiens
gtttcttcttccctt

SEQ ID NO: 7578 - DNA, 15 bp, Homo sapiens
tgtttcttcttccct

SEQ ID NO: 7579 - DNA, 15 bp, Homo sapiens
gtgtttcttcttccc

SEQ ID NO: 7580 - DNA, 15 bp, Homo sapiens
agtgtttcttcttcc

SEQ ID NO: 7581 - DNA, 15 bp, Homo sapiens
cagtgtttcttcttc

SEQ ID NO: 7582 - DNA, 15 bp, Homo sapiens
acagtgtttcttctt

SEQ ID NO: 7583 - DNA, 15 bp, Homo sapiens
aacagtgtttcttct

SEQ ID NO: 7584 - DNA, 15 bp, Homo sapiens
aaacagtgtttcttc

SEQ ID NO: 7585 - DNA, 15 bp, Homo sapiens
taaacagtgtttctt

SEQ ID NO: 7586 - DNA, 15 bp, Homo sapiens
ataaacagtgtttct

SEQ ID NO: 7587 - DNA, 15 bp, Homo sapiens
cataaacagtgtttc

SEQ ID NO: 7588 - DNA, 15 bp, Homo sapiens
acataaacagtgttt

SEQ ID NO: 7589 - DNA, 15 bp, Homo sapiens
gacataaacagtgtt

SEQ ID NO: 7590 - DNA, 15 bp, Homo sapiens
ggacataaacagtgt

SEQ ID NO: 7591 - DNA, 15 bp, Homo sapiens
tggacataaacagtg

SEQ ID NO: 7592 - DNA, 15 bp, Homo sapiens
ttggacataaacagt

SEQ ID NO: 7593 - DNA, 15 bp, Homo sapiens
tttggacataaacag

SEQ ID NO: 7594 - DNA, 15 bp, Homo sapiens
ttttggacataaaca

SEQ ID NO: 7595 - DNA, 15 bp, Homo sapiens
gttttggacataaac

SEQ ID NO: 7596 - DNA, 15 bp, Homo sapiens
agttttggacataaa

SEQ ID NO: 7597 - DNA, 15 bp, Homo sapiens
tagttttggacataa

SEQ ID NO: 7598 - DNA, 15 bp, Homo sapiens
atagttttggacata

SEQ ID NO: 7599 - DNA, 15 bp, Homo sapiens
catagttttggacat

SEQ ID NO: 7600 - DNA, 15 bp, Homo sapiens
ccatagttttggaca

SEQ ID NO: 7601 - DNA, 15 bp, Homo sapiens
cccatagttttggac

SEQ ID NO: 7602 - DNA, 15 bp, Homo sapiens
ccccatagttttgga

SEQ ID NO: 7603 - DNA, 15 bp, Homo sapiens
gccccatagttttgg

SEQ ID NO: 7604 - DNA, 15 bp, Homo sapiens
tgccccatagttttg

SEQ ID NO: 7605 - DNA, 15 bp, Homo sapiens
ctgccccatagtttt

SEQ ID NO: 7606 - DNA, 15 bp, Homo sapiens
actgccccatagttt

SEQ ID NO: 7607 - DNA, 15 bp, Homo sapiens
cactgccccatagtt

SEQ ID NO: 7608 - DNA, 15 bp, Homo sapiens
ccactgccccatagt

SEQ ID NO: 7609 - DNA, 15 bp, Homo sapiens
accactgccccatag

SEQ ID NO: 7610 - DNA, 15 bp, Homo sapiens
gaccactgccccata

SEQ ID NO: 7611 - DNA, 15 bp, Homo sapiens
agaccactgccccat

SEQ ID NO: 7612 - DNA, 15 bp, Homo sapiens
aagaccactgcccca

SEQ ID NO: 7613 - DNA, 15 bp, Homo sapiens
gaagaccactgcccc

SEQ ID NO: 7614 - DNA, 15 bp, Homo sapiens
agaagaccactgccc

SEQ ID NO: 7615 - DNA, 15 bp, Homo sapiens
gagaagaccactgcc

SEQ ID NO: 7616 - DNA, 15 bp, Homo sapiens
agagaagaccactgc

SEQ ID NO: 7617 - DNA, 15 bp, Homo sapiens
aagagaagaccactg

SEQ ID NO: 7618 - DNA, 15 bp, Homo sapiens
aaagagaagaccact

SEQ ID NO: 7619 - DNA, 15 bp, Homo sapiens
aaaagagaagaccac

SEQ ID NO: 7620 - DNA, 15 bp, Homo sapiens
taaaagagaagacca

SEQ ID NO: 7621 - DNA, 15 bp, Homo sapiens
gtaaaagagaagacc

SEQ ID NO: 7622 - DNA, 15 bp, Homo sapiens
agtaaaagagaagac

SEQ ID NO: 7623 - DNA, 15 bp, Homo sapiens
aagtaaaagagaaga

SEQ ID NO: 7624 - DNA, 15 bp, Homo sapiens
aaagtaaaagagaag

SEQ ID NO: 7625 - DNA, 15 bp, Homo sapiens
aaaagtaaaagagaa

SEQ ID NO: 7626 - DNA, 15 bp, Homo sapiens
gaaaagtaaaagaga

SEQ ID NO: 7627 - DNA, 15 bp, Homo sapiens
agaaaagtaaaagag

SEQ ID NO: 7628 - DNA, 15 bp, Homo sapiens
aagaaaagtaaaaga

SEQ ID NO: 7629 - DNA, 15 bp, Homo sapiens
aaagaaaagtaaaag

SEQ ID NO: 7630 - DNA, 15 bp, Homo sapiens
caaagaaaagtaaaa

SEQ ID NO: 7631 - DNA, 15 bp, Homo sapiens
gcaaagaaaagtaaa

SEQ ID NO: 7632 - DNA, 15 bp, Homo sapiens
agcaaagaaaagtaa

SEQ ID NO: 7633 - DNA, 15 bp, Homo sapiens
cagcaaagaaaagta

SEQ ID NO: 7634 - DNA, 15 bp, Homo sapiens
gcagcaaagaaaagt

SEQ ID NO: 7635 - DNA, 15 bp, Homo sapiens
agcagcaaagaaaag

SEQ ID NO: 7636 - DNA, 15 bp, Homo sapiens
cagcagcaaagaaaa

SEQ ID NO: 7637 - DNA, 15 bp, Homo sapiens
acagcagcaaagaaa

SEQ ID NO: 7638 - DNA, 15 bp, Homo sapiens
aacagcagcaaagaa

SEQ ID NO: 7639 - DNA, 15 bp, Homo sapiens
gaacagcagcaaaga

SEQ ID NO: 7640 - DNA, 15 bp, Homo sapiens
tgaacagcagcaaag

SEQ ID NO: 7641 - DNA, 15 bp, Homo sapiens
atgaacagcagcaaa

SEQ ID NO: 7642 - DNA, 15 bp, Homo sapiens
catgaacagcagcaa

SEQ ID NO: 7643 - DNA, 15 bp, Homo sapiens
tcatgaacagcagca

SEQ ID NO: 7644 - DNA, 15 bp, Homo sapiens
ttcatgaacagcagc

SEQ ID NO: 7645 - DNA, 15 bp, Homo sapiens
cttcatgaacagcag

SEQ ID NO: 7646 - DNA, 15 bp, Homo sapiens
gcttcatgaacagca

SEQ ID NO: 7647 - DNA, 15 bp, Homo sapiens
agcttcatgaacagc

SEQ ID NO: 7648 - DNA, 15 bp, Homo sapiens
aagcttcatgaacag

SEQ ID NO: 7649 - DNA, 15 bp, Homo sapiens
caagcttcatgaaca

SEQ ID NO: 7650 - DNA, 15 bp, Homo sapiens
acaagcttcatgaac

SEQ ID NO: 7651 - DNA, 15 bp, Homo sapiens
aacaagcttcatgaa

SEQ ID NO: 7652 - DNA, 15 bp, Homo sapiens
taacaagcttcatga

SEQ ID NO: 7653 - DNA, 15 bp, Homo sapiens
gtaacaagcttcatg

SEQ ID NO: 7654 - DNA, 15 bp, Homo sapiens
ggtaacaagcttcat

SEQ ID NO: 7655 - DNA, 15 bp, Homo sapiens
aggtaacaagcttca

SEQ ID NO: 7656 - DNA, 15 bp, Homo sapiens
aaggtaacaagcttc

SEQ ID NO: 7657 - DNA, 15 bp, Homo sapiens
aaaggtaacaagctt

SEQ ID NO: 7658 - DNA, 15 bp, Homo sapiens
aaaaggtaacaagct

SEQ ID NO: 7659 - DNA, 15 bp, Homo sapiens
gaaaaggtaacaagc

SEQ ID NO: 7660 - DNA, 15 bp, Homo sapiens
cgaaaaggtaacaag

SEQ ID NO: 7661 - DNA, 15 bp, Homo sapiens
gcgaaaaggtaacaa

SEQ ID NO: 7662 - DNA, 15 bp, Homo sapiens
agcgaaaaggtaaca

SEQ ID NO: 7663 - DNA, 15 bp, Homo sapiens
cagcgaaaaggtaac

SEQ ID NO: 7664 - DNA, 15 bp, Homo sapiens
acagcgaaaaggtaa

SEQ ID NO: 7665 - DNA, 15 bp, Homo sapiens
gacagcgaaaaggta

SEQ ID NO: 7666 - DNA, 15 bp, Homo sapiens
agacagcgaaaaggt

SEQ ID NO: 7667 - DNA, 15 bp, Homo sapiens
aagacagcgaaaagg

SEQ ID NO: 7668 - DNA, 15 bp, Homo sapiens
aaagacagcgaaaag

SEQ ID NO: 7669 - DNA, 15 bp, Homo sapiens
aaaagacagcgaaaa

SEQ ID NO: 7670 - DNA, 15 bp, Homo sapiens
aaaaagacagcgaaa

SEQ ID NO: 7671 - DNA, 15 bp, Homo sapiens
aaaaaagacagcgaa

SEQ ID NO: 7672 - DNA, 15 bp, Homo sapiens
aaaaaaagacagcga

SEQ ID NO: 7673 - DNA, 15 bp, Homo sapiens
aaaaaaaagacagcg

SEQ ID NO: 7674 - DNA, 15 bp, Homo sapiens
caaaaaaaagacagc

SEQ ID NO: 7675 - DNA, 15 bp, Homo sapiens
tcaaaaaaaagacag

SEQ ID NO: 7676 - DNA, 15 bp, Homo sapiens
ctcaaaaaaaagaca

SEQ ID NO: 7677 - DNA, 15 bp, Homo sapiens
tctcaaaaaaaagac

SEQ ID NO: 7678 - DNA, 15 bp, Homo sapiens
gtctcaaaaaaaaga

SEQ ID NO: 7679 - DNA, 15 bp, Homo sapiens
cgtctcaaaaaaaag

SEQ ID NO: 7680 - DNA, 15 bp, Homo sapiens
ccgtctcaaaaaaaa

SEQ ID NO: 7681 - DNA, 15 bp, Homo sapiens
tccgtctcaaaaaaa

SEQ ID NO: 7682 - DNA, 15 bp, Homo sapiens
ctccgtctcaaaaaa

SEQ ID NO: 7683 - DNA, 15 bp, Homo sapiens
actccgtctcaaaaa

SEQ ID NO: 7684 - DNA, 15 bp, Homo sapiens
gactccgtctcaaaa

SEQ ID NO: 7685 - DNA, 15 bp, Homo sapiens
ggactccgtctcaaa

SEQ ID NO: 7686 - DNA, 15 bp, Homo sapiens
aggactccgtctcaa

SEQ ID NO: 7687 - DNA, 15 bp, Homo sapiens
caggactccgtctca

SEQ ID NO: 7688 - DNA, 15 bp, Homo sapiens
gcaggactccgtctc

SEQ ID NO: 7689 - DNA, 15 bp, Homo sapiens
agcaggactccgtct

SEQ ID NO: 7690 - DNA, 15 bp, Homo sapiens
gagcaggactccgtc

SEQ ID NO: 7691 - DNA, 15 bp, Homo sapiens
agagcaggactccgt

SEQ ID NO: 7692 - DNA, 15 bp, Homo sapiens
cagagcaggactccg

SEQ ID NO: 7693 - DNA, 15 bp, Homo sapiens
acagagcaggactcc

SEQ ID NO: 7694 - DNA, 15 bp, Homo sapiens
gacagagcaggactc

SEQ ID NO: 7695 - DNA, 15 bp, Homo sapiens
cgacagagcaggact

SEQ ID NO: 7696 - DNA, 15 bp, Homo sapiens
gcgacagagcaggac

SEQ ID NO: 7697 - DNA, 15 bp, Homo sapiens
ggcgacagagcagga

SEQ ID NO: 7698 - DNA, 15 bp, Homo sapiens
gggcgacagagcagg

SEQ ID NO: 7699 - DNA, 15 bp, Homo sapiens
tgggcgacagagcag

SEQ ID NO: 7700 - DNA, 15 bp, Homo sapiens
tctgggcgacagagc

SEQ ID NO: 7701 - DNA, 15 bp, Homo sapiens
atctgggcgacagag

SEQ ID NO: 7702 - DNA, 15 bp, Homo sapiens
aatctgggcgacaga

SEQ ID NO: 7703 - DNA, 15 bp, Homo sapiens
caatctgggcgacag

SEQ ID NO: 7704 - DNA, 15 bp, Homo sapiens
ccaatctgggcgaca

SEQ ID NO: 7705 - DNA, 15 bp, Homo sapiens
tccaatctgggcgac

SEQ ID NO: 7706 - DNA, 15 bp, Homo sapiens
ctccaatctgggcga

SEQ ID NO: 7707 - DNA, 15 bp, Homo sapiens
actccaatctgggcg

SEQ ID NO: 7708 - DNA, 15 bp, Homo sapiens
cactccaatctgggc

SEQ ID NO: 7709 - DNA, 15 bp, Homo sapiens
gcactccaatctggg

SEQ ID NO: 7710 - DNA, 15 bp, Homo sapiens
tgcactccaatctgg

SEQ ID NO: 7711 - DNA, 15 bp, Homo sapiens
ctgcactccaatctg

SEQ ID NO: 7712 - DNA, 15 bp, Homo sapiens
actgcactccaatct

SEQ ID NO: 7713 - DNA, 15 bp, Homo sapiens
cactgcactccaatc

SEQ ID NO: 7714 - DNA, 15 bp, Homo sapiens
ccactgcactccaat

SEQ ID NO: 7715 - DNA, 15 bp, Homo sapiens
accactgcactccaa

SEQ ID NO: 7716 - DNA, 15 bp, Homo sapiens
aagatcgcaccactg

SEQ ID NO: 7717 - DNA, 15 bp, Homo sapiens
caagatcgcaccact

SEQ ID NO: 7718 - DNA, 15 bp, Homo sapiens
ccaagatcgcaccac

SEQ ID NO: 7719 - DNA, 15 bp, Homo sapiens
gccaagatcgcacca

SEQ ID NO: 7720 - DNA, 15 bp, Homo sapiens
agccaagatcgcacc

SEQ ID NO: 7721 - DNA, 15 bp, Homo sapiens
gagccaagatcgcac

SEQ ID NO: 7722 - DNA, 15 bp, Homo sapiens
tgagccaagatcgca

SEQ ID NO: 7723 - DNA, 15 bp, Homo sapiens
gtgagccaagatcgc

SEQ ID NO: 7724 - DNA, 15 bp, Homo sapiens
agtgagccaagatcg

SEQ ID NO: 7725 - DNA, 15 bp, Homo sapiens
cagtgagccaagatc

SEQ ID NO: 7726 - DNA, 15 bp, Homo sapiens
gggaggtggaggttg

SEQ ID NO: 7727 - DNA, 15 bp, Homo sapiens
tgggaggtggaggtt

SEQ ID NO: 7728 - DNA, 15 bp, Homo sapiens
ctgggaggtggaggt

SEQ ID NO: 7729 - DNA, 15 bp, Homo sapiens
gctgggaggtggagg

SEQ ID NO: 7730 - DNA, 15 bp, Homo sapiens
agctgggaggtggag

SEQ ID NO: 7731 - DNA, 15 bp, Homo sapiens
aagctgggaggtgga

SEQ ID NO: 7732 - DNA, 15 bp, Homo sapiens
gaagctgggaggtgg

SEQ ID NO: 7733 - DNA, 15 bp, Homo sapiens
tgaagctgggaggtg

SEQ ID NO: 7734 - DNA, 15 bp, Homo sapiens
ttgaagctgggaggt

SEQ ID NO: 7735 - DNA, 15 bp, Homo sapiens
cttgaagctgggagg

SEQ ID NO: 7736 - DNA, 15 bp, Homo sapiens
acttgaagctgggag

SEQ ID NO: 7737 - DNA, 15 bp, Homo sapiens
cacttgaagctggga

SEQ ID NO: 7738 - DNA, 15 bp, Homo sapiens
tcacttgaagctggg

SEQ ID NO: 7739 - DNA, 15 bp, Homo sapiens
atcacttgaagctgg

SEQ ID NO: 7740 - DNA, 15 bp, Homo sapiens
aatcacttgaagctg

SEQ ID NO: 7741 - DNA, 15 bp, Homo sapiens
gaatcacttgaagct

SEQ ID NO: 7742 - DNA, 15 bp, Homo sapiens
agaatcacttgaagc

SEQ ID NO: 7743 - DNA, 15 bp, Homo sapiens
gagaatcacttgaag

SEQ ID NO: 7744 - DNA, 15 bp, Homo sapiens
cgggaggctgaggca

SEQ ID NO: 7745 - DNA, 15 bp, Homo sapiens
tcgggaggctgaggc

SEQ ID NO: 7746 - DNA, 15 bp, Homo sapiens
ctcgggaggctgagg

SEQ ID NO: 7747 - DNA, 15 bp, Homo sapiens
actcgggaggctgag

SEQ ID NO: 7748 - DNA, 15 bp, Homo sapiens
tactcgggaggctga

SEQ ID NO: 7749 - DNA, 15 bp, Homo sapiens
ctactcgggaggctg

SEQ ID NO: 7750 - DNA, 15 bp, Homo sapiens
gctactcgggaggct

SEQ ID NO: 7751 - DNA, 15 bp, Homo sapiens
agctactcgggaggc

SEQ ID NO: 7752 - DNA, 15 bp, Homo sapiens
cagctactcgggagg

SEQ ID NO: 7753 - DNA, 15 bp, Homo sapiens
ccagctactcgggag

SEQ ID NO: 7754 - DNA, 15 bp, Homo sapiens
cccagctactcggga

SEQ ID NO: 7755 - DNA, 15 bp, Homo sapiens
tcccagctactcggg

SEQ ID NO: 7756 - DNA, 15 bp, Homo sapiens
atcccagctactcgg

SEQ ID NO: 7757 - DNA, 15 bp, Homo sapiens
aatcccagctactcg

SEQ ID NO: 7758 - DNA, 15 bp, Homo sapiens
gcatgcctgtaatcc

SEQ ID NO: 7759 - DNA, 15 bp, Homo sapiens
tgcatgcctgtaatc

SEQ ID NO: 7760 - DNA, 15 bp, Homo sapiens
gtgcatgcctgtaat

SEQ ID NO: 7761 - DNA, 15 bp, Homo sapiens
ggtgcatgcctgtaa

SEQ ID NO: 7762 - DNA, 15 bp, Homo sapiens
tggtgcatgcctgta

SEQ ID NO: 7763 - DNA, 15 bp, Homo sapiens
gtggtgcatgcctgt

SEQ ID NO: 7764 - DNA, 15 bp, Homo sapiens
ggtggtgcatgcctg

SEQ ID NO: 7765 - DNA, 15 bp, Homo sapiens
tggtggtgcatgcct

SEQ ID NO: 7766 - DNA, 15 bp, Homo sapiens
gtggtggtgcatgcc

SEQ ID NO: 7767 - DNA, 15 bp, Homo sapiens
cgtggtggtgcatgc

SEQ ID NO: 7768 - DNA, 15 bp, Homo sapiens
gcgtggtggtgcatg

SEQ ID NO: 7769 - DNA, 15 bp, Homo sapiens
ggcgtggtggtgcat

SEQ ID NO: 7770 - DNA, 15 bp, Homo sapiens
gggcgtggtggtgca

SEQ ID NO: 7771 - DNA, 15 bp, Homo sapiens
cgggcgtggtggtgc

SEQ ID NO: 7772 - DNA, 15 bp, Homo sapiens
cccgggcgtggtggt

SEQ ID NO: 7773 - DNA, 15 bp, Homo sapiens
acccgggcgtggtgg

SEQ ID NO: 7774 - DNA, 15 bp, Homo sapiens
tacccgggcgtggtg

SEQ ID NO: 7775 - DNA, 15 bp, Homo sapiens
ttacccgggcgtggt

SEQ ID NO: 7776 - DNA, 15 bp, Homo sapiens
attacccgggcgtgg

SEQ ID NO: 7777 - DNA, 15 bp, Homo sapiens
aattacccgggcgtg

SEQ ID NO: 7778 - DNA, 15 bp, Homo sapiens
aaattacccgggcgt

SEQ ID NO: 7779 - DNA, 15 bp, Homo sapiens
aaaattacccgggcg

SEQ ID NO: 7780 - DNA, 15 bp, Homo sapiens
aaaaattacccgggc

SEQ ID NO: 7781 - DNA, 15 bp, Homo sapiens
aaaaaattacccggg

SEQ ID NO: 7782 - DNA, 15 bp, Homo sapiens
caaaaaattacccgg

SEQ ID NO: 7783 - DNA, 15 bp, Homo sapiens
acaaaaaattacccg

SEQ ID NO: 7784 - DNA, 15 bp, Homo sapiens
tacaaaaaattaccc

SEQ ID NO: 7785 - DNA, 15 bp, Homo sapiens
atacaaaaaattacc

SEQ ID NO: 7786 - DNA, 15 bp, Homo sapiens
aatacaaaaaattac

SEQ ID NO: 7787 - DNA, 15 bp, Homo sapiens
aaatacaaaaaatta

SEQ ID NO: 7788 - DNA, 15 bp, Homo sapiens
agaaaccccgtctct

SEQ ID NO: 7789 - DNA, 15 bp, Homo sapiens
gagaaaccccgtctc

SEQ ID NO: 7790 - DNA, 15 bp, Homo sapiens
ggagaaaccccgtct

SEQ ID NO: 7791 - DNA, 15 bp, Homo sapiens
tggagaaaccccgtc

SEQ ID NO: 7792 - DNA, 15 bp, Homo sapiens
atggagaaaccccgt

SEQ ID NO: 7793 - DNA, 15 bp, Homo sapiens
catggagaaaccccg

SEQ ID NO: 7794 - DNA, 15 bp, Homo sapiens
acatggagaaacccc

SEQ ID NO: 7795 - DNA, 15 bp, Homo sapiens
aacatggagaaaccc

SEQ ID NO: 7796 - DNA, 15 bp, Homo sapiens
tcaacatggagaaac

SEQ ID NO: 7797 - DNA, 15 bp, Homo sapiens
gtcaacatggagaaa

SEQ ID NO: 7798 - DNA, 15 bp, Homo sapiens
ggtcaacatggagaa

SEQ ID NO: 7799 - DNA, 15 bp, Homo sapiens
tggtcaacatggaga

SEQ ID NO: 7800 - DNA, 15 bp, Homo sapiens
ctggtcaacatggag

SEQ ID NO: 7801 - DNA, 15 bp, Homo sapiens
cctggtcaacatgga

SEQ ID NO: 7802 - DNA, 15 bp, Homo sapiens
ggagaccagcctggt

SEQ ID NO: 7803 - DNA, 15 bp, Homo sapiens
tggagaccagcctgg

SEQ ID NO: 7804 - DNA, 15 bp, Homo sapiens
ctggagaccagcctg

SEQ ID NO: 7805 - DNA, 15 bp, Homo sapiens
gctggagaccagcct

SEQ ID NO: 7806 - DNA, 15 bp, Homo sapiens
agctggagaccagcc

SEQ ID NO: 7807 - DNA, 15 bp, Homo sapiens
gagctggagaccagc

SEQ ID NO: 7808 - DNA, 15 bp, Homo sapiens
ggagctggagaccag

SEQ ID NO: 7809 - DNA, 15 bp, Homo sapiens
aggagctggagacca

SEQ ID NO: 7810 - DNA, 15 bp, Homo sapiens
caggagctggagacc

SEQ ID NO: 7811 - DNA, 15 bp, Homo sapiens
ccaggagctggagac

SEQ ID NO: 7812 - DNA, 15 bp, Homo sapiens
gccaggagctggaga

SEQ ID NO: 7813 - DNA, 15 bp, Homo sapiens
ggccaggagctggag

SEQ ID NO: 7814 - DNA, 15 bp, Homo sapiens
aggccaggagctgga

SEQ ID NO: 7815 - DNA, 15 bp, Homo sapiens
aaggccaggagctgg

SEQ ID NO: 7816 - DNA, 15 bp, Homo sapiens
taaggccaggagctg

SEQ ID NO: 7817 - DNA, 15 bp, Homo sapiens
ctaaggccaggagct

SEQ ID NO: 7818 - DNA, 15 bp, Homo sapiens
cctaaggccaggagc

SEQ ID NO: 7819 - DNA, 15 bp, Homo sapiens
acctaaggccaggag

SEQ ID NO: 7820 - DNA, 15 bp, Homo sapiens
cacctaaggccagga

SEQ ID NO: 7821 - DNA, 15 bp, Homo sapiens
tcacctaaggccagg

SEQ ID NO: 7822 - DNA, 15 bp, Homo sapiens
atcacctaaggccag

SEQ ID NO: 7823 - DNA, 15 bp, Homo sapiens
gatcacctaaggcca

SEQ ID NO: 7824 - DNA, 15 bp, Homo sapiens
ggatcacctaaggcc

SEQ ID NO: 7825 - DNA, 15 bp, Homo sapiens
cggatcacctaaggc

SEQ ID NO: 7826 - DNA, 15 bp, Homo sapiens
gcggatcacctaagg

SEQ ID NO: 7827 - DNA, 15 bp, Homo sapiens
ggcggatcacctaag

SEQ ID NO: 7828 - DNA, 15 bp, Homo sapiens
aggcggatcacctaa

SEQ ID NO: 7829 - DNA, 15 bp, Homo sapiens
caggcggatcaccta

SEQ ID NO: 7830 - DNA, 15 bp, Homo sapiens
gcaggcggatcacct

SEQ ID NO: 7831 - DNA, 15 bp, Homo sapiens
ggcaggcggatcacc

SEQ ID NO: 7832 - DNA, 15 bp, Homo sapiens
aggcaggcggatcac

SEQ ID NO: 7833 - DNA, 15 bp, Homo sapiens
gaggcaggcggatca

SEQ ID NO: 7834 - DNA, 15 bp, Homo sapiens
tgaggcaggcggatc

SEQ ID NO: 7835 - DNA, 15 bp, Homo sapiens
ctgaggcaggcggat

SEQ ID NO: 7836 - DNA, 15 bp, Homo sapiens
gctgaggcaggcgga

SEQ ID NO: 7837 - DNA, 15 bp, Homo sapiens
agctgaggcaggcgg

SEQ ID NO: 7838 - DNA, 15 bp, Homo sapiens
aagctgaggcaggcg

SEQ ID NO: 7839 - DNA, 15 bp, Homo sapiens
gaagctgaggcaggc

SEQ ID NO: 7840 - DNA, 15 bp, Homo sapiens
ggaagctgaggcagg

SEQ ID NO: 7841 - DNA, 15 bp, Homo sapiens
gggaagctgaggcag

SEQ ID NO: 7842 - DNA, 15 bp, Homo sapiens
tgggaagctgaggca

SEQ ID NO: 7843 - DNA, 15 bp, Homo sapiens
ttgggaagctgaggc

SEQ ID NO: 7844 - DNA, 15 bp, Homo sapiens
tttgggaagctgagg

SEQ ID NO: 7845 - DNA, 15 bp, Homo sapiens
gcactttgggaagct

SEQ ID NO: 7846 - DNA, 15 bp, Homo sapiens
agcactttgggaagc

SEQ ID NO: 7847 - DNA, 15 bp, Homo sapiens
cagcactttgggaag

SEQ ID NO: 7848 - DNA, 15 bp, Homo sapiens
ccagcactttgggaa

SEQ ID NO: 7849 - DNA, 15 bp, Homo sapiens
tgtctgtaatcccag

SEQ ID NO: 7850 - DNA, 15 bp, Homo sapiens
atgtctgtaatccca

SEQ ID NO: 7851 - DNA, 15 bp, Homo sapiens
catgtctgtaatccc

SEQ ID NO: 7852 - DNA, 15 bp, Homo sapiens
tcatgtctgtaatcc

SEQ ID NO: 7853 - DNA, 15 bp, Homo sapiens
ctcatgtctgtaatc

SEQ ID NO: 7854 - DNA, 15 bp, Homo sapiens
gctcatgtctgtaat

SEQ ID NO: 7855 - DNA, 15 bp, Homo sapiens
ggctcatgtctgtaa

SEQ ID NO: 7856 - DNA, 15 bp, Homo sapiens
tggctcatgtctgta

SEQ ID NO: 7857 - DNA, 15 bp, Homo sapiens
gtggctcatgtctgt

SEQ ID NO: 7858 - DNA, 15 bp, Homo sapiens
ggtggctcatgtctg

SEQ ID NO: 7859 - DNA, 15 bp, Homo sapiens
aggtggctcatgtct

SEQ ID NO: 7860 - DNA, 15 bp, Homo sapiens
gaggtggctcatgtc

SEQ ID NO: 7861 - DNA, 15 bp, Homo sapiens
tgaggtggctcatgt

SEQ ID NO: 7862 - DNA, 15 bp, Homo sapiens
gtgaggtggctcatg

SEQ ID NO: 7863 - DNA, 15 bp, Homo sapiens
ggtgaggtggctcat

SEQ ID NO: 7864 - DNA, 15 bp, Homo sapiens
gggtgaggtggctca

SEQ ID NO: 7865 - DNA, 15 bp, Homo sapiens
tgggtgaggtggctc

SEQ ID NO: 7866 - DNA, 15 bp, Homo sapiens
ctgggtgaggtggct

SEQ ID NO: 7867 - DNA, 15 bp, Homo sapiens
gctgggtgaggtggc

SEQ ID NO: 7868 - DNA, 15 bp, Homo sapiens
ggctgggtgaggtgg

SEQ ID NO: 7869 - DNA, 15 bp, Homo sapiens
gggctgggtgaggtg

SEQ ID NO: 7870 - DNA, 15 bp, Homo sapiens
tgggctgggtgaggt

SEQ ID NO: 7871 - DNA, 15 bp, Homo sapiens
ctgggctgggtgagg

SEQ ID NO: 7872 - DNA, 15 bp, Homo sapiens
tctgggctgggtgag

SEQ ID NO: 7873 - DNA, 15 bp, Homo sapiens
atctgggctgggtga

SEQ ID NO: 7874 - DNA, 15 bp, Homo sapiens
tatctgggctgggtg

SEQ ID NO: 7875 - DNA, 15 bp, Homo sapiens
ttatctgggctgggt

SEQ ID NO: 7876 - DNA, 15 bp, Homo sapiens
attatctgggctggg

SEQ ID NO: 7877 - DNA, 15 bp, Homo sapiens
gattatctgggctgg

SEQ ID NO: 7878 - DNA, 15 bp, Homo sapiens
ggattatctgggctg

SEQ ID NO: 7879 - DNA, 15 bp, Homo sapiens
aggattatctgggct

SEQ ID NO: 7880 - DNA, 15 bp, Homo sapiens
aaggattatctgggc

SEQ ID NO: 7881 - DNA, 15 bp, Homo sapiens
aaaggattatctggg

SEQ ID NO: 7882 - DNA, 15 bp, Homo sapiens
aaaaggattatctgg

SEQ ID NO: 7883 - DNA, 15 bp, Homo sapiens
taaaaggattatctg

SEQ ID NO: 7884 - DNA, 15 bp, Homo sapiens
gtaaaaggattatct

SEQ ID NO: 7885 - DNA, 15 bp, Homo sapiens
tgtaaaaggattatc

SEQ ID NO: 7886 - DNA, 15 bp, Homo sapiens
gtgtaaaaggattat

SEQ ID NO: 7887 - DNA, 15 bp, Homo sapiens
tgtgtaaaaggatta

SEQ ID NO: 7888 - DNA, 15 bp, Homo sapiens
gtgtgtaaaaggatt

SEQ ID NO: 7889 - DNA, 15 bp, Homo sapiens
agtgtgtaaaaggat

SEQ ID NO: 7890 - DNA, 15 bp, Homo sapiens
cagtgtgtaaaagga

SEQ ID NO: 7891 - DNA, 15 bp, Homo sapiens
acagtgtgtaaaagg

SEQ ID NO: 7892 - DNA, 15 bp, Homo sapiens
aacagtgtgtaaaag

SEQ ID NO: 7893 - DNA, 15 bp, Homo sapiens
aaacagtgtgtaaaa

SEQ ID NO: 7894 - DNA, 15 bp, Homo sapiens
taaacagtgtgtaaa

SEQ ID NO: 7895 - DNA, 15 bp, Homo sapiens
ttaaacagtgtgtaa

SEQ ID NO: 7896 - DNA, 15 bp, Homo sapiens
tttaaacagtgtgta

SEQ ID NO: 7897 - DNA, 15 bp, Homo sapiens
ttttaaacagtgtgt

SEQ ID NO: 7898 - DNA, 15 bp, Homo sapiens
attttaaacagtgtg

SEQ ID NO: 7899 - DNA, 15 bp, Homo sapiens
aattttaaacagtgt

SEQ ID NO: 7900 - DNA, 15 bp, Homo sapiens
aaattttaaacagtg

SEQ ID NO: 7901 - DNA, 15 bp, Homo sapiens
aaaattttaaacagt

SEQ ID NO: 7902 - DNA, 15 bp, Homo sapiens
gaaaattttaaacag

SEQ ID NO: 7903 - DNA, 15 bp, Homo sapiens
tgaaaattttaaaca

SEQ ID NO: 7904 - DNA, 15 bp, Homo sapiens
ttgaaaattttaaac

SEQ ID NO: 7905 - DNA, 15 bp, Homo sapiens
attgaaaattttaaa

SEQ ID NO: 7906 - DNA, 15 bp, Homo sapiens
aattgaaaattttaa

SEQ ID NO: 7907 - DNA, 15 bp, Homo sapiens
aaattgaaaatttta

SEQ ID NO: 7908 - DNA, 15 bp, Homo sapiens
aaaattgaaaatttt

SEQ ID NO: 7909 - DNA, 15 bp, Homo sapiens
gaaaattgaaaattt

SEQ ID NO: 7910 - DNA, 15 bp, Homo sapiens
ggaaaattgaaaatt

SEQ ID NO: 7911 - DNA, 15 bp, Homo sapiens
aggaaaattgaaaat

SEQ ID NO: 7912 - DNA, 15 bp, Homo sapiens
caggaaaattgaaaa

SEQ ID NO: 7913 - DNA, 15 bp, Homo sapiens
ccaggaaaattgaaa

SEQ ID NO: 7914 - DNA, 15 bp, Homo sapiens
tccaggaaaattgaa

SEQ ID NO: 7915 - DNA, 15 bp, Homo sapiens
ctccaggaaaattga

SEQ ID NO: 7916 - DNA, 15 bp, Homo sapiens
tctccaggaaaattg

SEQ ID NO: 7917 - DNA, 15 bp, Homo sapiens
atctccaggaaaatt

SEQ ID NO: 7918 - DNA, 15 bp, Homo sapiens
tatctccaggaaaat

SEQ ID NO: 7919 - DNA, 15 bp, Homo sapiens
ctatctccaggaaaa

SEQ ID NO: 7920 - DNA, 15 bp, Homo sapiens
cctatctccaggaaa

SEQ ID NO: 7921 - DNA, 15 bp, Homo sapiens
ccctatctccaggaa

SEQ ID NO: 7922 - DNA, 15 bp, Homo sapiens
accctatctccagga

SEQ ID NO: 7923 - DNA, 15 bp, Homo sapiens
gaccctatctccagg

SEQ ID NO: 7924 - DNA, 15 bp, Homo sapiens
agaccctatctccag

SEQ ID NO: 7925 - DNA, 15 bp, Homo sapiens
gagaccctatctcca

SEQ ID NO: 7926 - DNA, 15 bp, Homo sapiens
ggagaccctatctcc

SEQ ID NO: 7927 - DNA, 15 bp, Homo sapiens
aggagaccctatctc

SEQ ID NO: 7928 - DNA, 15 bp, Homo sapiens
caggagaccctatct

SEQ ID NO: 7929 - DNA, 15 bp, Homo sapiens
acaggagaccctatc

SEQ ID NO: 7930 - DNA, 15 bp, Homo sapiens
gacaggagaccctat

SEQ ID NO: 7931 - DNA, 15 bp, Homo sapiens
cgacaggagacccta

SEQ ID NO: 7932 - DNA, 15 bp, Homo sapiens
gcgacaggagaccct

SEQ ID NO: 7933 - DNA, 15 bp, Homo sapiens
ggcgacaggagaccc

SEQ ID NO: 7934 - DNA, 15 bp, Homo sapiens
gggcgacaggagacc

SEQ ID NO: 7935 - DNA, 15 bp, Homo sapiens
tgggcgacaggagac

SEQ ID NO: 7936 - DNA, 15 bp, Homo sapiens
ctgggcgacaggaga

SEQ ID NO: 7937 - DNA, 15 bp, Homo sapiens
gctgggcgacaggag

SEQ ID NO: 7938 - DNA, 15 bp, Homo sapiens
cgctgggcgacagga

SEQ ID NO: 7939 - DNA, 15 bp, Homo sapiens
ccgctgggcgacagg

SEQ ID NO: 7940 - DNA, 15 bp, Homo sapiens
cccgctgggcgacag

SEQ ID NO: 7941 - DNA, 15 bp, Homo sapiens
acccgctgggcgaca

SEQ ID NO: 7942 - DNA, 15 bp, Homo sapiens
tacccgctgggcgac

SEQ ID NO: 7943 - DNA, 15 bp, Homo sapiens
ttacccgctgggcga

SEQ ID NO: 7944 - DNA, 15 bp, Homo sapiens
tttacccgctgggcg

SEQ ID NO: 7945 - DNA, 15 bp, Homo sapiens
atttacccgctgggc

SEQ ID NO: 7946 - DNA, 15 bp, Homo sapiens
catttacccgctggg

SEQ ID NO: 7947 - DNA, 15 bp, Homo sapiens
gcatttacccgctgg

SEQ ID NO: 7948 - DNA, 15 bp, Homo sapiens
tgcatttacccgctg

SEQ ID NO: 7949 - DNA, 15 bp, Homo sapiens
ctgcatttacccgct

SEQ ID NO: 7950 - DNA, 15 bp, Homo sapiens
actgcatttacccgc

SEQ ID NO: 7951 - DNA, 15 bp, Homo sapiens
cactgcatttacccg

SEQ ID NO: 7952 - DNA, 15 bp, Homo sapiens
ccactgcatttaccc

SEQ ID NO: 7953 - DNA, 15 bp, Homo sapiens
accactgcatttacc

SEQ ID NO: 7954 - DNA, 15 bp, Homo sapiens
caccactgcatttac

SEQ ID NO: 7955 - DNA, 15 bp, Homo sapiens
gcaccactgcattta

SEQ ID NO: 7956 - DNA, 15 bp, Homo sapiens
cgcaccactgcattt

SEQ ID NO: 7957 - DNA, 15 bp, Homo sapiens
tcgcaccactgcatt

SEQ ID NO: 7958 - DNA, 15 bp, Homo sapiens
atcgcaccactgcat

SEQ ID NO: 7959 - DNA, 15 bp, Homo sapiens
aatcgcaccactgca

SEQ ID NO: 7960 - DNA, 15 bp, Homo sapiens
taatcgcaccactgc

SEQ ID NO: 7961 - DNA, 15 bp, Homo sapiens
ataatcgcaccactg

SEQ ID NO: 7962 - DNA, 15 bp, Homo sapiens
tataatcgcaccact

SEQ ID NO: 7963 - DNA, 15 bp, Homo sapiens
ctataatcgcaccac

SEQ ID NO: 7964 - DNA, 15 bp, Homo sapiens
gctataatcgcacca

SEQ ID NO: 7965 - DNA, 15 bp, Homo sapiens
agctataatcgcacc

SEQ ID NO: 7966 - DNA, 15 bp, Homo sapiens
gagctataatcgcac

SEQ ID NO: 7967 - DNA, 15 bp, Homo sapiens
tgagctataatcgca

SEQ ID NO: 7968 - DNA, 15 bp, Homo sapiens
gtgagctataatcgc

SEQ ID NO: 7969 - DNA, 15 bp, Homo sapiens
agtgagctataatcg

SEQ ID NO: 7970 - DNA, 15 bp, Homo sapiens
cagtgagctataatc

SEQ ID NO: 7971 - DNA, 15 bp, Homo sapiens
gcagtgagctataat

SEQ ID NO: 7972 - DNA, 15 bp, Homo sapiens
tgcagtgagctataa

SEQ ID NO: 7973 - DNA, 15 bp, Homo sapiens
ctgcagtgagctata

SEQ ID NO: 7974 - DNA, 15 bp, Homo sapiens
gctgcagtgagctat

SEQ ID NO: 7975 - DNA, 15 bp, Homo sapiens
ggctgcagtgagcta

SEQ ID NO: 7976 - DNA, 15 bp, Homo sapiens
aggctgcagtgagct

SEQ ID NO: 7977 - DNA, 15 bp, Homo sapiens
gaggctgcagtgagc

SEQ ID NO: 7978 - DNA, 15 bp, Homo sapiens
tgaggctgcagtgag

SEQ ID NO: 7979 - DNA, 15 bp, Homo sapiens
ctgaggctgcagtga

SEQ ID NO: 7980 - DNA, 15 bp, Homo sapiens
tctgaggctgcagtg

SEQ ID NO: 7981 - DNA, 15 bp, Homo sapiens
gtctgaggctgcagt

SEQ ID NO: 7982 - DNA, 15 bp, Homo sapiens
tgtctgaggctgcag

SEQ ID NO: 7983 - DNA, 15 bp, Homo sapiens
gtgtctgaggctgca

SEQ ID NO: 7984 - DNA, 15 bp, Homo sapiens
ggtgtctgaggctgc

SEQ ID NO: 7985 - DNA, 15 bp, Homo sapiens
aggtgtctgaggctg

SEQ ID NO: 7986 - DNA, 15 bp, Homo sapiens
caggtgtctgaggct

SEQ ID NO: 7987 - DNA, 15 bp, Homo sapiens
ccaggtgtctgaggc

SEQ ID NO: 7988 - DNA, 15 bp, Homo sapiens
cccaggtgtctgagg

SEQ ID NO: 7989 - DNA, 15 bp, Homo sapiens
gcccaggtgtctgag

SEQ ID NO: 7990 - DNA, 15 bp, Homo sapiens
agcccaggtgtctga

SEQ ID NO: 7991 - DNA, 15 bp, Homo sapiens
cagcccaggtgtctg

SEQ ID NO: 7992 - DNA, 15 bp, Homo sapiens
tcagcccaggtgtct

SEQ ID NO: 7993 - DNA, 15 bp, Homo sapiens
ttcagcccaggtgtc

SEQ ID NO: 7994 - DNA, 15 bp, Homo sapiens
cttcagcccaggtgt

SEQ ID NO: 7995 - DNA, 15 bp, Homo sapiens
gcttcagcccaggtg

SEQ ID NO: 7996 - DNA, 15 bp, Homo sapiens
ggcttcagcccaggt

SEQ ID NO: 7997 - DNA, 15 bp, Homo sapiens
aggcttcagcccagg

SEQ ID NO: 7998 - DNA, 15 bp, Homo sapiens
caggcttcagcccag

SEQ ID NO: 7999 - DNA, 15 bp, Homo sapiens
tcaggcttcagccca

SEQ ID NO: 8000 - DNA, 15 bp, Homo sapiens
atcaggcttcagccc

SEQ ID NO: 8001 - DNA, 15 bp, Homo sapiens
aatcaggcttcagcc

SEQ ID NO: 8002 - DNA, 15 bp, Homo sapiens
gaatcaggcttcagc

SEQ ID NO: 8003 - DNA, 15 bp, Homo sapiens
agaatcaggcttcag

SEQ ID NO: 8004 - DNA, 15 bp, Homo sapiens
aagaatcaggcttca

SEQ ID NO: 8005 - DNA, 15 bp, Homo sapiens
caagaatcaggcttc

SEQ ID NO: 8006 - DNA, 15 bp, Homo sapiens
tcaagaatcaggctt

SEQ ID NO: 8007 - DNA, 15 bp, Homo sapiens
ctcaagaatcaggct

SEQ ID NO: 8008 - DNA, 15 bp, Homo sapiens
gctcaagaatcaggc

SEQ ID NO: 8009 - DNA, 15 bp, Homo sapiens
ggctcaagaatcagg

SEQ ID NO: 8010 - DNA, 15 bp, Homo sapiens
aggctcaagaatcag

SEQ ID NO: 8011 - DNA, 15 bp, Homo sapiens
gaggctcaagaatca

SEQ ID NO: 8012 - DNA, 15 bp, Homo sapiens
ggaggctcaagaatc

SEQ ID NO: 8013 - DNA, 15 bp, Homo sapiens
gggaggctcaagaat

SEQ ID NO: 8014 - DNA, 15 bp, Homo sapiens
tgggaggctcaagaa

SEQ ID NO: 8015 - DNA, 15 bp, Homo sapiens
ttgggaggctcaaga

SEQ ID NO: 8016 - DNA, 15 bp, Homo sapiens
cttgggaggctcaag

SEQ ID NO: 8017 - DNA, 15 bp, Homo sapiens
acttgggaggctcaa

SEQ ID NO: 8018 - DNA, 15 bp, Homo sapiens
tacttgggaggctca

SEQ ID NO: 8019 - DNA, 15 bp, Homo sapiens
ctacttgggaggctc

SEQ ID NO: 8020 - DNA, 15 bp, Homo sapiens
gctacttgggaggct

SEQ ID NO: 8021 - DNA, 15 bp, Homo sapiens
agctacttgggaggc

SEQ ID NO: 8022 - DNA, 15 bp, Homo sapiens
cagctacttgggagg

SEQ ID NO: 8023 - DNA, 15 bp, Homo sapiens
ccagctacttgggag

SEQ ID NO: 8024 - DNA, 15 bp, Homo sapiens
cccagctacttggga

SEQ ID NO: 8025 - DNA, 15 bp, Homo sapiens
tcccagctacttggg

SEQ ID NO: 8026 - DNA, 15 bp, Homo sapiens
gtcccagctacttgg

SEQ ID NO: 8027 - DNA, 15 bp, Homo sapiens
agtcccagctacttg

SEQ ID NO: 8028 - DNA, 15 bp, Homo sapiens
tagtcccagctactt

SEQ ID NO: 8029 - DNA, 15 bp, Homo sapiens
atagtcccagctact

SEQ ID NO: 8030 - DNA, 15 bp, Homo sapiens
tatagtcccagctac

SEQ ID NO: 8031 - DNA, 15 bp, Homo sapiens
ctatagtcccagcta

SEQ ID NO: 8032 - DNA, 15 bp, Homo sapiens
cctatagtcccagct

SEQ ID NO: 8033 - DNA, 15 bp, Homo sapiens
acctatagtcccagc

SEQ ID NO: 8034 - DNA, 15 bp, Homo sapiens
cacctatagtcccag

SEQ ID NO: 8035 - DNA, 15 bp, Homo sapiens
acacctatagtccca

SEQ ID NO: 8036 - DNA, 15 bp, Homo sapiens
cacacctatagtccc

SEQ ID NO: 8037 - DNA, 15 bp, Homo sapiens
tcacacctatagtcc

SEQ ID NO: 8038 - DNA, 15 bp, Homo sapiens
ctcacacctatagtc

SEQ ID NO: 8039 - DNA, 15 bp, Homo sapiens
gctcacacctatagt

SEQ ID NO: 8040 - DNA, 15 bp, Homo sapiens
ggctcacacctatag

SEQ ID NO: 8041 - DNA, 15 bp, Homo sapiens
atggctcacacctat

SEQ ID NO: 8042 - DNA, 15 bp, Homo sapiens
gatggctcacaccta

SEQ ID NO: 8043 - DNA, 15 bp, Homo sapiens
tgatggctcacacct

SEQ ID NO: 8044 - DNA, 15 bp, Homo sapiens
atgatggctcacacc

SEQ ID NO: 8045 - DNA, 15 bp, Homo sapiens
catgatggctcacac

SEQ ID NO: 8046 - DNA, 15 bp, Homo sapiens
gcatgatggctcaca

SEQ ID NO: 8047 - DNA, 15 bp, Homo sapiens
agcatgatggctcac

SEQ ID NO: 8048 - DNA, 15 bp, Homo sapiens
aagcatgatggctca

SEQ ID NO: 8049 - DNA, 15 bp, Homo sapiens
aaagcatgatggctc

SEQ ID NO: 8050 - DNA, 15 bp, Homo sapiens
caaagcatgatggct

SEQ ID NO: 8051 - DNA, 15 bp, Homo sapiens
gcaaagcatgatggc

SEQ ID NO: 8052 - DNA, 15 bp, Homo sapiens
ggcaaagcatgatgg

SEQ ID NO: 8053 - DNA, 15 bp, Homo sapiens
gggcaaagcatgatg

SEQ ID NO: 8054 - DNA, 15 bp, Homo sapiens
agggcaaagcatgat

SEQ ID NO: 8055 - DNA, 15 bp, Homo sapiens
aagggcaaagcatga

SEQ ID NO: 8056 - DNA, 15 bp, Homo sapiens
aaagggcaaagcatg

SEQ ID NO: 8057 - DNA, 15 bp, Homo sapiens
aaaagggcaaagcat

SEQ ID NO: 8058 - DNA, 15 bp, Homo sapiens
aaaaagggcaaagca

SEQ ID NO: 8059 - DNA, 15 bp, Homo sapiens
aaaaaagggcaaagc

SEQ ID NO: 8060 - DNA, 15 bp, Homo sapiens
aaaaaaagggcaaag

SEQ ID NO: 8061 - DNA, 15 bp, Homo sapiens
aaaaaaaagggcaaa

SEQ ID NO: 8062 - DNA, 15 bp, Homo sapiens
aaaaaaaaagggcaa

SEQ ID NO: 8063 - DNA, 15 bp, Homo sapiens
aaaaaaaaaagggca

SEQ ID NO: 8064 - DNA, 15 bp, Homo sapiens
aaaaaaaaaaagggc

SEQ ID NO: 8065 - DNA, 15 bp, Homo sapiens
aaaaaaaaaaaaggg

SEQ ID NO: 8066 - DNA, 15 bp, Homo sapiens
aaaaaaaaaaaaagg

SEQ ID NO: 8067 - DNA, 15 bp, Homo sapiens
tctgcctcaaaaaaa

SEQ ID NO: 8068 - DNA, 15 bp, Homo sapiens
ctctgcctcaaaaaa

SEQ ID NO: 8069 - DNA, 15 bp, Homo sapiens
actctgcctcaaaaa

SEQ ID NO: 8070 - DNA, 15 bp, Homo sapiens
gactctgcctcaaaa

SEQ ID NO: 8071 - DNA, 15 bp, Homo sapiens
agactctgcctcaaa

SEQ ID NO: 8072 - DNA, 15 bp, Homo sapiens
gagactctgcctcaa

SEQ ID NO: 8073 - DNA, 15 bp, Homo sapiens
tgagactctgcctca

SEQ ID NO: 8074 - DNA, 15 bp, Homo sapiens
gtgagactctgcctc

SEQ ID NO: 8075 - DNA, 15 bp, Homo sapiens
agtgagactctgcct

SEQ ID NO: 8076 - DNA, 15 bp, Homo sapiens
gagtgagactctgcc

SEQ ID NO: 8077 - DNA, 15 bp, Homo sapiens
agagtgagactctgc

SEQ ID NO: 8078 - DNA, 15 bp, Homo sapiens
cagagtgagactctg

SEQ ID NO: 8079 - DNA, 15 bp, Homo sapiens
acagagtgagactct

SEQ ID NO: 8080 - DNA, 15 bp, Homo sapiens
gacagagtgagactc

SEQ ID NO: 8081 - DNA, 15 bp, Homo sapiens
tgacagagtgagact

SEQ ID NO: 8082 - DNA, 15 bp, Homo sapiens
gtgacagagtgagac

SEQ ID NO: 8083 - DNA, 15 bp, Homo sapiens
ggtgacagagtgaga

SEQ ID NO: 8084 - DNA, 15 bp, Homo sapiens
aggtgacagagtgag

SEQ ID NO: 8085 - DNA, 15 bp, Homo sapiens
taggtgacagagtga

SEQ ID NO: 8086 - DNA, 15 bp, Homo sapiens
ctaggtgacagagtg

SEQ ID NO: 8087 - DNA, 15 bp, Homo sapiens
cctaggtgacagagt

SEQ ID NO: 8088 - DNA, 15 bp, Homo sapiens
gcctaggtgacagag

SEQ ID NO: 8089 - DNA, 15 bp, Homo sapiens
agcctaggtgacaga

SEQ ID NO: 8090 - DNA, 15 bp, Homo sapiens
ttccagcctaggtga

SEQ ID NO: 8091 - DNA, 15 bp, Homo sapiens
attccagcctaggtg

SEQ ID NO: 8092 - DNA, 15 bp, Homo sapiens
cattccagcctaggt

SEQ ID NO: 8093 - DNA, 15 bp, Homo sapiens
acattccagcctagg

SEQ ID NO: 8094 - DNA, 15 bp, Homo sapiens
tacattccagcctag

SEQ ID NO: 8095 - DNA, 15 bp, Homo sapiens
ctacattccagccta

SEQ ID NO: 8096 - DNA, 15 bp, Homo sapiens
actacattccagcct

SEQ ID NO: 8097 - DNA, 15 bp, Homo sapiens
tactacattccagcc

SEQ ID NO: 8098 - DNA, 15 bp, Homo sapiens
ctactacattccagc

SEQ ID NO: 8099 - DNA, 15 bp, Homo sapiens
actactacattccag

SEQ ID NO: 8100 - DNA, 15 bp, Homo sapiens
cactactacattcca

SEQ ID NO: 8101 - DNA, 15 bp, Homo sapiens
ccactactacattcc

SEQ ID NO: 8102 - DNA, 15 bp, Homo sapiens
gccactactacattc

SEQ ID NO: 8103 - DNA, 15 bp, Homo sapiens
tgccactactacatt

SEQ ID NO: 8104 - DNA, 15 bp, Homo sapiens
gtgccactactacat

SEQ ID NO: 8105 - DNA, 15 bp, Homo sapiens
cgtgccactactaca

SEQ ID NO: 8106 - DNA, 15 bp, Homo sapiens
tcgtgccactactac

SEQ ID NO: 8107 - DNA, 15 bp, Homo sapiens
atcgtgccactacta

SEQ ID NO: 8108 - DNA, 15 bp, Homo sapiens
gatcgtgccactact

SEQ ID NO: 8109 - DNA, 15 bp, Homo sapiens
tgatcgtgccactac

SEQ ID NO: 8110 - DNA, 15 bp, Homo sapiens
atgatcgtgccacta

SEQ ID NO: 8111 - DNA, 15 bp, Homo sapiens
tatgatcgtgccact

SEQ ID NO: 8112 - DNA, 15 bp, Homo sapiens
ctatgatcgtgccac

SEQ ID NO: 8113 - DNA, 15 bp, Homo sapiens
gctatgatcgtgcca

SEQ ID NO: 8114 - DNA, 15 bp, Homo sapiens
agctatgatcgtgcc

SEQ ID NO: 8115 - DNA, 15 bp, Homo sapiens
gagctatgatcgtgc

SEQ ID NO: 8116 - DNA, 15 bp, Homo sapiens
tgagctatgatcgtg

SEQ ID NO: 8117 - DNA, 15 bp, Homo sapiens
atgagctatgatcgt

SEQ ID NO: 8118 - DNA, 15 bp, Homo sapiens
aatgagctatgatcg

SEQ ID NO: 8119 - DNA, 15 bp, Homo sapiens
taatgagctatgatc

SEQ ID NO: 8120 - DNA, 15 bp, Homo sapiens
ataatgagctatgat

SEQ ID NO: 8121 - DNA, 15 bp, Homo sapiens
tataatgagctatga

SEQ ID NO: 8122 - DNA, 15 bp, Homo sapiens
ttataatgagctatg

SEQ ID NO: 8123 - DNA, 15 bp, Homo sapiens
gttataatgagctat

SEQ ID NO: 8124 - DNA, 15 bp, Homo sapiens
ggttataatgagcta

SEQ ID NO: 8125 - DNA, 15 bp, Homo sapiens
aggttataatgagct

SEQ ID NO: 8126 - DNA, 15 bp, Homo sapiens
gaggttataatgagc

SEQ ID NO: 8127 - DNA, 15 bp, Homo sapiens
tgaggttataatgag

SEQ ID NO: 8128 - DNA, 15 bp, Homo sapiens
ttgaggttataatga

SEQ ID NO: 8129 - DNA, 15 bp, Homo sapiens
tttgaggttataatg

SEQ ID NO: 8130 - DNA, 15 bp, Homo sapiens
gtttgaggttataat

SEQ ID NO: 8131 - DNA, 15 bp, Homo sapiens
agtttgaggttataa

SEQ ID NO: 8132 - DNA, 15 bp, Homo sapiens
gagtttgaggttata

SEQ ID NO: 8133 - DNA, 15 bp, Homo sapiens
ggagtttgaggttat

SEQ ID NO: 8134 - DNA, 15 bp, Homo sapiens
aggagtttgaggtta

SEQ ID NO: 8135 - DNA, 15 bp, Homo sapiens
caggagtttgaggtt

SEQ ID NO: 8136 - DNA, 15 bp, Homo sapiens
ccaggagtttgaggt

SEQ ID NO: 8137 - DNA, 15 bp, Homo sapiens
accaggagtttgagg

SEQ ID NO: 8138 - DNA, 15 bp, Homo sapiens
aaccaggagtttgag

SEQ ID NO: 8139 - DNA, 15 bp, Homo sapiens
aaaccaggagtttga

SEQ ID NO: 8140 - DNA, 15 bp, Homo sapiens
gaaaccaggagtttg

SEQ ID NO: 8141 - DNA, 15 bp, Homo sapiens
tgaaaccaggagttt

SEQ ID NO: 8142 - DNA, 15 bp, Homo sapiens
ttgaaaccaggagtt

SEQ ID NO: 8143 - DNA, 15 bp, Homo sapiens
cttgaaaccaggagt

SEQ ID NO: 8144 - DNA, 15 bp, Homo sapiens
gcttgaaaccaggag

SEQ ID NO: 8145 - DNA, 15 bp, Homo sapiens
tgcttgaaaccagga

SEQ ID NO: 8146 - DNA, 15 bp, Homo sapiens
ttgcttgaaaccagg

SEQ ID NO: 8147 - DNA, 15 bp, Homo sapiens
attgcttgaaaccag

SEQ ID NO: 8148 - DNA, 15 bp, Homo sapiens
gattgcttgaaacca

SEQ ID NO: 8149 - DNA, 15 bp, Homo sapiens
agattgcttgaaacc

SEQ ID NO: 8150 - DNA, 15 bp, Homo sapiens
aagattgcttgaaac

SEQ ID NO: 8151 - DNA, 15 bp, Homo sapiens
gaagattgcttgaaa

SEQ ID NO: 8152 - DNA, 15 bp, Homo sapiens
ggaagattgcttgaa

SEQ ID NO: 8153 - DNA, 15 bp, Homo sapiens
cgggaagattgcttg

SEQ ID NO: 8154 - DNA, 15 bp, Homo sapiens
tcgggaagattgctt

SEQ ID NO: 8155 - DNA, 15 bp, Homo sapiens
ctcgggaagattgct

SEQ ID NO: 8156 - DNA, 15 bp, Homo sapiens
actcgggaagattgc

SEQ ID NO: 8157 - DNA, 15 bp, Homo sapiens
tactcgggaagattg

SEQ ID NO: 8158 - DNA, 15 bp, Homo sapiens
ctactcgggaagatt

SEQ ID NO: 8159 - DNA, 15 bp, Homo sapiens
actactcgggaagat

SEQ ID NO: 8160 - DNA, 15 bp, Homo sapiens
gactactcgggaaga

SEQ ID NO: 8161 - DNA, 15 bp, Homo sapiens
tgactactcgggaag

SEQ ID NO: 8162 - DNA, 15 bp, Homo sapiens
ctgactactcgggaa

SEQ ID NO: 8163 - DNA, 15 bp, Homo sapiens
cctgactactcggga

SEQ ID NO: 8164 - DNA, 15 bp, Homo sapiens
tcctgactactcggg

SEQ ID NO: 8165 - DNA, 15 bp, Homo sapiens
gtcctgactactcgg

SEQ ID NO: 8166 - DNA, 15 bp, Homo sapiens
agtcctgactactcg

SEQ ID NO: 8167 - DNA, 15 bp, Homo sapiens
tagtcctgactactc

SEQ ID NO: 8168 - DNA, 15 bp, Homo sapiens
gtagtcctgactact

SEQ ID NO: 8169 - DNA, 15 bp, Homo sapiens
tgtagtcctgactac

SEQ ID NO: 8170 - DNA, 15 bp, Homo sapiens
ctgtagtcctgacta

SEQ ID NO: 8171 - DNA, 15 bp, Homo sapiens
cctgtagtcctgact

SEQ ID NO: 8172 - DNA, 15 bp, Homo sapiens
gcctgtagtcctgac

SEQ ID NO: 8173 - DNA, 15 bp, Homo sapiens
tgcctgtagtcctga

SEQ ID NO: 8174 - DNA, 15 bp, Homo sapiens
atgcctgtagtcctg

SEQ ID NO: 8175 - DNA, 15 bp, Homo sapiens
catgcctgtagtcct

SEQ ID NO: 8176 - DNA, 15 bp, Homo sapiens
gcatgcctgtagtcc

SEQ ID NO: 8177 - DNA, 15 bp, Homo sapiens
ggcatgcctgtagtc

SEQ ID NO: 8178 - DNA, 15 bp, Homo sapiens
gggcatgcctgtagt

SEQ ID NO: 8179 - DNA, 15 bp, Homo sapiens
agggcatgcctgtag

SEQ ID NO: 8180 - DNA, 15 bp, Homo sapiens
cagggcatgcctgta

SEQ ID NO: 8181 - DNA, 15 bp, Homo sapiens
gcagggcatgcctgt

SEQ ID NO: 8182 - DNA, 15 bp, Homo sapiens
ggcagggcatgcctg

SEQ ID NO: 8183 - DNA, 15 bp, Homo sapiens
tggcagggcatgcct

SEQ ID NO: 8184 - DNA, 15 bp, Homo sapiens
atggcagggcatgcc

SEQ ID NO: 8185 - DNA, 15 bp, Homo sapiens
catggcagggcatgc

SEQ ID NO: 8186 - DNA, 15 bp, Homo sapiens
gcatggcagggcatg

SEQ ID NO: 8187 - DNA, 15 bp, Homo sapiens
ggcatggcagggcat

SEQ ID NO: 8188 - DNA, 15 bp, Homo sapiens
gggcatggcagggca

SEQ ID NO: 8189 - DNA, 15 bp, Homo sapiens
tgggcatggcagggc

SEQ ID NO: 8190 - DNA, 15 bp, Homo sapiens
ttgggcatggcaggg

SEQ ID NO: 8191 - DNA, 15 bp, Homo sapiens
gttgggcatggcagg

SEQ ID NO: 8192 - DNA, 15 bp, Homo sapiens
agttgggcatggcag

SEQ ID NO: 8193 - DNA, 15 bp, Homo sapiens
tagttgggcatggca

SEQ ID NO: 8194 - DNA, 15 bp, Homo sapiens
ttagttgggcatggc

SEQ ID NO: 8195 - DNA, 15 bp, Homo sapiens
attagttgggcatgg

SEQ ID NO: 8196 - DNA, 15 bp, Homo sapiens
aattagttgggcatg

SEQ ID NO: 8197 - DNA, 15 bp, Homo sapiens
taattagttgggcat

SEQ ID NO: 8198 - DNA, 15 bp, Homo sapiens
ttaattagttgggca

SEQ ID NO: 8199 - DNA, 15 bp, Homo sapiens
tttaattagttgggc

SEQ ID NO: 8200 - DNA, 15 bp, Homo sapiens
ttttaattagttggg

SEQ ID NO: 8201 - DNA, 15 bp, Homo sapiens
tttttaattagttgg

SEQ ID NO: 8202 - DNA, 15 bp, Homo sapiens
ttttttaattagttg

SEQ ID NO: 8203 - DNA, 15 bp, Homo sapiens
tttttttaattagtt

SEQ ID NO: 8204 - DNA, 15 bp, Homo sapiens
ttttttttaattagt

SEQ ID NO: 8205 - DNA, 15 bp, Homo sapiens
tttttttttaattag

SEQ ID NO: 8206 - DNA, 15 bp, Homo sapiens
atttttttttaatta

SEQ ID NO: 8207 - DNA, 15 bp, Homo sapiens
aatttttttttaatt

SEQ ID NO: 8208 - DNA, 15 bp, Homo sapiens
aaatttttttttaat

SEQ ID NO: 8209 - DNA, 15 bp, Homo sapiens
aaaatttttttttaa

SEQ ID NO: 8210 - DNA, 15 bp, Homo sapiens
aaaaattttttttta

SEQ ID NO: 8211 - DNA, 15 bp, Homo sapiens
taaaaaaaaattttt

SEQ ID NO: 8212 - DNA, 15 bp, Homo sapiens
ataaaaaaaaatttt

SEQ ID NO: 8213 - DNA, 15 bp, Homo sapiens
tataaaaaaaaattt

SEQ ID NO: 8214 - DNA, 15 bp, Homo sapiens
gtataaaaaaaaatt

SEQ ID NO: 8215 - DNA, 15 bp, Homo sapiens
tgtataaaaaaaaat

SEQ ID NO: 8216 - DNA, 15 bp, Homo sapiens
gtgtataaaaaaaaa

SEQ ID NO: 8217 - DNA, 15 bp, Homo sapiens
tgtgtataaaaaaaa

SEQ ID NO: 8218 - DNA, 15 bp, Homo sapiens
atgtgtataaaaaaa

SEQ ID NO: 8219 - DNA, 15 bp, Homo sapiens
tatgtgtataaaaaa

SEQ ID NO: 8220 - DNA, 15 bp, Homo sapiens
ctatgtgtataaaaa

SEQ ID NO: 8221 - DNA, 15 bp, Homo sapiens
cctatgtgtataaaa

SEQ ID NO: 8222 - DNA, 15 bp, Homo sapiens
ccctatgtgtataaa

SEQ ID NO: 8223 - DNA, 15 bp, Homo sapiens
accctatgtgtataa

SEQ ID NO: 8224 - DNA, 15 bp, Homo sapiens
gaccctatgtgtata

SEQ ID NO: 8225 - DNA, 15 bp, Homo sapiens
agaccctatgtgtat

SEQ ID NO: 8226 - DNA, 15 bp, Homo sapiens
gagaccctatgtgta

SEQ ID NO: 8227 - DNA, 15 bp, Homo sapiens
tgagaccctatgtgt

SEQ ID NO: 8228 - DNA, 15 bp, Homo sapiens
gtgagaccctatgtg

SEQ ID NO: 8229 - DNA, 15 bp, Homo sapiens
agtgagaccctatgt

SEQ ID NO: 8230 - DNA, 15 bp, Homo sapiens
tagtgagaccctatg

SEQ ID NO: 8231 - DNA, 15 bp, Homo sapiens
atagtgagaccctat

SEQ ID NO: 8232 - DNA, 15 bp, Homo sapiens
catagtgagacccta

SEQ ID NO: 8233 - DNA, 15 bp, Homo sapiens
acatagtgagaccct

SEQ ID NO: 8234 - DNA, 15 bp, Homo sapiens
aacatagtgagaccc

SEQ ID NO: 8235 - DNA, 15 bp, Homo sapiens
taacatagtgagacc

SEQ ID NO: 8236 - DNA, 15 bp, Homo sapiens
gtaacatagtgagac

SEQ ID NO: 8237 - DNA, 15 bp, Homo sapiens
agtaacatagtgaga

SEQ ID NO: 8238 - DNA, 15 bp, Homo sapiens
gagtaacatagtgag

SEQ ID NO: 8239 - DNA, 15 bp, Homo sapiens
tgagtaacatagtga

SEQ ID NO: 8240 - DNA, 15 bp, Homo sapiens
ttgagtaacatagtg

SEQ ID NO: 8241 - DNA, 15 bp, Homo sapiens
cttgagtaacatagt

SEQ ID NO: 8242 - DNA, 15 bp, Homo sapiens
gcttgagtaacatag

SEQ ID NO: 8243 - DNA, 15 bp, Homo sapiens
agcttgagtaacata

SEQ ID NO: 8244 - DNA, 15 bp, Homo sapiens
tagcttgagtaacat

SEQ ID NO: 8245 - DNA, 15 bp, Homo sapiens
ctagcttgagtaaca

SEQ ID NO: 8246 - DNA, 15 bp, Homo sapiens
actagcttgagtaac

SEQ ID NO: 8247 - DNA, 15 bp, Homo sapiens
gactagcttgagtaa

SEQ ID NO: 8248 - DNA, 15 bp, Homo sapiens
agactagcttgagta

SEQ ID NO: 8249 - DNA, 15 bp, Homo sapiens
gagactagcttgagt

SEQ ID NO: 8250 - DNA, 15 bp, Homo sapiens
ggagactagcttgag

SEQ ID NO: 8251 - DNA, 15 bp, Homo sapiens
tggagactagcttga

SEQ ID NO: 8252 - DNA, 15 bp, Homo sapiens
ttggagactagcttg

SEQ ID NO: 8253 - DNA, 15 bp, Homo sapiens
attggagactagctt

SEQ ID NO: 8254 - DNA, 15 bp, Homo sapiens
aattggagactagct

SEQ ID NO: 8255 - DNA, 15 bp, Homo sapiens
gaattggagactagc

SEQ ID NO: 8256 - DNA, 15 bp, Homo sapiens
ggaattggagactag

SEQ ID NO: 8257 - DNA, 15 bp, Homo sapiens
aggaattggagacta

SEQ ID NO: 8258 - DNA, 15 bp, Homo sapiens
caggaattggagact

SEQ ID NO: 8259 - DNA, 15 bp, Homo sapiens
ccaggaattggagac

SEQ ID NO: 8260 - DNA, 15 bp, Homo sapiens
gccaggaattggaga

SEQ ID NO: 8261 - DNA, 15 bp, Homo sapiens
ggccaggaattggag

SEQ ID NO: 8262 - DNA, 15 bp, Homo sapiens
aggccaggaattgga

SEQ ID NO: 8263 - DNA, 15 bp, Homo sapiens
aaggccaggaattgg

SEQ ID NO: 8264 - DNA, 15 bp, Homo sapiens
taaggccaggaattg

SEQ ID NO: 8265 - DNA, 15 bp, Homo sapiens
ttaaggccaggaatt

SEQ ID NO: 8266 - DNA, 15 bp, Homo sapiens
cttaaggccaggaat

SEQ ID NO: 8267 - DNA, 15 bp, Homo sapiens
tcttaaggccaggaa

SEQ ID NO: 8268 - DNA, 15 bp, Homo sapiens
ctcttaaggccagga

SEQ ID NO: 8269 - DNA, 15 bp, Homo sapiens
tctcttaaggccagg

SEQ ID NO: 8270 - DNA, 15 bp, Homo sapiens
atctcttaaggccag

SEQ ID NO: 8271 - DNA, 15 bp, Homo sapiens
aatctcttaaggcca

SEQ ID NO: 8272 - DNA, 15 bp, Homo sapiens
aaatctcttaaggcc

SEQ ID NO: 8273 - DNA, 15 bp, Homo sapiens
aaaatctcttaaggc

SEQ ID NO: 8274 - DNA, 15 bp, Homo sapiens
gaaaatctcttaagg

SEQ ID NO: 8275 - DNA, 15 bp, Homo sapiens
ggaaaatctcttaag

SEQ ID NO: 8276 - DNA, 15 bp, Homo sapiens
gggaaaatctcttaa

SEQ ID NO: 8277 - DNA, 15 bp, Homo sapiens
tgggaaaatctctta

SEQ ID NO: 8278 - DNA, 15 bp, Homo sapiens
ttgggaaaatctctt

SEQ ID NO: 8279 - DNA, 15 bp, Homo sapiens
tttgggaaaatctct

SEQ ID NO: 8280 - DNA, 15 bp, Homo sapiens
ctttgggaaaatctc

SEQ ID NO: 8281 - DNA, 15 bp, Homo sapiens
gctttgggaaaatct

SEQ ID NO: 8282 - DNA, 15 bp, Homo sapiens
tgctttgggaaaatc

SEQ ID NO: 8283 - DNA, 15 bp, Homo sapiens
atgctttgggaaaat

SEQ ID NO: 8284 - DNA, 15 bp, Homo sapiens
aatgctttgggaaaa

SEQ ID NO: 8285 - DNA, 15 bp, Homo sapiens
taatgctttgggaaa

SEQ ID NO: 8286 - DNA, 15 bp, Homo sapiens
ctaatgctttgggaa

SEQ ID NO: 8287 - DNA, 15 bp, Homo sapiens
cctaatgctttggga

SEQ ID NO: 8288 - DNA, 15 bp, Homo sapiens
tcctaatgctttggg

SEQ ID NO: 8289 - DNA, 15 bp, Homo sapiens
atcctaatgctttgg

SEQ ID NO: 8290 - DNA, 15 bp, Homo sapiens
aatcctaatgctttg

SEQ ID NO: 8291 - DNA, 15 bp, Homo sapiens
taatcctaatgcttt

SEQ ID NO: 8292 - DNA, 15 bp, Homo sapiens
ataatcctaatgctt

SEQ ID NO: 8293 - DNA, 15 bp, Homo sapiens
tataatcctaatgct

SEQ ID NO: 8294 - DNA, 15 bp, Homo sapiens
ctataatcctaatgc

SEQ ID NO: 8295 - DNA, 15 bp, Homo sapiens
cctataatcctaatg

SEQ ID NO: 8296 - DNA, 15 bp, Homo sapiens
gcctataatcctaat

SEQ ID NO: 8297 - DNA, 15 bp, Homo sapiens
tgcctataatcctaa

SEQ ID NO: 8298 - DNA, 15 bp, Homo sapiens
atgcctataatccta

SEQ ID NO: 8299 - DNA, 15 bp, Homo sapiens
catgcctataatcct

SEQ ID NO: 8300 - DNA, 15 bp, Homo sapiens
tcatgcctataatcc

SEQ ID NO: 8301 - DNA, 15 bp, Homo sapiens
ctcatgcctataatc

SEQ ID NO: 8302 - DNA, 15 bp, Homo sapiens
gctcatgcctataat

SEQ ID NO: 8303 - DNA, 15 bp, Homo sapiens
ggctcatgcctataa

SEQ ID NO: 8304 - DNA, 15 bp, Homo sapiens
tggctcatgcctata

SEQ ID NO: 8305 - DNA, 15 bp, Homo sapiens
gtggctcatgcctat

SEQ ID NO: 8306 - DNA, 15 bp, Homo sapiens
ggtggctcatgccta

SEQ ID NO: 8307 - DNA, 15 bp, Homo sapiens
aggtggctcatgcct

SEQ ID NO: 8308 - DNA, 15 bp, Homo sapiens
gaggtggctcatgcc

SEQ ID NO: 8309 - DNA, 15 bp, Homo sapiens
tgaggtggctcatgc

SEQ ID NO: 8310 - DNA, 15 bp, Homo sapiens
agctgggtgaggtgg

SEQ ID NO: 8311 - DNA, 15 bp, Homo sapiens
cagctgggtgaggtg

SEQ ID NO: 8312 - DNA, 15 bp, Homo sapiens
tcagctgggtgaggt

SEQ ID NO: 8313 - DNA, 15 bp, Homo sapiens
ttcagctgggtgagg

SEQ ID NO: 8314 - DNA, 15 bp, Homo sapiens
tttcagctgggtgag

SEQ ID NO: 8315 - DNA, 15 bp, Homo sapiens
gtttcagctgggtga

SEQ ID NO: 8316 - DNA, 15 bp, Homo sapiens
tgtttcagctgggtg

SEQ ID NO: 8317 - DNA, 15 bp, Homo sapiens
ctgtttcagctgggt

SEQ ID NO: 8318 - DNA, 15 bp, Homo sapiens
tctgtttcagctggg

SEQ ID NO: 8319 - DNA, 15 bp, Homo sapiens
atctgtttcagctgg

SEQ ID NO: 8320 - DNA, 15 bp, Homo sapiens
tatctgtttcagctg

SEQ ID NO: 8321 - DNA, 15 bp, Homo sapiens
ttatctgtttcagct

SEQ ID NO: 8322 - DNA, 15 bp, Homo sapiens
attatctgtttcagc

SEQ ID NO: 8323 - DNA, 15 bp, Homo sapiens
aattatctgtttcag

SEQ ID NO: 8324 - DNA, 15 bp, Homo sapiens
gaattatctgtttca

SEQ ID NO: 8325 - DNA, 15 bp, Homo sapiens
agaattatctgtttc

SEQ ID NO: 8326 - DNA, 15 bp, Homo sapiens
aagaattatctgttt

SEQ ID NO: 8327 - DNA, 15 bp, Homo sapiens
aaagaattatctgtt

SEQ ID NO: 8328 - DNA, 15 bp, Homo sapiens
aaaagaattatctgt

SEQ ID NO: 8329 - DNA, 15 bp, Homo sapiens
aaaaagaattatctg

SEQ ID NO: 8330 - DNA, 15 bp, Homo sapiens
aaaaaagaattatct

SEQ ID NO: 8331 - DNA, 15 bp, Homo sapiens
aaaaaaagaattatc

SEQ ID NO: 8332 - DNA, 15 bp, Homo sapiens
aaaaaaaagaattat

SEQ ID NO: 8333 - DNA, 15 bp, Homo sapiens
aaaaaaaaagaatta

SEQ ID NO: 8334 - DNA, 15 bp, Homo sapiens
aaaaaaaaaagaatt

SEQ ID NO: 8335 - DNA, 15 bp, Homo sapiens
aaaaaaaaaaagaat

SEQ ID NO: 8336 - DNA, 15 bp, Homo sapiens
ggaaaaaaaaaaaaa

SEQ ID NO: 8337 - DNA, 15 bp, Homo sapiens
aggaaaaaaaaaaaa

SEQ ID NO: 8338 - DNA, 15 bp, Homo sapiens
aaggaaaaaaaaaaa

SEQ ID NO: 8339 - DNA, 15 bp, Homo sapiens
caaggaaaaaaaaaa

SEQ ID NO: 8340 - DNA, 15 bp, Homo sapiens
tcaaggaaaaaaaaa

SEQ ID NO: 8341 - DNA, 15 bp, Homo sapiens
ctcaaggaaaaaaaa

SEQ ID NO: 8342 - DNA, 15 bp, Homo sapiens
tctcaaggaaaaaaa

SEQ ID NO: 8343 - DNA, 15 bp, Homo sapiens
atctcaaggaaaaaa

SEQ ID NO: 8344 - DNA, 15 bp, Homo sapiens
catctcaaggaaaaa

SEQ ID NO: 8345 - DNA, 15 bp, Homo sapiens
ccatctcaaggaaaa

SEQ ID NO: 8346 - DNA, 15 bp, Homo sapiens
tccatctcaaggaaa

SEQ ID NO: 8347 - DNA, 15 bp, Homo sapiens
ctccatctcaaggaa

SEQ ID NO: 8348 - DNA, 15 bp, Homo sapiens
actccatctcaagga

SEQ ID NO: 8349 - DNA, 15 bp, Homo sapiens
aactccatctcaagg

SEQ ID NO: 8350 - DNA, 15 bp, Homo sapiens
aaactccatctcaag

SEQ ID NO: 8351 - DNA, 15 bp, Homo sapiens
aaaactccatctcaa

SEQ ID NO: 8352 - DNA, 15 bp, Homo sapiens
caaaactccatctca

SEQ ID NO: 8353 - DNA, 15 bp, Homo sapiens
gcaaaactccatctc

SEQ ID NO: 8354 - DNA, 15 bp, Homo sapiens
agcaaaactccatct

SEQ ID NO: 8355 - DNA, 15 bp, Homo sapiens
gagcaaaactccatc

SEQ ID NO: 8356 - DNA, 15 bp, Homo sapiens
agagcaaaactccat

SEQ ID NO: 8357 - DNA, 15 bp, Homo sapiens
aagagcaaaactcca

SEQ ID NO: 8358 - DNA, 15 bp, Homo sapiens
caagagcaaaactcc

SEQ ID NO: 8359 - DNA, 15 bp, Homo sapiens
acaagagcaaaactc

SEQ ID NO: 8360 - DNA, 15 bp, Homo sapiens
gacaagagcaaaact

SEQ ID NO: 8361 - DNA, 15 bp, Homo sapiens
tgacaagagcaaaac

SEQ ID NO: 8362 - DNA, 15 bp, Homo sapiens
ctgacaagagcaaaa

SEQ ID NO: 8363 - DNA, 15 bp, Homo sapiens
gctgacaagagcaaa

SEQ ID NO: 8364 - DNA, 15 bp, Homo sapiens
ggctgacaagagcaa

SEQ ID NO: 8365 - DNA, 15 bp, Homo sapiens
tggctgacaagagca

SEQ ID NO: 8366 - DNA, 15 bp, Homo sapiens
ctggctgacaagagc

SEQ ID NO: 8367 - DNA, 15 bp, Homo sapiens
cctggctgacaagag

SEQ ID NO: 8368 - DNA, 15 bp, Homo sapiens
gcctggctgacaaga

SEQ ID NO: 8369 - DNA, 15 bp, Homo sapiens
agcctggctgacaag

SEQ ID NO: 8370 - DNA, 15 bp, Homo sapiens
cagcctggctgacaa

SEQ ID NO: 8371 - DNA, 15 bp, Homo sapiens
ccagcctggctgaca

SEQ ID NO: 8372 - DNA, 15 bp, Homo sapiens
tccagcctggctgac

SEQ ID NO: 8373 - DNA, 15 bp, Homo sapiens
ctccagcctggctga

SEQ ID NO: 8374 - DNA, 15 bp, Homo sapiens
actccagcctggctg

SEQ ID NO: 8375 - DNA, 15 bp, Homo sapiens
cactccagcctggct

SEQ ID NO: 8376 - DNA, 15 bp, Homo sapiens
gcactccagcctggc

SEQ ID NO: 8377 - DNA, 15 bp, Homo sapiens
ttgcactccagcctg

SEQ ID NO: 8378 - DNA, 15 bp, Homo sapiens
attgcactccagcct

SEQ ID NO: 8379 - DNA, 15 bp, Homo sapiens
cattgcactccagcc

SEQ ID NO: 8380 - DNA, 15 bp, Homo sapiens
ccattgcactccagc

SEQ ID NO: 8381 - DNA, 15 bp, Homo sapiens
gccattgcactccag

SEQ ID NO: 8382 - DNA, 15 bp, Homo sapiens
cgccattgcactcca

SEQ ID NO: 8383 - DNA, 15 bp, Homo sapiens
gcgccattgcactcc

SEQ ID NO: 8384 - DNA, 15 bp, Homo sapiens
cgcgccattgcactc

SEQ ID NO: 8385 - DNA, 15 bp, Homo sapiens
tcgcgccattgcact

SEQ ID NO: 8386 - DNA, 15 bp, Homo sapiens
atcgcgccattgcac

SEQ ID NO: 8387 - DNA, 15 bp, Homo sapiens
gatcgcgccattgca

SEQ ID NO: 8388 - DNA, 15 bp, Homo sapiens
agatcgcgccattgc

SEQ ID NO: 8389 - DNA, 15 bp, Homo sapiens
gagatcgcgccattg

SEQ ID NO: 8390 - DNA, 15 bp, Homo sapiens
cgagatcgcgccatt

SEQ ID NO: 8391 - DNA, 15 bp, Homo sapiens
ccgagatcgcgccat

SEQ ID NO: 8392 - DNA, 15 bp, Homo sapiens
gccgagatcgcgcca

SEQ ID NO: 8393 - DNA, 15 bp, Homo sapiens
agccgagatcgcgcc

SEQ ID NO: 8394 - DNA, 15 bp, Homo sapiens
gagccgagatcgcgc

SEQ ID NO: 8395 - DNA, 15 bp, Homo sapiens
cgagccgagatcgcg

SEQ ID NO: 8396 - DNA, 15 bp, Homo sapiens
gcgagccgagatcgc

SEQ ID NO: 8397 - DNA, 15 bp, Homo sapiens
agcgagccgagatcg

SEQ ID NO: 8398 - DNA, 15 bp, Homo sapiens
cagcgagccgagatc

SEQ ID NO: 8399 - DNA, 15 bp, Homo sapiens
acagcgagccgagat

SEQ ID NO: 8400 - DNA, 15 bp, Homo sapiens
tacagcgagccgaga

SEQ ID NO: 8401 - DNA, 15 bp, Homo sapiens
ttacagcgagccgag

SEQ ID NO: 8402 - DNA, 15 bp, Homo sapiens
gttacagcgagccga

SEQ ID NO: 8403 - DNA, 15 bp, Homo sapiens
ggttacagcgagccg

SEQ ID NO: 8404 - DNA, 15 bp, Homo sapiens
aggttacagcgagcc

SEQ ID NO: 8405 - DNA, 15 bp, Homo sapiens
gaggttacagcgagc

SEQ ID NO: 8406 - DNA, 15 bp, Homo sapiens
agaggttacagcgag

SEQ ID NO: 8407 - DNA, 15 bp, Homo sapiens
cagaggttacagcga

SEQ ID NO: 8408 - DNA, 15 bp, Homo sapiens
gcagaggttacagcg

SEQ ID NO: 8409 - DNA, 15 bp, Homo sapiens
ggcagaggttacagc

SEQ ID NO: 8410 - DNA, 15 bp, Homo sapiens
aggcagaggttacag

SEQ ID NO: 8411 - DNA, 15 bp, Homo sapiens
gaggcagaggttaca

SEQ ID NO: 8412 - DNA, 15 bp, Homo sapiens
ggaggcagaggttac

SEQ ID NO: 8413 - DNA, 15 bp, Homo sapiens
gggaggcagaggtta

SEQ ID NO: 8414 - DNA, 15 bp, Homo sapiens
ccccgggaggcagag

SEQ ID NO: 8415 - DNA, 15 bp, Homo sapiens
accccgggaggcaga

SEQ ID NO: 8416 - DNA, 15 bp, Homo sapiens
gaccccgggaggcag

SEQ ID NO: 8417 - DNA, 15 bp, Homo sapiens
tgaccccgggaggca

SEQ ID NO: 8418 - DNA, 15 bp, Homo sapiens
ttgaccccgggaggc

SEQ ID NO: 8419 - DNA, 15 bp, Homo sapiens
cttgaccccgggagg

SEQ ID NO: 8420 - DNA, 15 bp, Homo sapiens
gcttgaccccgggag

SEQ ID NO: 8421 - DNA, 15 bp, Homo sapiens
cgcttgaccccggga

SEQ ID NO: 8422 - DNA, 15 bp, Homo sapiens
tcgcttgaccccggg

SEQ ID NO: 8423 - DNA, 15 bp, Homo sapiens
atcgcttgaccccgg

SEQ ID NO: 8424 - DNA, 15 bp, Homo sapiens
aatcgcttgaccccg

SEQ ID NO: 8425 - DNA, 15 bp, Homo sapiens
gaatcgcttgacccc

SEQ ID NO: 8426 - DNA, 15 bp, Homo sapiens
agaatcgcttgaccc

SEQ ID NO: 8427 - DNA, 15 bp, Homo sapiens
gagaatcgcttgacc

SEQ ID NO: 8428 - DNA, 15 bp, Homo sapiens
ggagaatcgcttgac

SEQ ID NO: 8429 - DNA, 15 bp, Homo sapiens
acaggagaatcgctt

SEQ ID NO: 8430 - DNA, 15 bp, Homo sapiens
gacaggagaatcgct

SEQ ID NO: 8431 - DNA, 15 bp, Homo sapiens
agacaggagaatcgc

SEQ ID NO: 8432 - DNA, 15 bp, Homo sapiens
gagacaggagaatcg

SEQ ID NO: 8433 - DNA, 15 bp, Homo sapiens
tgagacaggagaatc

SEQ ID NO: 8434 - DNA, 15 bp, Homo sapiens
agctgagacaggaga

SEQ ID NO: 8435 - DNA, 15 bp, Homo sapiens
aagctgagacaggag

SEQ ID NO: 8436 - DNA, 15 bp, Homo sapiens
gaagctgagacagga

SEQ ID NO: 8437 - DNA, 15 bp, Homo sapiens
ggaagctgagacagg

SEQ ID NO: 8438 - DNA, 15 bp, Homo sapiens
gggaagctgagacag

SEQ ID NO: 8439 - DNA, 15 bp, Homo sapiens
ggggaagctgagaca

SEQ ID NO: 8440 - DNA, 15 bp, Homo sapiens
tggggaagctgagac

SEQ ID NO: 8441 - DNA, 15 bp, Homo sapiens
ctggggaagctgaga

SEQ ID NO: 8442 - DNA, 15 bp, Homo sapiens
actggggaagctgag

SEQ ID NO: 8443 - DNA, 15 bp, Homo sapiens
tactggggaagctga

SEQ ID NO: 8444 - DNA, 15 bp, Homo sapiens
ctactggggaagctg

SEQ ID NO: 8445 - DNA, 15 bp, Homo sapiens
gctactggggaagct

SEQ ID NO: 8446 - DNA, 15 bp, Homo sapiens
agctactggggaagc

SEQ ID NO: 8447 - DNA, 15 bp, Homo sapiens
cagctactggggaag

SEQ ID NO: 8448 - DNA, 15 bp, Homo sapiens
ccagctactggggaa

SEQ ID NO: 8449 - DNA, 15 bp, Homo sapiens
gacgcctgtaatccc

SEQ ID NO: 8450 - DNA, 15 bp, Homo sapiens
ggacgcctgtaatcc

SEQ ID NO: 8451 - DNA, 15 bp, Homo sapiens
tggacgcctgtaatc

SEQ ID NO: 8452 - DNA, 15 bp, Homo sapiens
gtggacgcctgtaat

SEQ ID NO: 8453 - DNA, 15 bp, Homo sapiens
ggtggacgcctgtaa

SEQ ID NO: 8454 - DNA, 15 bp, Homo sapiens
tggtggacgcctgta

SEQ ID NO: 8455 - DNA, 15 bp, Homo sapiens
gtggtggacgcctgt

SEQ ID NO: 8456 - DNA, 15 bp, Homo sapiens
ggtggtggacgcctg

SEQ ID NO: 8457 - DNA, 15 bp, Homo sapiens
tggtggtggacgcct

SEQ ID NO: 8458 - DNA, 15 bp, Homo sapiens
gtggtggtggacgcc

SEQ ID NO: 8459 - DNA, 15 bp, Homo sapiens
tgtggtggtggacgc

SEQ ID NO: 8460 - DNA, 15 bp, Homo sapiens
gtgtggtggtggacg

SEQ ID NO: 8461 - DNA, 15 bp, Homo sapiens
agtgtggtggtggac

SEQ ID NO: 8462 - DNA, 15 bp, Homo sapiens
gagtgtggtggtgga

SEQ ID NO: 8463 - DNA, 15 bp, Homo sapiens
cgagtgtggtggtgg

SEQ ID NO: 8464 - DNA, 15 bp, Homo sapiens
ccgagtgtggtggtg

SEQ ID NO: 8465 - DNA, 15 bp, Homo sapiens
gccgagtgtggtggt

SEQ ID NO: 8466 - DNA, 15 bp, Homo sapiens
agccgagtgtggtgg

SEQ ID NO: 8467 - DNA, 15 bp, Homo sapiens
tagccgagtgtggtg

SEQ ID NO: 8468 - DNA, 15 bp, Homo sapiens
ttagccgagtgtggt

SEQ ID NO: 8469 - DNA, 15 bp, Homo sapiens
attagccgagtgtgg

SEQ ID NO: 8470 - DNA, 15 bp, Homo sapiens
aattagccgagtgtg

SEQ ID NO: 8471 - DNA, 15 bp, Homo sapiens
aaattagccgagtgt

SEQ ID NO: 8472 - DNA, 15 bp, Homo sapiens
aaaattagccgagtg

SEQ ID NO: 8473 - DNA, 15 bp, Homo sapiens
aaaaattagccgagt

SEQ ID NO: 8474 - DNA, 15 bp, Homo sapiens
aaaaaattagccgag

SEQ ID NO: 8475 - DNA, 15 bp, Homo sapiens
caaaaaattagccga

SEQ ID NO: 8476 - DNA, 15 bp, Homo sapiens
acaaaaaattagccg

SEQ ID NO: 8477 - DNA, 15 bp, Homo sapiens
tacaaaaaattagcc

SEQ ID NO: 8478 - DNA, 15 bp, Homo sapiens
atacaaaaaattagc

SEQ ID NO: 8479 - DNA, 15 bp, Homo sapiens
aatacaaaaaattag

SEQ ID NO: 8480 - DNA, 15 bp, Homo sapiens
taaaatacaaaaaat

SEQ ID NO: 8481 - DNA, 15 bp, Homo sapiens
ctaaaatacaaaaaa

SEQ ID NO: 8482 - DNA, 15 bp, Homo sapiens
actaaaatacaaaaa

SEQ ID NO: 8483 - DNA, 15 bp, Homo sapiens
tactaaaatacaaaa

SEQ ID NO: 8484 - DNA, 15 bp, Homo sapiens
ctactaaaatacaaa

SEQ ID NO: 8485 - DNA, 15 bp, Homo sapiens
tctactaaaatacaa

SEQ ID NO: 8486 - DNA, 15 bp, Homo sapiens
ctctactaaaataca

SEQ ID NO: 8487 - DNA, 15 bp, Homo sapiens
tctctactaaaatac

SEQ ID NO: 8488 - DNA, 15 bp, Homo sapiens
atctctactaaaata

SEQ ID NO: 8489 - DNA, 15 bp, Homo sapiens
catctctactaaaat

SEQ ID NO: 8490 - DNA, 15 bp, Homo sapiens
acccatctctactaa

SEQ ID NO: 8491 - DNA, 15 bp, Homo sapiens
aacccatctctacta

SEQ ID NO: 8492 - DNA, 15 bp, Homo sapiens
aaacccatctctact

SEQ ID NO: 8493 - DNA, 15 bp, Homo sapiens
aaaacccatctctac

SEQ ID NO: 8494 - DNA, 15 bp, Homo sapiens
gaaaacccatctcta

SEQ ID NO: 8495 - DNA, 15 bp, Homo sapiens
cgaaaacccatctct

SEQ ID NO: 8496 - DNA, 15 bp, Homo sapiens
gcgaaaacccatctc

SEQ ID NO: 8497 - DNA, 15 bp, Homo sapiens
ggcgaaaacccatct

SEQ ID NO: 8498 - DNA, 15 bp, Homo sapiens
tggcgaaaacccatc

SEQ ID NO: 8499 - DNA, 15 bp, Homo sapiens
atggcgaaaacccat

SEQ ID NO: 8500 - DNA, 15 bp, Homo sapiens
catggcgaaaaccca

SEQ ID NO: 8501 - DNA, 15 bp, Homo sapiens
acatggcgaaaaccc

SEQ ID NO: 8502 - DNA, 15 bp, Homo sapiens
aacatggcgaaaacc

SEQ ID NO: 8503 - DNA, 15 bp, Homo sapiens
caacatggcgaaaac

SEQ ID NO: 8504 - DNA, 15 bp, Homo sapiens
ccaacatggcgaaaa

SEQ ID NO: 8505 - DNA, 15 bp, Homo sapiens
accaacatggcgaaa

SEQ ID NO: 8506 - DNA, 15 bp, Homo sapiens
gaccaacatggcgaa

SEQ ID NO: 8507 - DNA, 15 bp, Homo sapiens
tgaccaacatggcga

SEQ ID NO: 8508 - DNA, 15 bp, Homo sapiens
ctgaccaacatggcg

SEQ ID NO: 8509 - DNA, 15 bp, Homo sapiens
cctgaccaacatggc

SEQ ID NO: 8510 - DNA, 15 bp, Homo sapiens
aagaccagcctgacc

SEQ ID NO: 8511 - DNA, 15 bp, Homo sapiens
caagaccagcctgac

SEQ ID NO: 8512 - DNA, 15 bp, Homo sapiens
tcaagaccagcctga

SEQ ID NO: 8513 - DNA, 15 bp, Homo sapiens
ttcaagaccagcctg

SEQ ID NO: 8514 - DNA, 15 bp, Homo sapiens
gttcaagaccagcct

SEQ ID NO: 8515 - DNA, 15 bp, Homo sapiens
agttcaagaccagcc

SEQ ID NO: 8516 - DNA, 15 bp, Homo sapiens
gagttcaagaccagc

SEQ ID NO: 8517 - DNA, 15 bp, Homo sapiens
ggagttcaagaccag

SEQ ID NO: 8518 - DNA, 15 bp, Homo sapiens
aggagttcaagacca

SEQ ID NO: 8519 - DNA, 15 bp, Homo sapiens
caggagttcaagacc

SEQ ID NO: 8520 - DNA, 15 bp, Homo sapiens
tcaggagttcaagac

SEQ ID NO: 8521 - DNA, 15 bp, Homo sapiens
gtcaggagttcaaga

SEQ ID NO: 8522 - DNA, 15 bp, Homo sapiens
agatcacctgaggtc

SEQ ID NO: 8523 - DNA, 15 bp, Homo sapiens
cagatcacctgaggt

SEQ ID NO: 8524 - DNA, 15 bp, Homo sapiens
gcagatcacctgagg

SEQ ID NO: 8525 - DNA, 15 bp, Homo sapiens
ggcagatcacctgag

SEQ ID NO: 8526 - DNA, 15 bp, Homo sapiens
gggcagatcacctga

SEQ ID NO: 8527 - DNA, 15 bp, Homo sapiens
tgggcagatcacctg

SEQ ID NO: 8528 - DNA, 15 bp, Homo sapiens
gtgggcagatcacct

SEQ ID NO: 8529 - DNA, 15 bp, Homo sapiens
ggtgggcagatcacc

SEQ ID NO: 8530 - DNA, 15 bp, Homo sapiens
aggtgggcagatcac

SEQ ID NO: 8531 - DNA, 15 bp, Homo sapiens
acagcactttgggag

SEQ ID NO: 8532 - DNA, 15 bp, Homo sapiens
cacagcactttggga

SEQ ID NO: 8533 - DNA, 15 bp, Homo sapiens
tcacagcactttggg

SEQ ID NO: 8534 - DNA, 15 bp, Homo sapiens
atcacagcactttgg

SEQ ID NO: 8535 - DNA, 15 bp, Homo sapiens
aatcacagcactttg

SEQ ID NO: 8536 - DNA, 15 bp, Homo sapiens
taatcacagcacttt

SEQ ID NO: 8537 - DNA, 15 bp, Homo sapiens
gtaatcacagcactt

SEQ ID NO: 8538 - DNA, 15 bp, Homo sapiens
tgtaatcacagcact

SEQ ID NO: 8539 - DNA, 15 bp, Homo sapiens
ctgtaatcacagcac

SEQ ID NO: 8540 - DNA, 15 bp, Homo sapiens
cctgtaatcacagca

SEQ ID NO: 8541 - DNA, 15 bp, Homo sapiens
acctgtaatcacagc

SEQ ID NO: 8542 - DNA, 15 bp, Homo sapiens
cacctgtaatcacag

SEQ ID NO: 8543 - DNA, 15 bp, Homo sapiens
acacctgtaatcaca

SEQ ID NO: 8544 - DNA, 15 bp, Homo sapiens
cacacctgtaatcac

SEQ ID NO: 8545 - DNA, 15 bp, Homo sapiens
tcacacctgtaatca

SEQ ID NO: 8546 - DNA, 15 bp, Homo sapiens
ctcacacctgtaatc

SEQ ID NO: 8547 - DNA, 15 bp, Homo sapiens
gctcacacctgtaat

SEQ ID NO: 8548 - DNA, 15 bp, Homo sapiens
ggctcacacctgtaa

SEQ ID NO: 8549 - DNA, 15 bp, Homo sapiens
tggctcacacctgta

SEQ ID NO: 8550 - DNA, 15 bp, Homo sapiens
gtggctcacacctgt

SEQ ID NO: 8551 - DNA, 15 bp, Homo sapiens
agcagtggctcacac

SEQ ID NO: 8552 - DNA, 15 bp, Homo sapiens
gagcagtggctcaca

SEQ ID NO: 8553 - DNA, 15 bp, Homo sapiens
ggagcagtggctcac

SEQ ID NO: 8554 - DNA, 15 bp, Homo sapiens
aggagcagtggctca

SEQ ID NO: 8555 - DNA, 15 bp, Homo sapiens
caggagcagtggctc

SEQ ID NO: 8556 - DNA, 15 bp, Homo sapiens
ccaggagcagtggct

SEQ ID NO: 8557 - DNA, 15 bp, Homo sapiens
gccaggagcagtggc

SEQ ID NO: 8558 - DNA, 15 bp, Homo sapiens
agccaggagcagtgg

SEQ ID NO: 8559 - DNA, 15 bp, Homo sapiens
aagccaggagcagtg

SEQ ID NO: 8560 - DNA, 15 bp, Homo sapiens
caagccaggagcagt

SEQ ID NO: 8561 - DNA, 15 bp, Homo sapiens
tcaagccaggagcag

SEQ ID NO: 8562 - DNA, 15 bp, Homo sapiens
ttcaagccaggagca

SEQ ID NO: 8563 - DNA, 15 bp, Homo sapiens
tttcaagccaggagc

SEQ ID NO: 8564 - DNA, 15 bp, Homo sapiens
gtttcaagccaggag

SEQ ID NO: 8565 - DNA, 15 bp, Homo sapiens
tgtttcaagccagga

SEQ ID NO: 8566 - DNA, 15 bp, Homo sapiens
ctgtttcaagccagg

SEQ ID NO: 8567 - DNA, 15 bp, Homo sapiens
tctgtttcaagccag

SEQ ID NO: 8568 - DNA, 15 bp, Homo sapiens
atctgtttcaagcca

SEQ ID NO: 8569 - DNA, 15 bp, Homo sapiens
tatctgtttcaagcc

SEQ ID NO: 8570 - DNA, 15 bp, Homo sapiens
ttatctgtttcaagc

SEQ ID NO: 8571 - DNA, 15 bp, Homo sapiens
attatctgtttcaag

SEQ ID NO: 8572 - DNA, 15 bp, Homo sapiens
aattatctgtttcaa

SEQ ID NO: 8573 - DNA, 15 bp, Homo sapiens
taaagaattatctgt

SEQ ID NO: 8574 - DNA, 15 bp, Homo sapiens
ataaagaattatctg

SEQ ID NO: 8575 - DNA, 15 bp, Homo sapiens
tataaagaattatct

SEQ ID NO: 8576 - DNA, 15 bp, Homo sapiens
atataaagaattatc

SEQ ID NO: 8577 - DNA, 15 bp, Homo sapiens
aatataaagaattat

SEQ ID NO: 8578 - DNA, 15 bp, Homo sapiens
gaatataaagaatta

SEQ ID NO: 8579 - DNA, 15 bp, Homo sapiens
tgaatataaagaatt

SEQ ID NO: 8580 - DNA, 15 bp, Homo sapiens
ttgaatataaagaat

SEQ ID NO: 8581 - DNA, 15 bp, Homo sapiens
gttgaatataaagaa

SEQ ID NO: 8582 - DNA, 15 bp, Homo sapiens
ggttgaatataaaga

SEQ ID NO: 8583 - DNA, 15 bp, Homo sapiens
aggttgaatataaag

SEQ ID NO: 8584 - DNA, 15 bp, Homo sapiens
caggttgaatataaa

SEQ ID NO: 8585 - DNA, 15 bp, Homo sapiens
acaggttgaatataa

SEQ ID NO: 8586 - DNA, 15 bp, Homo sapiens
aacaggttgaatata

SEQ ID NO: 8587 - DNA, 15 bp, Homo sapiens
caacaggttgaatat

SEQ ID NO: 8588 - DNA, 15 bp, Homo sapiens
acaacaggttgaata

SEQ ID NO: 8589 - DNA, 15 bp, Homo sapiens
gacaacaggttgaat

SEQ ID NO: 8590 - DNA, 15 bp, Homo sapiens
tgacaacaggttgaa

SEQ ID NO: 8591 - DNA, 15 bp, Homo sapiens
ttgacaacaggttga

SEQ ID NO: 8592 - DNA, 15 bp, Homo sapiens
tttgacaacaggttg

SEQ ID NO: 8593 - DNA, 15 bp, Homo sapiens
ttttgacaacaggtt

SEQ ID NO: 8594 - DNA, 15 bp, Homo sapiens
attttgacaacaggt

SEQ ID NO: 8595 - DNA, 15 bp, Homo sapiens
aattttgacaacagg

SEQ ID NO: 8596 - DNA, 15 bp, Homo sapiens
aaattttgacaacag

SEQ ID NO: 8597 - DNA, 15 bp, Homo sapiens
aaaattttgacaaca

SEQ ID NO: 8598 - DNA, 15 bp, Homo sapiens
aaaaattttgacaac

SEQ ID NO: 8599 - DNA, 15 bp, Homo sapiens
taaaaattttgacaa

SEQ ID NO: 8600 - DNA, 15 bp, Homo sapiens
ctaaaaattttgaca

SEQ ID NO: 8601 - DNA, 15 bp, Homo sapiens
tctaaaaattttgac

SEQ ID NO: 8602 - DNA, 15 bp, Homo sapiens
ttctaaaaattttga

SEQ ID NO: 8603 - DNA, 15 bp, Homo sapiens
tttctaaaaattttg

SEQ ID NO: 8604 - DNA, 15 bp, Homo sapiens
gtttctaaaaatttt

SEQ ID NO: 8605 - DNA, 15 bp, Homo sapiens
tgtttctaaaaattt

SEQ ID NO: 8606 - DNA, 15 bp, Homo sapiens
atgtttctaaaaatt

SEQ ID NO: 8607 - DNA, 15 bp, Homo sapiens
aatgtttctaaaaat

SEQ ID NO: 8608 - DNA, 15 bp, Homo sapiens
aaatgtttctaaaaa

SEQ ID NO: 8609 - DNA, 15 bp, Homo sapiens
aaaatgtttctaaaa

SEQ ID NO: 8610 - DNA, 15 bp, Homo sapiens
gaaaatgtttctaaa

SEQ ID NO: 8611 - DNA, 15 bp, Homo sapiens
ggaaaatgtttctaa

SEQ ID NO: 8612 - DNA, 15 bp, Homo sapiens
gggaaaatgtttcta

SEQ ID NO: 8613 - DNA, 15 bp, Homo sapiens
tgggaaaatgtttct

SEQ ID NO: 8614 - DNA, 15 bp, Homo sapiens
ctgggaaaatgtttc

SEQ ID NO: 8615 - DNA, 15 bp, Homo sapiens
actgggaaaatgttt

SEQ ID NO: 8616 - DNA, 15 bp, Homo sapiens
aactgggaaaatgtt

SEQ ID NO: 8617 - DNA, 15 bp, Homo sapiens
gaactgggaaaatgt

SEQ ID NO: 8618 - DNA, 15 bp, Homo sapiens
ggaactgggaaaatg

SEQ ID NO: 8619 - DNA, 15 bp, Homo sapiens
aggaactgggaaaat

SEQ ID NO: 8620 - DNA, 15 bp, Homo sapiens
aaggaactgggaaaa

SEQ ID NO: 8621 - DNA, 15 bp, Homo sapiens
caaggaactgggaaa

SEQ ID NO: 8622 - DNA, 15 bp, Homo sapiens
acaaggaactgggaa

SEQ ID NO: 8623 - DNA, 15 bp, Homo sapiens
tacaaggaactggga

SEQ ID NO: 8624 - DNA, 15 bp, Homo sapiens
atacaaggaactggg

SEQ ID NO: 8625 - DNA, 15 bp, Homo sapiens
tatacaaggaactgg

SEQ ID NO: 8626 - DNA, 15 bp, Homo sapiens
ttatacaaggaactg

SEQ ID NO: 8627 - DNA, 15 bp, Homo sapiens
cttatacaaggaact

SEQ ID NO: 8628 - DNA, 15 bp, Homo sapiens
acttatacaaggaac

SEQ ID NO: 8629 - DNA, 15 bp, Homo sapiens
tacttatacaaggaa

SEQ ID NO: 8630 - DNA, 15 bp, Homo sapiens
atacttatacaagga

SEQ ID NO: 8631 - DNA, 15 bp, Homo sapiens
tatacttatacaagg

SEQ ID NO: 8632 - DNA, 15 bp, Homo sapiens
gtatacttatacaag

SEQ ID NO: 8633 - DNA, 15 bp, Homo sapiens
agtatacttatacaa

SEQ ID NO: 8634 - DNA, 15 bp, Homo sapiens
aagtatacttataca

SEQ ID NO: 8635 - DNA, 15 bp, Homo sapiens
aaagtatacttatac

SEQ ID NO: 8636 - DNA, 15 bp, Homo sapiens
caaagtatacttata

SEQ ID NO: 8637 - DNA, 15 bp, Homo sapiens
acaaagtatacttat

SEQ ID NO: 8638 - DNA, 15 bp, Homo sapiens
tacaaagtatactta

SEQ ID NO: 8639 - DNA, 15 bp, Homo sapiens
atacaaagtatactt

SEQ ID NO: 8640 - DNA, 15 bp, Homo sapiens
tatacaaagtatact

SEQ ID NO: 8641 - DNA, 15 bp, Homo sapiens
ttatacaaagtatac

SEQ ID NO: 8642 - DNA, 15 bp, Homo sapiens
gttatacaaagtata

SEQ ID NO: 8643 - DNA, 15 bp, Homo sapiens
agttatacaaagtat

SEQ ID NO: 8644 - DNA, 15 bp, Homo sapiens
aagttatacaaagta

SEQ ID NO: 8645 - DNA, 15 bp, Homo sapiens
gaagttatacaaagt

SEQ ID NO: 8646 - DNA, 15 bp, Homo sapiens
agaagttatacaaag

SEQ ID NO: 8647 - DNA, 15 bp, Homo sapiens
cagaagttatacaaa

SEQ ID NO: 8648 - DNA, 15 bp, Homo sapiens
ccagaagttatacaa

SEQ ID NO: 8649 - DNA, 15 bp, Homo sapiens
gccagaagttataca

SEQ ID NO: 8650 - DNA, 15 bp, Homo sapiens
tgccagaagttatac

SEQ ID NO: 8651 - DNA, 15 bp, Homo sapiens
ttgccagaagttata

SEQ ID NO: 8652 - DNA, 15 bp, Homo sapiens
tttgccagaagttat

SEQ ID NO: 8653 - DNA, 15 bp, Homo sapiens
gtttgccagaagtta

SEQ ID NO: 8654 - DNA, 15 bp, Homo sapiens
ggtttgccagaagtt

SEQ ID NO: 8655 - DNA, 15 bp, Homo sapiens
tggtttgccagaagt

SEQ ID NO: 8656 - DNA, 15 bp, Homo sapiens
atggtttgccagaag

SEQ ID NO: 8657 - DNA, 15 bp, Homo sapiens
tatggtttgccagaa

SEQ ID NO: 8658 - DNA, 15 bp, Homo sapiens
ttatggtttgccaga

SEQ ID NO: 8659 - DNA, 15 bp, Homo sapiens
attatggtttgccag

SEQ ID NO: 8660 - DNA, 15 bp, Homo sapiens
aattatggtttgcca

SEQ ID NO: 8661 - DNA, 15 bp, Homo sapiens
taattatggtttgcc

SEQ ID NO: 8662 - DNA, 15 bp, Homo sapiens
ataattatggtttgc

SEQ ID NO: 8663 - DNA, 15 bp, Homo sapiens
cataattatggtttg

SEQ ID NO: 8664 - DNA, 15 bp, Homo sapiens
tcataattatggttt

SEQ ID NO: 8665 - DNA, 15 bp, Homo sapiens
ttcataattatggtt

SEQ ID NO: 8666 - DNA, 15 bp, Homo sapiens
gttcataattatggt

SEQ ID NO: 8667 - DNA, 15 bp, Homo sapiens
agttcataattatgg

SEQ ID NO: 8668 - DNA, 15 bp, Homo sapiens
gagttcataattatg

SEQ ID NO: 8669 - DNA, 15 bp, Homo sapiens
tgagttcataattat

SEQ ID NO: 8670 - DNA, 15 bp, Homo sapiens
gtgagttcataatta

SEQ ID NO: 8671 - DNA, 15 bp, Homo sapiens
tgtgagttcataatt

SEQ ID NO: 8672 - DNA, 15 bp, Homo sapiens
atgtgagttcataat

SEQ ID NO: 8673 - DNA, 15 bp, Homo sapiens
aatgtgagttcataa

SEQ ID NO: 8674 - DNA, 15 bp, Homo sapiens
taatgtgagttcata

SEQ ID NO: 8675 - DNA, 15 bp, Homo sapiens
gtaatgtgagttcat

SEQ ID NO: 8676 - DNA, 15 bp, Homo sapiens
agtaatgtgagttca

SEQ ID NO: 8677 - DNA, 15 bp, Homo sapiens
tagtaatgtgagttc

SEQ ID NO: 8678 - DNA, 15 bp, Homo sapiens
atagtaatgtgagtt

SEQ ID NO: 8679 - DNA, 15 bp, Homo sapiens
tatagtaatgtgagt

SEQ ID NO: 8680 - DNA, 15 bp, Homo sapiens
ctatagtaatgtgag

SEQ ID NO: 8681 - DNA, 15 bp, Homo sapiens
actatagtaatgtga

SEQ ID NO: 8682 - DNA, 15 bp, Homo sapiens
tactatagtaatgtg

SEQ ID NO: 8683 - DNA, 15 bp, Homo sapiens
gtactatagtaatgt

SEQ ID NO: 8684 - DNA, 15 bp, Homo sapiens
agtactatagtaatg

SEQ ID NO: 8685 - DNA, 15 bp, Homo sapiens
tagtactatagtaat

SEQ ID NO: 8686 - DNA, 15 bp, Homo sapiens
atagtactatagtaa

SEQ ID NO: 8687 - DNA, 15 bp, Homo sapiens
tatagtactatagta

SEQ ID NO: 8688 - DNA, 15 bp, Homo sapiens
ttatagtactatagt

SEQ ID NO: 8689 - DNA, 15 bp, Homo sapiens
attatagtactatag

SEQ ID NO: 8690 - DNA, 15 bp, Homo sapiens
tattatagtactata

SEQ ID NO: 8691 - DNA, 15 bp, Homo sapiens
gtattatagtactat

SEQ ID NO: 8692 - DNA, 15 bp, Homo sapiens
agtattatagtacta

SEQ ID NO: 8693 - DNA, 15 bp, Homo sapiens
cagtattatagtact

SEQ ID NO: 8694 - DNA, 15 bp, Homo sapiens
gcagtattatagtac

SEQ ID NO: 8695 - DNA, 15 bp, Homo sapiens
tgcagtattatagta

SEQ ID NO: 8696 - DNA, 15 bp, Homo sapiens
ctgcagtattatagt

SEQ ID NO: 8697 - DNA, 15 bp, Homo sapiens
actgcagtattatag

SEQ ID NO: 8698 - DNA, 15 bp, Homo sapiens
tactgcagtattata

SEQ ID NO: 8699 - DNA, 15 bp, Homo sapiens
ttactgcagtattat

SEQ ID NO: 8700 - DNA, 15 bp, Homo sapiens
cttactgcagtatta

SEQ ID NO: 8701 - DNA, 15 bp, Homo sapiens
ccttactgcagtatt

SEQ ID NO: 8702 - DNA, 15 bp, Homo sapiens
cccttactgcagtat

SEQ ID NO: 8703 - DNA, 15 bp, Homo sapiens
tcccttactgcagta

SEQ ID NO: 8704 - DNA, 15 bp, Homo sapiens
atcccttactgcagt

SEQ ID NO: 8705 - DNA, 15 bp, Homo sapiens
gatcccttactgcag

SEQ ID NO: 8706 - DNA, 15 bp, Homo sapiens
agatcccttactgca

SEQ ID NO: 8707 - DNA, 15 bp, Homo sapiens
aagatcccttactgc

SEQ ID NO: 8708 - DNA, 15 bp, Homo sapiens
caagatcccttactg

SEQ ID NO: 8709 - DNA, 15 bp, Homo sapiens
gcaagatcccttact

SEQ ID NO: 8710 - DNA, 15 bp, Homo sapiens
cgcaagatcccttac

SEQ ID NO: 8711 - DNA, 15 bp, Homo sapiens
acgcaagatccctta

SEQ ID NO: 8712 - DNA, 15 bp, Homo sapiens
aacgcaagatccctt

SEQ ID NO: 8713 - DNA, 15 bp, Homo sapiens
aaacgcaagatccct

SEQ ID NO: 8714 - DNA, 15 bp, Homo sapiens
gaaacgcaagatccc

SEQ ID NO: 8715 - DNA, 15 bp, Homo sapiens
tgaaacgcaagatcc

SEQ ID NO: 8716 - DNA, 15 bp, Homo sapiens
ctgaaacgcaagatc

SEQ ID NO: 8717 - DNA, 15 bp, Homo sapiens
actgaaacgcaagat

SEQ ID NO: 8718 - DNA, 15 bp, Homo sapiens
tactgaaacgcaaga

SEQ ID NO: 8719 - DNA, 15 bp, Homo sapiens
ttactgaaacgcaag

SEQ ID NO: 8720 - DNA, 15 bp, Homo sapiens
attactgaaacgcaa

SEQ ID NO: 8721 - DNA, 15 bp, Homo sapiens
cattactgaaacgca

SEQ ID NO: 8722 - DNA, 15 bp, Homo sapiens
acattactgaaacgc

SEQ ID NO: 8723 - DNA, 15 bp, Homo sapiens
gacattactgaaacg

SEQ ID NO: 8724 - DNA, 15 bp, Homo sapiens
tgacattactgaaac

SEQ ID NO: 8725 - DNA, 15 bp, Homo sapiens
gtgacattactgaaa

SEQ ID NO: 8726 - DNA, 15 bp, Homo sapiens
agtgacattactgaa

SEQ ID NO: 8727 - DNA, 15 bp, Homo sapiens
gagtgacattactga

SEQ ID NO: 8728 - DNA, 15 bp, Homo sapiens
tgagtgacattactg

SEQ ID NO: 8729 - DNA, 15 bp, Homo sapiens
atgagtgacattact

SEQ ID NO: 8730 - DNA, 15 bp, Homo sapiens
gatgagtgacattac

SEQ ID NO: 8731 - DNA, 15 bp, Homo sapiens
ggatgagtgacatta

SEQ ID NO: 8732 - DNA, 15 bp, Homo sapiens
tggatgagtgacatt

SEQ ID NO: 8733 - DNA, 15 bp, Homo sapiens
ctggatgagtgacat

SEQ ID NO: 8734 - DNA, 15 bp, Homo sapiens
actggatgagtgaca

SEQ ID NO: 8735 - DNA, 15 bp, Homo sapiens
aactggatgagtgac

SEQ ID NO: 8736 - DNA, 15 bp, Homo sapiens
aaactggatgagtga

SEQ ID NO: 8737 - DNA, 15 bp, Homo sapiens
aaaactggatgagtg

SEQ ID NO: 8738 - DNA, 15 bp, Homo sapiens
gaaaactggatgagt

SEQ ID NO: 8739 - DNA, 15 bp, Homo sapiens
ggaaaactggatgag

SEQ ID NO: 8740 - DNA, 15 bp, Homo sapiens
aggaaaactggatga

SEQ ID NO: 8741 - DNA, 15 bp, Homo sapiens
gaggaaaactggatg

SEQ ID NO: 8742 - DNA, 15 bp, Homo sapiens
ggaggaaaactggat

SEQ ID NO: 8743 - DNA, 15 bp, Homo sapiens
gggaggaaaactgga

SEQ ID NO: 8744 - DNA, 15 bp, Homo sapiens
ggggaggaaaactgg

SEQ ID NO: 8745 - DNA, 15 bp, Homo sapiens
aggggaggaaaactg

SEQ ID NO: 8746 - DNA, 15 bp, Homo sapiens
aaggggaggaaaact

SEQ ID NO: 8747 - DNA, 15 bp, Homo sapiens
aaaggggaggaaaac

SEQ ID NO: 8748 - DNA, 15 bp, Homo sapiens
gaaaggggaggaaaa

SEQ ID NO: 8749 - DNA, 15 bp, Homo sapiens
agaaaggggaggaaa

SEQ ID NO: 8750 - DNA, 15 bp, Homo sapiens
gagaaaggggaggaa

SEQ ID NO: 8751 - DNA, 15 bp, Homo sapiens
agagaaaggggagga

SEQ ID NO: 8752 - DNA, 15 bp, Homo sapiens
aagagaaaggggagg

SEQ ID NO: 8753 - DNA, 15 bp, Homo sapiens
taagagaaaggggag

SEQ ID NO: 8754 - DNA, 15 bp, Homo sapiens
gtaagagaaagggga

SEQ ID NO: 8755 - DNA, 15 bp, Homo sapiens
ggtaagagaaagggg

SEQ ID NO: 8756 - DNA, 15 bp, Homo sapiens
gggtaagagaaaggg

SEQ ID NO: 8757 - DNA, 15 bp, Homo sapiens
ggggtaagagaaagg

SEQ ID NO: 8758 - DNA, 15 bp, Homo sapiens
tggggtaagagaaag

SEQ ID NO: 8759 - DNA, 15 bp, Homo sapiens
atggggtaagagaaa

SEQ ID NO: 8760 - DNA, 15 bp, Homo sapiens
gatggggtaagagaa

SEQ ID NO: 8761 - DNA, 15 bp, Homo sapiens
agatggggtaagaga

SEQ ID NO: 8762 - DNA, 15 bp, Homo sapiens
gagatggggtaagag

SEQ ID NO: 8763 - DNA, 15 bp, Homo sapiens
ggagatggggtaaga

SEQ ID NO: 8764 - DNA, 15 bp, Homo sapiens
gggagatggggtaag

SEQ ID NO: 8765 - DNA, 15 bp, Homo sapiens
agggagatggggtaa

SEQ ID NO: 8766 - DNA, 15 bp, Homo sapiens
gagggagatggggta

SEQ ID NO: 8767 - DNA, 15 bp, Homo sapiens
ggagggagatggggt

SEQ ID NO: 8768 - DNA, 15 bp, Homo sapiens
gggagggagatgggg

SEQ ID NO: 8769 - DNA, 15 bp, Homo sapiens
tgggagggagatggg

SEQ ID NO: 8770 - DNA, 15 bp, Homo sapiens
ctgggagggagatgg

SEQ ID NO: 8771 - DNA, 15 bp, Homo sapiens
actgggagggagatg

SEQ ID NO: 8772 - DNA, 15 bp, Homo sapiens
gactgggagggagat

SEQ ID NO: 8773 - DNA, 15 bp, Homo sapiens
agactgggagggaga

SEQ ID NO: 8774 - DNA, 15 bp, Homo sapiens
gagactgggagggag

SEQ ID NO: 8775 - DNA, 15 bp, Homo sapiens
tgagactgggaggga

SEQ ID NO: 8776 - DNA, 15 bp, Homo sapiens
atgagactgggaggg

SEQ ID NO: 8777 - DNA, 15 bp, Homo sapiens
catgagactgggagg

SEQ ID NO: 8778 - DNA, 15 bp, Homo sapiens
ccatgagactgggag

SEQ ID NO: 8779 - DNA, 15 bp, Homo sapiens
accatgagactggga

SEQ ID NO: 8780 - DNA, 15 bp, Homo sapiens
aaccatgagactggg

SEQ ID NO: 8781 - DNA, 15 bp, Homo sapiens
aaaccatgagactgg

SEQ ID NO: 8782 - DNA, 15 bp, Homo sapiens
gaaaccatgagactg

SEQ ID NO: 8783 - DNA, 15 bp, Homo sapiens
agaaaccatgagact

SEQ ID NO: 8784 - DNA, 15 bp, Homo sapiens
cagaaaccatgagac

SEQ ID NO: 8785 - DNA, 15 bp, Homo sapiens
acagaaaccatgaga

SEQ ID NO: 8786 - DNA, 15 bp, Homo sapiens
aacagaaaccatgag

SEQ ID NO: 8787 - DNA, 15 bp, Homo sapiens
caacagaaaccatga

SEQ ID NO: 8788 - DNA, 15 bp, Homo sapiens
acaacagaaaccatg

SEQ ID NO: 8789 - DNA, 15 bp, Homo sapiens
gacaacagaaaccat

SEQ ID NO: 8790 - DNA, 15 bp, Homo sapiens
tgacaacagaaacca

SEQ ID NO: 8791 - DNA, 15 bp, Homo sapiens
ttgacaacagaaacc

SEQ ID NO: 8792 - DNA, 15 bp, Homo sapiens
attgacaacagaaac

SEQ ID NO: 8793 - DNA, 15 bp, Homo sapiens
gattgacaacagaaa

SEQ ID NO: 8794 - DNA, 15 bp, Homo sapiens
ggattgacaacagaa

SEQ ID NO: 8795 - DNA, 15 bp, Homo sapiens
aggattgacaacaga

SEQ ID NO: 8796 - DNA, 15 bp, Homo sapiens
gaggattgacaacag

SEQ ID NO: 8797 - DNA, 15 bp, Homo sapiens
agaggattgacaaca

SEQ ID NO: 8798 - DNA, 15 bp, Homo sapiens
aagaggattgacaac

SEQ ID NO: 8799 - DNA, 15 bp, Homo sapiens
aaagaggattgacaa

SEQ ID NO: 8800 - DNA, 15 bp, Homo sapiens
gaaagaggattgaca

SEQ ID NO: 8801 - DNA, 15 bp, Homo sapiens
agaaagaggattgac

SEQ ID NO: 8802 - DNA, 15 bp, Homo sapiens
gagaaagaggattga

SEQ ID NO: 8803 - DNA, 15 bp, Homo sapiens
ggagaaagaggattg

SEQ ID NO: 8804 - DNA, 15 bp, Homo sapiens
aggagaaagaggatt

SEQ ID NO: 8805 - DNA, 15 bp, Homo sapiens
aaggagaaagaggat

SEQ ID NO: 8806 - DNA, 15 bp, Homo sapiens
taaggagaaagagga

SEQ ID NO: 8807 - DNA, 15 bp, Homo sapiens
gtaaggagaaagagg

SEQ ID NO: 8808 - DNA, 15 bp, Homo sapiens
tgtaaggagaaagag

SEQ ID NO: 8809 - DNA, 15 bp, Homo sapiens
gtgtaaggagaaaga

SEQ ID NO: 8810 - DNA, 15 bp, Homo sapiens
tgtgtaaggagaaag

SEQ ID NO: 8811 - DNA, 15 bp, Homo sapiens
ttgtgtaaggagaaa

SEQ ID NO: 8812 - DNA, 15 bp, Homo sapiens
cttgtgtaaggagaa

SEQ ID NO: 8813 - DNA, 15 bp, Homo sapiens
ccttgtgtaaggaga

SEQ ID NO: 8814 - DNA, 15 bp, Homo sapiens
gccttgtgtaaggag

SEQ ID NO: 8815 - DNA, 15 bp, Homo sapiens
tgccttgtgtaagga

SEQ ID NO: 8816 - DNA, 15 bp, Homo sapiens
ttgccttgtgtaagg

SEQ ID NO: 8817 - DNA, 15 bp, Homo sapiens
cttgccttgtgtaag

SEQ ID NO: 8818 - DNA, 15 bp, Homo sapiens
tcttgccttgtgtaa

SEQ ID NO: 8819 - DNA, 15 bp, Homo sapiens
ctcttgccttgtgta

SEQ ID NO: 8820 - DNA, 15 bp, Homo sapiens
cctcttgccttgtgt

SEQ ID NO: 8821 - DNA, 15 bp, Homo sapiens
acctcttgccttgtg

SEQ ID NO: 8822 - DNA, 15 bp, Homo sapiens
aacctcttgccttgt

SEQ ID NO: 8823 - DNA, 15 bp, Homo sapiens
aaacctcttgccttg

SEQ ID NO: 8824 - DNA, 15 bp, Homo sapiens
aaaacctcttgcctt

SEQ ID NO: 8825 - DNA, 15 bp, Homo sapiens
gaaaacctcttgcct

SEQ ID NO: 8826 - DNA, 15 bp, Homo sapiens
agaaaacctcttgcc

SEQ ID NO: 8827 - DNA, 15 bp, Homo sapiens
aagaaaacctcttgc

SEQ ID NO: 8828 - DNA, 15 bp, Homo sapiens
taagaaaacctcttg

SEQ ID NO: 8829 - DNA, 15 bp, Homo sapiens
gtaagaaaacctctt

SEQ ID NO: 8830 - DNA, 15 bp, Homo sapiens
ggtaagaaaacctct

SEQ ID NO: 8831 - DNA, 15 bp, Homo sapiens
tggtaagaaaacctc

SEQ ID NO: 8832 - DNA, 15 bp, Homo sapiens
ttggtaagaaaacct

SEQ ID NO: 8833 - DNA, 15 bp, Homo sapiens
attggtaagaaaacc

SEQ ID NO: 8834 - DNA, 15 bp, Homo sapiens
tattggtaagaaaac

SEQ ID NO: 8835 - DNA, 15 bp, Homo sapiens
ctattggtaagaaaa

SEQ ID NO: 8836 - DNA, 15 bp, Homo sapiens
tctattggtaagaaa

SEQ ID NO: 8837 - DNA, 15 bp, Homo sapiens
atctattggtaagaa

SEQ ID NO: 8838 - DNA, 15 bp, Homo sapiens
gatctattggtaaga

SEQ ID NO: 8839 - DNA, 15 bp, Homo sapiens
tgatctattggtaag

SEQ ID NO: 8840 - DNA, 15 bp, Homo sapiens
ctgatctattggtaa

SEQ ID NO: 8841 - DNA, 15 bp, Homo sapiens
tctgatctattggta

SEQ ID NO: 8842 - DNA, 15 bp, Homo sapiens
ttctgatctattggt

SEQ ID NO: 8843 - DNA, 15 bp, Homo sapiens
gttctgatctattgg

SEQ ID NO: 8844 - DNA, 15 bp, Homo sapiens
agttctgatctattg

SEQ ID NO: 8845 - DNA, 15 bp, Homo sapiens
cagttctgatctatt

SEQ ID NO: 8846 - DNA, 15 bp, Homo sapiens
acagttctgatctat

SEQ ID NO: 8847 - DNA, 15 bp, Homo sapiens
cacagttctgatcta

SEQ ID NO: 8848 - DNA, 15 bp, Homo sapiens
tcacagttctgatct

SEQ ID NO: 8849 - DNA, 15 bp, Homo sapiens
ttcacagttctgatc

SEQ ID NO: 8850 - DNA, 15 bp, Homo sapiens
cttcacagttctgat

SEQ ID NO: 8851 - DNA, 15 bp, Homo sapiens
ccttcacagttctga

SEQ ID NO: 8852 - DNA, 15 bp, Homo sapiens
tccttcacagttctg

SEQ ID NO: 8853 - DNA, 15 bp, Homo sapiens
gtccttcacagttct

SEQ ID NO: 8854 - DNA, 15 bp, Homo sapiens
agtccttcacagttc

SEQ ID NO: 8855 - DNA, 15 bp, Homo sapiens
cagtccttcacagtt

SEQ ID NO: 8856 - DNA, 15 bp, Homo sapiens
gcagtccttcacagt

SEQ ID NO: 8857 - DNA, 15 bp, Homo sapiens
ggcagtccttcacag

SEQ ID NO: 8858 - DNA, 15 bp, Homo sapiens
gggcagtccttcaca

SEQ ID NO: 8859 - DNA, 15 bp, Homo sapiens
cgggcagtccttcac

SEQ ID NO: 8860 - DNA, 15 bp, Homo sapiens
tcgggcagtccttca

SEQ ID NO: 8861 - DNA, 15 bp, Homo sapiens
gtcgggcagtccttc

SEQ ID NO: 8862 - DNA, 15 bp, Homo sapiens
tgtcgggcagtcctt

SEQ ID NO: 8863 - DNA, 15 bp, Homo sapiens
atgtcgggcagtcct

SEQ ID NO: 8864 - DNA, 15 bp, Homo sapiens
catgtcgggcagtcc

SEQ ID NO: 8865 - DNA, 15 bp, Homo sapiens
tcatgtcgggcagtc

SEQ ID NO: 8866 - DNA, 15 bp, Homo sapiens
atcatgtcgggcagt

SEQ ID NO: 8867 - DNA, 15 bp, Homo sapiens
gatcatgtcgggcag

SEQ ID NO: 8868 - DNA, 15 bp, Homo sapiens
agatcatgtcgggca

SEQ ID NO: 8869 - DNA, 15 bp, Homo sapiens
cagatcatgtcgggc

SEQ ID NO: 8870 - DNA, 15 bp, Homo sapiens
tcagatcatgtcggg

SEQ ID NO: 8871 - DNA, 15 bp, Homo sapiens
atcagatcatgtcgg

SEQ ID NO: 8872 - DNA, 15 bp, Homo sapiens
tatcagatcatgtcg

SEQ ID NO: 8873 - DNA, 15 bp, Homo sapiens
atatcagatcatgtc

SEQ ID NO: 8874 - DNA, 15 bp, Homo sapiens
catatcagatcatgt

SEQ ID NO: 8875 - DNA, 15 bp, Homo sapiens
ccatatcagatcatg

SEQ ID NO: 8876 - DNA, 15 bp, Homo sapiens
accatatcagatcat

SEQ ID NO: 8877 - DNA, 15 bp, Homo sapiens
aaccatatcagatca

SEQ ID NO: 8878 - DNA, 15 bp, Homo sapiens
caaccatatcagatc

SEQ ID NO: 8879 - DNA, 15 bp, Homo sapiens
acaaccatatcagat

SEQ ID NO: 8880 - DNA, 15 bp, Homo sapiens
aacaaccatatcaga

SEQ ID NO: 8881 - DNA, 15 bp, Homo sapiens
gaacaaccatatcag

SEQ ID NO: 8882 - DNA, 15 bp, Homo sapiens
agaacaaccatatca

SEQ ID NO: 8883 - DNA, 15 bp, Homo sapiens
aagaacaaccatatc

SEQ ID NO: 8884 - DNA, 15 bp, Homo sapiens
gaagaacaaccatat

SEQ ID NO: 8885 - DNA, 15 bp, Homo sapiens
tgaagaacaaccata

SEQ ID NO: 8886 - DNA, 15 bp, Homo sapiens
atgaagaacaaccat

SEQ ID NO: 8887 - DNA, 15 bp, Homo sapiens
aatgaagaacaacca

SEQ ID NO: 8888 - DNA, 15 bp, Homo sapiens
aaatgaagaacaacc

SEQ ID NO: 8889 - DNA, 15 bp, Homo sapiens
aaaatgaagaacaac

SEQ ID NO: 8890 - DNA, 15 bp, Homo sapiens
caaaatgaagaacaa

SEQ ID NO: 8891 - DNA, 15 bp, Homo sapiens
ccaaaatgaagaaca

SEQ ID NO: 8892 - DNA, 15 bp, Homo sapiens
cccaaaatgaagaac

SEQ ID NO: 8893 - DNA, 15 bp, Homo sapiens
gcccaaaatgaagaa

SEQ ID NO: 8894 - DNA, 15 bp, Homo sapiens
agcccaaaatgaaga

SEQ ID NO: 8895 - DNA, 15 bp, Homo sapiens
cagcccaaaatgaag

SEQ ID NO: 8896 - DNA, 15 bp, Homo sapiens
acagcccaaaatgaa

SEQ ID NO: 8897 - DNA, 15 bp, Homo sapiens
tacagcccaaaatga

SEQ ID NO: 8898 - DNA, 15 bp, Homo sapiens
ctacagcccaaaatg

SEQ ID NO: 8899 - DNA, 15 bp, Homo sapiens
actacagcccaaaat

SEQ ID NO: 8900 - DNA, 15 bp, Homo sapiens
tactacagcccaaaa

SEQ ID NO: 8901 - DNA, 15 bp, Homo sapiens
atactacagcccaaa

SEQ ID NO: 8902 - DNA, 15 bp, Homo sapiens
aatactacagcccaa

SEQ ID NO: 8903 - DNA, 15 bp, Homo sapiens
aaatactacagccca

SEQ ID NO: 8904 - DNA, 15 bp, Homo sapiens
aaaatactacagccc

SEQ ID NO: 8905 - DNA, 15 bp, Homo sapiens
taaaatactacagcc

SEQ ID NO: 8906 - DNA, 15 bp, Homo sapiens
ttaaaatactacagc

SEQ ID NO: 8907 - DNA, 15 bp, Homo sapiens
tttaaaatactacag

SEQ ID NO: 8908 - DNA, 15 bp, Homo sapiens
ctttaaaatactaca

SEQ ID NO: 8909 - DNA, 15 bp, Homo sapiens
actttaaaatactac

SEQ ID NO: 8910 - DNA, 15 bp, Homo sapiens
tactttaaaatacta

SEQ ID NO: 8911 - DNA, 15 bp, Homo sapiens
ctactttaaaatact

SEQ ID NO: 8912 - DNA, 15 bp, Homo sapiens
tctactttaaaatac

SEQ ID NO: 8913 - DNA, 15 bp, Homo sapiens
ctctactttaaaata

SEQ ID NO: 8914 - DNA, 15 bp, Homo sapiens
cctctactttaaaat

SEQ ID NO: 8915 - DNA, 15 bp, Homo sapiens
acctctactttaaaa

SEQ ID NO: 8916 - DNA, 15 bp, Homo sapiens
aacctctactttaaa

SEQ ID NO: 8917 - DNA, 15 bp, Homo sapiens
aaacctctactttaa

SEQ ID NO: 8918 - DNA, 15 bp, Homo sapiens
caaacctctacttta

SEQ ID NO: 8919 - DNA, 15 bp, Homo sapiens
gcaaacctctacttt

SEQ ID NO: 8920 - DNA, 15 bp, Homo sapiens
agcaaacctctactt

SEQ ID NO: 8921 - DNA, 15 bp, Homo sapiens
gagcaaacctctact

SEQ ID NO: 8922 - DNA, 15 bp, Homo sapiens
agagcaaacctctac

SEQ ID NO: 8923 - DNA, 15 bp, Homo sapiens
cagagcaaacctcta

SEQ ID NO: 8924 - DNA, 15 bp, Homo sapiens
tcagagcaaacctct

SEQ ID NO: 8925 - DNA, 15 bp, Homo sapiens
atcagagcaaacctc

SEQ ID NO: 8926 - DNA, 15 bp, Homo sapiens
catcagagcaaacct

SEQ ID NO: 8927 - DNA, 15 bp, Homo sapiens
ccatcagagcaaacc

SEQ ID NO: 8928 - DNA, 15 bp, Homo sapiens
accatcagagcaaac

SEQ ID NO: 8929 - DNA, 15 bp, Homo sapiens
gaccatcagagcaaa

SEQ ID NO: 8930 - DNA, 15 bp, Homo sapiens
ggaccatcagagcaa

SEQ ID NO: 8931 - DNA, 15 bp, Homo sapiens
gggaccatcagagca

SEQ ID NO: 8932 - DNA, 15 bp, Homo sapiens
tgggaccatcagagc

SEQ ID NO: 8933 - DNA, 15 bp, Homo sapiens
atgggaccatcagag

SEQ ID NO: 8934 - DNA, 15 bp, Homo sapiens
gatgggaccatcaga

SEQ ID NO: 8935 - DNA, 15 bp, Homo sapiens
tgatgggaccatcag

SEQ ID NO: 8936 - DNA, 15 bp, Homo sapiens
gtgatgggaccatca

SEQ ID NO: 8937 - DNA, 15 bp, Homo sapiens
agtgatgggaccatc

SEQ ID NO: 8938 - DNA, 15 bp, Homo sapiens
cagtgatgggaccat

SEQ ID NO: 8939 - DNA, 15 bp, Homo sapiens
gcagtgatgggacca

SEQ ID NO: 8940 - DNA, 15 bp, Homo sapiens
agcagtgatgggacc

SEQ ID NO: 8941 - DNA, 15 bp, Homo sapiens
aagcagtgatgggac

SEQ ID NO: 8942 - DNA, 15 bp, Homo sapiens
caagcagtgatggga

SEQ ID NO: 8943 - DNA, 15 bp, Homo sapiens
gcaagcagtgatggg

SEQ ID NO: 8944 - DNA, 15 bp, Homo sapiens
ggcaagcagtgatgg

SEQ ID NO: 8945 - DNA, 15 bp, Homo sapiens
tggcaagcagtgatg

SEQ ID NO: 8946 - DNA, 15 bp, Homo sapiens
atggcaagcagtgat

SEQ ID NO: 8947 - DNA, 15 bp, Homo sapiens
aatggcaagcagtga

SEQ ID NO: 8948 - DNA, 15 bp, Homo sapiens
caatggcaagcagtg

SEQ ID NO: 8949 - DNA, 15 bp, Homo sapiens
acaatggcaagcagt

SEQ ID NO: 8950 - DNA, 15 bp, Homo sapiens
gacaatggcaagcag

SEQ ID NO: 8951 - DNA, 15 bp, Homo sapiens
agacaatggcaagca

SEQ ID NO: 8952 - DNA, 15 bp, Homo sapiens
aagacaatggcaagc

SEQ ID NO: 8953 - DNA, 15 bp, Homo sapiens
aaagacaatggcaag

SEQ ID NO: 8954 - DNA, 15 bp, Homo sapiens
gaaagacaatggcaa

SEQ ID NO: 8955 - DNA, 15 bp, Homo sapiens
ggaaagacaatggca

SEQ ID NO: 8956 - DNA, 15 bp, Homo sapiens
gggaaagacaatggc

SEQ ID NO: 8957 - DNA, 15 bp, Homo sapiens
agggaaagacaatgg

SEQ ID NO: 8958 - DNA, 15 bp, Homo sapiens
aagggaaagacaatg

SEQ ID NO: 8959 - DNA, 15 bp, Homo sapiens
aaagggaaagacaat

SEQ ID NO: 8960 - DNA, 15 bp, Homo sapiens
caaagggaaagacaa

SEQ ID NO: 8961 - DNA, 15 bp, Homo sapiens
gcaaagggaaagaca

SEQ ID NO: 8962 - DNA, 15 bp, Homo sapiens
agcaaagggaaagac

SEQ ID NO: 8963 - DNA, 15 bp, Homo sapiens
gagcaaagggaaaga

SEQ ID NO: 8964 - DNA, 15 bp, Homo sapiens
agagcaaagggaaag

SEQ ID NO: 8965 - DNA, 15 bp, Homo sapiens
tagagcaaagggaaa

SEQ ID NO: 8966 - DNA, 15 bp, Homo sapiens
ctagagcaaagggaa

SEQ ID NO: 8967 - DNA, 15 bp, Homo sapiens
gctagagcaaaggga

SEQ ID NO: 8968 - DNA, 15 bp, Homo sapiens
agctagagcaaaggg

SEQ ID NO: 8969 - DNA, 15 bp, Homo sapiens
tagctagagcaaagg

SEQ ID NO: 8970 - DNA, 15 bp, Homo sapiens
atagctagagcaaag

SEQ ID NO: 8971 - DNA, 15 bp, Homo sapiens
gatagctagagcaaa

SEQ ID NO: 8972 - DNA, 15 bp, Homo sapiens
tgatagctagagcaa

SEQ ID NO: 8973 - DNA, 15 bp, Homo sapiens
ctgatagctagagca

SEQ ID NO: 8974 - DNA, 15 bp, Homo sapiens
cctgatagctagagc

SEQ ID NO: 8975 - DNA, 15 bp, Homo sapiens
ccctgatagctagag

SEQ ID NO: 8976 - DNA, 15 bp, Homo sapiens
cccctgatagctaga

SEQ ID NO: 8977 - DNA, 15 bp, Homo sapiens
tcccctgatagctag

SEQ ID NO: 8978 - DNA, 15 bp, Homo sapiens
atcccctgatagcta

SEQ ID NO: 8979 - DNA, 15 bp, Homo sapiens
catcccctgatagct

SEQ ID NO: 8980 - DNA, 15 bp, Homo sapiens
acatcccctgatagc

SEQ ID NO: 8981 - DNA, 15 bp, Homo sapiens
aacatcccctgatag

SEQ ID NO: 8982 - DNA, 15 bp, Homo sapiens
caacatcccctgata

SEQ ID NO: 8983 - DNA, 15 bp, Homo sapiens
gcaacatcccctgat

SEQ ID NO: 8984 - DNA, 15 bp, Homo sapiens
agcaacatcccctga

SEQ ID NO: 8985 - DNA, 15 bp, Homo sapiens
aagcaacatcccctg

SEQ ID NO: 8986 - DNA, 15 bp, Homo sapiens
aaagcaacatcccct

SEQ ID NO: 8987 - DNA, 15 bp, Homo sapiens
taaagcaacatcccc

SEQ ID NO: 8988 - DNA, 15 bp, Homo sapiens
ttaaagcaacatccc

SEQ ID NO: 8989 - DNA, 15 bp, Homo sapiens
cttaaagcaacatcc

SEQ ID NO: 8990 - DNA, 15 bp, Homo sapiens
acttaaagcaacatc

SEQ ID NO: 8991 - DNA, 15 bp, Homo sapiens
aacttaaagcaacat

SEQ ID NO: 8992 - DNA, 15 bp, Homo sapiens
aaacttaaagcaaca

SEQ ID NO: 8993 - DNA, 15 bp, Homo sapiens
caaacttaaagcaac

SEQ ID NO: 8994 - DNA, 15 bp, Homo sapiens
acaaacttaaagcaa

SEQ ID NO: 8995 - DNA, 15 bp, Homo sapiens
aacaaacttaaagca

SEQ ID NO: 8996 - DNA, 15 bp, Homo sapiens
gaacaaacttaaagc

SEQ ID NO: 8997 - DNA, 15 bp, Homo sapiens
ggaacaaacttaaag

SEQ ID NO: 8998 - DNA, 15 bp, Homo sapiens
gggaacaaacttaaa

SEQ ID NO: 8999 - DNA, 15 bp, Homo sapiens
ggggaacaaacttaa

SEQ ID NO: 9000 - DNA, 15 bp, Homo sapiens
tggggaacaaactta

SEQ ID NO: 9001 - DNA, 15 bp, Homo sapiens
ctggggaacaaactt

SEQ ID NO: 9002 - DNA, 15 bp, Homo sapiens
cctggggaacaaact

SEQ ID NO: 9003 - DNA, 15 bp, Homo sapiens
gcctggggaacaaac

SEQ ID NO: 9004 - DNA, 15 bp, Homo sapiens
agcctggggaacaaa

SEQ ID NO: 9005 - DNA, 15 bp, Homo sapiens
aagcctggggaacaa

SEQ ID NO: 9006 - DNA, 15 bp, Homo sapiens
aaagcctggggaaca

SEQ ID NO: 9007 - DNA, 15 bp, Homo sapiens
taaagcctggggaac

SEQ ID NO: 9008 - DNA, 15 bp, Homo sapiens
gtaaagcctggggaa

SEQ ID NO: 9009 - DNA, 15 bp, Homo sapiens
agtaaagcctgggga

SEQ ID NO: 9010 - DNA, 15 bp, Homo sapiens
cagtaaagcctgggg

SEQ ID NO: 9011 - DNA, 15 bp, Homo sapiens
gcagtaaagcctggg

SEQ ID NO: 9012 - DNA, 15 bp, Homo sapiens
ggcagtaaagcctgg

SEQ ID NO: 9013 - DNA, 15 bp, Homo sapiens
tggcagtaaagcctg

SEQ ID NO: 9014 - DNA, 15 bp, Homo sapiens
ttggcagtaaagcct

SEQ ID NO: 9015 - DNA, 15 bp, Homo sapiens
cttggcagtaaagcc

SEQ ID NO: 9016 - DNA, 15 bp, Homo sapiens
tcttggcagtaaagc

SEQ ID NO: 9017 - DNA, 15 bp, Homo sapiens
ctcttggcagtaaag

SEQ ID NO: 9018 - DNA, 15 bp, Homo sapiens
cctcttggcagtaaa

SEQ ID NO: 9019 - DNA, 15 bp, Homo sapiens
ccctcttggcagtaa

SEQ ID NO: 9020 - DNA, 15 bp, Homo sapiens
tccctcttggcagta

SEQ ID NO: 9021 - DNA, 15 bp, Homo sapiens
ttccctcttggcagt

SEQ ID NO: 9022 - DNA, 15 bp, Homo sapiens
tttccctcttggcag

SEQ ID NO: 9023 - DNA, 15 bp, Homo sapiens
atttccctcttggca

SEQ ID NO: 9024 - DNA, 15 bp, Homo sapiens
aatttccctcttggc

SEQ ID NO: 9025 - DNA, 15 bp, Homo sapiens
gaatttccctcttgg

SEQ ID NO: 9026 - DNA, 15 bp, Homo sapiens
tgaatttccctcttg

SEQ ID NO: 9027 - DNA, 15 bp, Homo sapiens
atgaatttccctctt

SEQ ID NO: 9028 - DNA, 15 bp, Homo sapiens
tatgaatttccctct

SEQ ID NO: 9029 - DNA, 15 bp, Homo sapiens
gtatgaatttccctc

SEQ ID NO: 9030 - DNA, 15 bp, Homo sapiens
ggtatgaatttccct

SEQ ID NO: 9031 - DNA, 15 bp, Homo sapiens
gggtatgaatttccc

SEQ ID NO: 9032 - DNA, 15 bp, Homo sapiens
tgggtatgaatttcc

SEQ ID NO: 9033 - DNA, 15 bp, Homo sapiens
gtgggtatgaatttc

SEQ ID NO: 9034 - DNA, 15 bp, Homo sapiens
agtgggtatgaattt

SEQ ID NO: 9035 - DNA, 15 bp, Homo sapiens
aagtgggtatgaatt

SEQ ID NO: 9036 - DNA, 15 bp, Homo sapiens
aaagtgggtatgaat

SEQ ID NO: 9037 - DNA, 15 bp, Homo sapiens
taaagtgggtatgaa

SEQ ID NO: 9038 - DNA, 15 bp, Homo sapiens
ttaaagtgggtatga

SEQ ID NO: 9039 - DNA, 15 bp, Homo sapiens
gttaaagtgggtatg

SEQ ID NO: 9040 - DNA, 15 bp, Homo sapiens
tgttaaagtgggtat

SEQ ID NO: 9041 - DNA, 15 bp, Homo sapiens
ttgttaaagtgggta

SEQ ID NO: 9042 - DNA, 15 bp, Homo sapiens
cttgttaaagtgggt

SEQ ID NO: 9043 - DNA, 15 bp, Homo sapiens
ccttgttaaagtggg

SEQ ID NO: 9044 - DNA, 15 bp, Homo sapiens
accttgttaaagtgg

SEQ ID NO: 9045 - DNA, 15 bp, Homo sapiens
caccttgttaaagtg

SEQ ID NO: 9046 - DNA, 15 bp, Homo sapiens
acaccttgttaaagt

SEQ ID NO: 9047 - DNA, 15 bp, Homo sapiens
cacaccttgttaaag

SEQ ID NO: 9048 - DNA, 15 bp, Homo sapiens
tcacaccttgttaaa

SEQ ID NO: 9049 - DNA, 15 bp, Homo sapiens
ttcacaccttgttaa

SEQ ID NO: 9050 - DNA, 15 bp, Homo sapiens
cttcacaccttgtta

SEQ ID NO: 9051 - DNA, 15 bp, Homo sapiens
gcttcacaccttgtt

SEQ ID NO: 9052 - DNA, 15 bp, Homo sapiens
agcttcacaccttgt

SEQ ID NO: 9053 - DNA, 15 bp, Homo sapiens
aagcttcacaccttg

SEQ ID NO: 9054 - DNA, 15 bp, Homo sapiens
taagcttcacacctt

SEQ ID NO: 9055 - DNA, 15 bp, Homo sapiens
ataagcttcacacct

SEQ ID NO: 9056 - DNA, 15 bp, Homo sapiens
gataagcttcacacc

SEQ ID NO: 9057 - DNA, 15 bp, Homo sapiens
agataagcttcacac

SEQ ID NO: 9058 - DNA, 15 bp, Homo sapiens
aagataagcttcaca

SEQ ID NO: 9059 - DNA, 15 bp, Homo sapiens
taagataagcttcac

SEQ ID NO: 9060 - DNA, 15 bp, Homo sapiens
gtaagataagcttca

SEQ ID NO: 9061 - DNA, 15 bp, Homo sapiens
tgtaagataagcttc

SEQ ID NO: 9062 - DNA, 15 bp, Homo sapiens
ctgtaagataagctt

SEQ ID NO: 9063 - DNA, 15 bp, Homo sapiens
actgtaagataagct

SEQ ID NO: 9064 - DNA, 15 bp, Homo sapiens
aactgtaagataagc

SEQ ID NO: 9065 - DNA, 15 bp, Homo sapiens
caactgtaagataag

SEQ ID NO: 9066 - DNA, 15 bp, Homo sapiens
gcaactgtaagataa

SEQ ID NO: 9067 - DNA, 15 bp, Homo sapiens
agcaactgtaagata

SEQ ID NO: 9068 - DNA, 15 bp, Homo sapiens
tagcaactgtaagat

SEQ ID NO: 9069 - DNA, 15 bp, Homo sapiens
ttagcaactgtaaga

SEQ ID NO: 9070 - DNA, 15 bp, Homo sapiens
attagcaactgtaag

SEQ ID NO: 9071 - DNA, 15 bp, Homo sapiens
cattagcaactgtaa

SEQ ID NO: 9072 - DNA, 15 bp, Homo sapiens
gcattagcaactgta

SEQ ID NO: 9073 - DNA, 15 bp, Homo sapiens
ggcattagcaactgt

SEQ ID NO: 9074 - DNA, 15 bp, Homo sapiens
aggcattagcaactg

SEQ ID NO: 9075 - DNA, 15 bp, Homo sapiens
gaggcattagcaact

SEQ ID NO: 9076 - DNA, 15 bp, Homo sapiens
tgaggcattagcaac

SEQ ID NO: 9077 - DNA, 15 bp, Homo sapiens
gtgaggcattagcaa

SEQ ID NO: 9078 - DNA, 15 bp, Homo sapiens
agtgaggcattagca

SEQ ID NO: 9079 - DNA, 15 bp, Homo sapiens
cagtgaggcattagc

SEQ ID NO: 9080 - DNA, 15 bp, Homo sapiens
tcagtgaggcattag

SEQ ID NO: 9081 - DNA, 15 bp, Homo sapiens
gtcagtgaggcatta

SEQ ID NO: 9082 - DNA, 15 bp, Homo sapiens
ggtcagtgaggcatt

SEQ ID NO: 9083 - DNA, 15 bp, Homo sapiens
aggtcagtgaggcat

SEQ ID NO: 9084 - DNA, 15 bp, Homo sapiens
aaggtcagtgaggca

SEQ ID NO: 9085 - DNA, 15 bp, Homo sapiens
aaaggtcagtgaggc

SEQ ID NO: 9086 - DNA, 15 bp, Homo sapiens
aaaaggtcagtgagg

SEQ ID NO: 9087 - DNA, 15 bp, Homo sapiens
caaaaggtcagtgag

SEQ ID NO: 9088 - DNA, 15 bp, Homo sapiens
ccaaaaggtcagtga

SEQ ID NO: 9089 - DNA, 15 bp, Homo sapiens
tccaaaaggtcagtg

SEQ ID NO: 9090 - DNA, 15 bp, Homo sapiens
ttccaaaaggtcagt

SEQ ID NO: 9091 - DNA, 15 bp, Homo sapiens
tttccaaaaggtcag

SEQ ID NO: 9092 - DNA, 15 bp, Homo sapiens
ctttccaaaaggtca

SEQ ID NO: 9093 - DNA, 15 bp, Homo sapiens
cctttccaaaaggtc

SEQ ID NO: 9094 - DNA, 15 bp, Homo sapiens
acctttccaaaaggt

SEQ ID NO: 9095 - DNA, 15 bp, Homo sapiens
gacctttccaaaagg

SEQ ID NO: 9096 - DNA, 15 bp, Homo sapiens
tgacctttccaaaag

SEQ ID NO: 9097 - DNA, 15 bp, Homo sapiens
atgacctttccaaaa

SEQ ID NO: 9098 - DNA, 15 bp, Homo sapiens
tatgacctttccaaa

SEQ ID NO: 9099 - DNA, 15 bp, Homo sapiens
ctatgacctttccaa

SEQ ID NO: 9100 - DNA, 15 bp, Homo sapiens
actatgacctttcca

SEQ ID NO: 9101 - DNA, 15 bp, Homo sapiens
aactatgacctttcc

SEQ ID NO: 9102 - DNA, 15 bp, Homo sapiens
taactatgacctttc

SEQ ID NO: 9103 - DNA, 15 bp, Homo sapiens
gtaactatgaccttt

SEQ ID NO: 9104 - DNA, 15 bp, Homo sapiens
agtaactatgacctt

SEQ ID NO: 9105 - DNA, 15 bp, Homo sapiens
gagtaactatgacct

SEQ ID NO: 9106 - DNA, 15 bp, Homo sapiens
agagtaactatgacc

SEQ ID NO: 9107 - DNA, 15 bp, Homo sapiens
aagagtaactatgac

SEQ ID NO: 9108 - DNA, 15 bp, Homo sapiens
gaagagtaactatga

SEQ ID NO: 9109 - DNA, 15 bp, Homo sapiens
tgaagagtaactatg

SEQ ID NO: 9110 - DNA, 15 bp, Homo sapiens
ttgaagagtaactat

SEQ ID NO: 9111 - DNA, 15 bp, Homo sapiens
cttgaagagtaacta

SEQ ID NO: 9112 - DNA, 15 bp, Homo sapiens
acttgaagagtaact

SEQ ID NO: 9113 - DNA, 15 bp, Homo sapiens
aacttgaagagtaac

SEQ ID NO: 9114 - DNA, 15 bp, Homo sapiens
caacttgaagagtaa

SEQ ID NO: 9115 - DNA, 15 bp, Homo sapiens
tcaacttgaagagta

SEQ ID NO: 9116 - DNA, 15 bp, Homo sapiens
ctcaacttgaagagt

SEQ ID NO: 9117 - DNA, 15 bp, Homo sapiens
gctcaacttgaagag

SEQ ID NO: 9118 - DNA, 15 bp, Homo sapiens
cgctcaacttgaaga

SEQ ID NO: 9119 - DNA, 15 bp, Homo sapiens
tcgctcaacttgaag

SEQ ID NO: 9120 - DNA, 15 bp, Homo sapiens
atcgctcaacttgaa

SEQ ID NO: 9121 - DNA, 15 bp, Homo sapiens
aatcgctcaacttga

SEQ ID NO: 9122 - DNA, 15 bp, Homo sapiens
aaatcgctcaacttg

SEQ ID NO: 9123 - DNA, 15 bp, Homo sapiens
aaaatcgctcaactt

SEQ ID NO: 9124 - DNA, 15 bp, Homo sapiens
aaaaatcgctcaact

SEQ ID NO: 9125 - DNA, 15 bp, Homo sapiens
gaaaaatcgctcaac

SEQ ID NO: 9126 - DNA, 15 bp, Homo sapiens
agaaaaatcgctcaa

SEQ ID NO: 9127 - DNA, 15 bp, Homo sapiens
gagaaaaatcgctca

SEQ ID NO: 9128 - DNA, 15 bp, Homo sapiens
ggagaaaaatcgctc

SEQ ID NO: 9129 - DNA, 15 bp, Homo sapiens
gggagaaaaatcgct

SEQ ID NO: 9130 - DNA, 15 bp, Homo sapiens
ggggagaaaaatcgc

SEQ ID NO: 9131 - DNA, 15 bp, Homo sapiens
gggggagaaaaatcg

SEQ ID NO: 9132 - DNA, 15 bp, Homo sapiens
tgggggagaaaaatc

SEQ ID NO: 9133 - DNA, 15 bp, Homo sapiens
ttgggggagaaaaat

SEQ ID NO: 9134 - DNA, 15 bp, Homo sapiens
cttgggggagaaaaa

SEQ ID NO: 9135 - DNA, 15 bp, Homo sapiens
tcttgggggagaaaa

SEQ ID NO: 9136 - DNA, 15 bp, Homo sapiens
ctcttgggggagaaa

SEQ ID NO: 9137 - DNA, 15 bp, Homo sapiens
gctcttgggggagaa

SEQ ID NO: 9138 - DNA, 15 bp, Homo sapiens
agctcttgggggaga

SEQ ID NO: 9139 - DNA, 15 bp, Homo sapiens
tagctcttgggggag

SEQ ID NO: 9140 - DNA, 15 bp, Homo sapiens
ttagctcttggggga

SEQ ID NO: 9141 - DNA, 15 bp, Homo sapiens
attagctcttggggg

SEQ ID NO: 9142 - DNA, 15 bp, Homo sapiens
aattagctcttgggg

SEQ ID NO: 9143 - DNA, 15 bp, Homo sapiens
taattagctcttggg

SEQ ID NO: 9144 - DNA, 15 bp, Homo sapiens
ttaattagctcttgg

SEQ ID NO: 9145 - DNA, 15 bp, Homo sapiens
tttaattagctcttg

SEQ ID NO: 9146 - DNA, 15 bp, Homo sapiens
ctttaattagctctt

SEQ ID NO: 9147 - DNA, 15 bp, Homo sapiens
actttaattagctct

SEQ ID NO: 9148 - DNA, 15 bp, Homo sapiens
aactttaattagctc

SEQ ID NO: 9149 - DNA, 15 bp, Homo sapiens
aaactttaattagct

SEQ ID NO: 9150 - DNA, 15 bp, Homo sapiens
gaaactttaattagc

SEQ ID NO: 9151 - DNA, 15 bp, Homo sapiens
agaaactttaattag

SEQ ID NO: 9152 - DNA, 15 bp, Homo sapiens
aagaaactttaatta

SEQ ID NO: 9153 - DNA, 15 bp, Homo sapiens
caagaaactttaatt

SEQ ID NO: 9154 - DNA, 15 bp, Homo sapiens
acaagaaactttaat

SEQ ID NO: 9155 - DNA, 15 bp, Homo sapiens
aacaagaaactttaa

SEQ ID NO: 9156 - DNA, 15 bp, Homo sapiens
aaacaagaaacttta

SEQ ID NO: 9157 - DNA, 15 bp, Homo sapiens
gaaacaagaaacttt

SEQ ID NO: 9158 - DNA, 15 bp, Homo sapiens
agaaacaagaaactt

SEQ ID NO: 9159 - DNA, 15 bp, Homo sapiens
cagaaacaagaaact

SEQ ID NO: 9160 - DNA, 15 bp, Homo sapiens
tcagaaacaagaaac

SEQ ID NO: 9161 - DNA, 15 bp, Homo sapiens
atcagaaacaagaaa

SEQ ID NO: 9162 - DNA, 15 bp, Homo sapiens
tatcagaaacaagaa

SEQ ID NO: 9163 - DNA, 15 bp, Homo sapiens
atatcagaaacaaga

SEQ ID NO: 9164 - DNA, 15 bp, Homo sapiens
catatcagaaacaag

SEQ ID NO: 9165 - DNA, 15 bp, Homo sapiens
gcatatcagaaacaa

SEQ ID NO: 9166 - DNA, 15 bp, Homo sapiens
agcatatcagaaaca

SEQ ID NO: 9167 - DNA, 15 bp, Homo sapiens
gagcatatcagaaac

SEQ ID NO: 9168 - DNA, 15 bp, Homo sapiens
agagcatatcagaaa

SEQ ID NO: 9169 - DNA, 15 bp, Homo sapiens
gagagcatatcagaa

SEQ ID NO: 9170 - DNA, 15 bp, Homo sapiens
ggagagcatatcaga

SEQ ID NO: 9171 - DNA, 15 bp, Homo sapiens
aggagagcatatcag

SEQ ID NO: 9172 - DNA, 15 bp, Homo sapiens
aaggagagcatatca

SEQ ID NO: 9173 - DNA, 15 bp, Homo sapiens
caaggagagcatatc

SEQ ID NO: 9174 - DNA, 15 bp, Homo sapiens
ccaaggagagcatat

SEQ ID NO: 9175 - DNA, 15 bp, Homo sapiens
gccaaggagagcata

SEQ ID NO: 9176 - DNA, 15 bp, Homo sapiens
tgccaaggagagcat

SEQ ID NO: 9177 - DNA, 15 bp, Homo sapiens
ttgccaaggagagca

SEQ ID NO: 9178 - DNA, 15 bp, Homo sapiens
tttgccaaggagagc

SEQ ID NO: 9179 - DNA, 15 bp, Homo sapiens
atttgccaaggagag

SEQ ID NO: 9180 - DNA, 15 bp, Homo sapiens
catttgccaaggaga

SEQ ID NO: 9181 - DNA, 15 bp, Homo sapiens
acatttgccaaggag

SEQ ID NO: 9182 - DNA, 15 bp, Homo sapiens
aacatttgccaagga

SEQ ID NO: 9183 - DNA, 15 bp, Homo sapiens
aaacatttgccaagg

SEQ ID NO: 9184 - DNA, 15 bp, Homo sapiens
caaacatttgccaag

SEQ ID NO: 9185 - DNA, 15 bp, Homo sapiens
tcaaacatttgccaa

SEQ ID NO: 9186 - DNA, 15 bp, Homo sapiens
ttcaaacatttgcca

SEQ ID NO: 9187 - DNA, 15 bp, Homo sapiens
tttcaaacatttgcc

SEQ ID NO: 9188 - DNA, 15 bp, Homo sapiens
ctttcaaacatttgc

SEQ ID NO: 9189 - DNA, 15 bp, Homo sapiens
actttcaaacatttg

SEQ ID NO: 9190 - DNA, 15 bp, Homo sapiens
gactttcaaacattt

SEQ ID NO: 9191 - DNA, 15 bp, Homo sapiens
agactttcaaacatt

SEQ ID NO: 9192 - DNA, 15 bp, Homo sapiens
tagactttcaaacat

SEQ ID NO: 9193 - DNA, 15 bp, Homo sapiens
ctagactttcaaaca

SEQ ID NO: 9194 - DNA, 15 bp, Homo sapiens
actagactttcaaac

SEQ ID NO: 9195 - DNA, 15 bp, Homo sapiens
tactagactttcaaa

SEQ ID NO: 9196 - DNA, 15 bp, Homo sapiens
atactagactttcaa

SEQ ID NO: 9197 - DNA, 15 bp, Homo sapiens
gatactagactttca

SEQ ID NO: 9198 - DNA, 15 bp, Homo sapiens
tgatactagactttc

SEQ ID NO: 9199 - DNA, 15 bp, Homo sapiens
ctgatactagacttt

SEQ ID NO: 9200 - DNA, 15 bp, Homo sapiens
tctgatactagactt

SEQ ID NO: 9201 - DNA, 15 bp, Homo sapiens
ctctgatactagact

SEQ ID NO: 9202 - DNA, 15 bp, Homo sapiens
gctctgatactagac

SEQ ID NO: 9203 - DNA, 15 bp, Homo sapiens
tgctctgatactaga

SEQ ID NO: 9204 - DNA, 15 bp, Homo sapiens
ctgctctgatactag

SEQ ID NO: 9205 - DNA, 15 bp, Homo sapiens
gctgctctgatacta

SEQ ID NO: 9206 - DNA, 15 bp, Homo sapiens
agctgctctgatact

SEQ ID NO: 9207 - DNA, 15 bp, Homo sapiens
cagctgctctgatac

SEQ ID NO: 9208 - DNA, 15 bp, Homo sapiens
acagctgctctgata

SEQ ID NO: 9209 - DNA, 15 bp, Homo sapiens
cacagctgctctgat

SEQ ID NO: 9210 - DNA, 15 bp, Homo sapiens
tcacagctgctctga

SEQ ID NO: 9211 - DNA, 15 bp, Homo sapiens
atcacagctgctctg

SEQ ID NO: 9212 - DNA, 15 bp, Homo sapiens
gatcacagctgctct

SEQ ID NO: 9213 - DNA, 15 bp, Homo sapiens
ggatcacagctgctc

SEQ ID NO: 9214 - DNA, 15 bp, Homo sapiens
aggatcacagctgct

SEQ ID NO: 9215 - DNA, 15 bp, Homo sapiens
caggatcacagctgc

SEQ ID NO: 9216 - DNA, 15 bp, Homo sapiens
gcaggatcacagctg

SEQ ID NO: 9217 - DNA, 15 bp, Homo sapiens
tgcaggatcacagct

SEQ ID NO: 9218 - DNA, 15 bp, Homo sapiens
atgcaggatcacagc

SEQ ID NO: 9219 - DNA, 15 bp, Homo sapiens
gatgcaggatcacag

SEQ ID NO: 9220 - DNA, 15 bp, Homo sapiens
agatgcaggatcaca

SEQ ID NO: 9221 - DNA, 15 bp, Homo sapiens
tagatgcaggatcac

SEQ ID NO: 9222 - DNA, 15 bp, Homo sapiens
atagatgcaggatca

SEQ ID NO: 9223 - DNA, 15 bp, Homo sapiens
gatagatgcaggatc

SEQ ID NO: 9224 - DNA, 15 bp, Homo sapiens
tgatagatgcaggat

SEQ ID NO: 9225 - DNA, 15 bp, Homo sapiens
ttgatagatgcagga

SEQ ID NO: 9226 - DNA, 15 bp, Homo sapiens
tttgatagatgcagg

SEQ ID NO: 9227 - DNA, 15 bp, Homo sapiens
ttttgatagatgcag

SEQ ID NO: 9228 - DNA, 15 bp, Homo sapiens
attttgatagatgca

SEQ ID NO: 9229 - DNA, 15 bp, Homo sapiens
aattttgatagatgc

SEQ ID NO: 9230 - DNA, 15 bp, Homo sapiens
aaattttgatagatg

SEQ ID NO: 9231 - DNA, 15 bp, Homo sapiens
taaattttgatagat

SEQ ID NO: 9232 - DNA, 15 bp, Homo sapiens
ataaattttgataga

SEQ ID NO: 9233 - DNA, 15 bp, Homo sapiens
tataaattttgatag

SEQ ID NO: 9234 - DNA, 15 bp, Homo sapiens
ttataaattttgata

SEQ ID NO: 9235 - DNA, 15 bp, Homo sapiens
gttataaattttgat

SEQ ID NO: 9236 - DNA, 15 bp, Homo sapiens
agttataaattttga

SEQ ID NO: 9237 - DNA, 15 bp, Homo sapiens
aagttataaattttg

SEQ ID NO: 9238 - DNA, 15 bp, Homo sapiens
gaagttataaatttt

SEQ ID NO: 9239 - DNA, 15 bp, Homo sapiens
ggaagttataaattt

SEQ ID NO: 9240 - DNA, 15 bp, Homo sapiens
aggaagttataaatt

SEQ ID NO: 9241 - DNA, 15 bp, Homo sapiens
taggaagttataaat

SEQ ID NO: 9242 - DNA, 15 bp, Homo sapiens
ctaggaagttataaa

SEQ ID NO: 9243 - DNA, 15 bp, Homo sapiens
tctaggaagttataa

SEQ ID NO: 9244 - DNA, 15 bp, Homo sapiens
ctctaggaagttata

SEQ ID NO: 9245 - DNA, 15 bp, Homo sapiens
tctctaggaagttat

SEQ ID NO: 9246 - DNA, 15 bp, Homo sapiens
ttctctaggaagtta

SEQ ID NO: 9247 - DNA, 15 bp, Homo sapiens
cttctctaggaagtt

SEQ ID NO: 9248 - DNA, 15 bp, Homo sapiens
acttctctaggaagt

SEQ ID NO: 9249 - DNA, 15 bp, Homo sapiens
aacttctctaggaag

SEQ ID NO: 9250 - DNA, 15 bp, Homo sapiens
aaacttctctaggaa

SEQ ID NO: 9251 - DNA, 15 bp, Homo sapiens
aaaacttctctagga

SEQ ID NO: 9252 - DNA, 15 bp, Homo sapiens
gaaaacttctctagg

SEQ ID NO: 9253 - DNA, 15 bp, Homo sapiens
tgaaaacttctctag

SEQ ID NO: 9254 - DNA, 15 bp, Homo sapiens
atgaaaacttctcta

SEQ ID NO: 9255 - DNA, 15 bp, Homo sapiens
aatgaaaacttctct

SEQ ID NO: 9256 - DNA, 15 bp, Homo sapiens
gaatgaaaacttctc

SEQ ID NO: 9257 - DNA, 15 bp, Homo sapiens
agaatgaaaacttct

SEQ ID NO: 9258 - DNA, 15 bp, Homo sapiens
cagaatgaaaacttc

SEQ ID NO: 9259 - DNA, 15 bp, Homo sapiens
ccagaatgaaaactt

SEQ ID NO: 9260 - DNA, 15 bp, Homo sapiens
gccagaatgaaaact

SEQ ID NO: 9261 - DNA, 15 bp, Homo sapiens
tgccagaatgaaaac

SEQ ID NO: 9262 - DNA, 15 bp, Homo sapiens
atgccagaatgaaaa

SEQ ID NO: 9263 - DNA, 15 bp, Homo sapiens
aatgccagaatgaaa

SEQ ID NO: 9264 - DNA, 15 bp, Homo sapiens
taatgccagaatgaa

SEQ ID NO: 9265 - DNA, 15 bp, Homo sapiens
ataatgccagaatga

SEQ ID NO: 9266 - DNA, 15 bp, Homo sapiens
aataatgccagaatg

SEQ ID NO: 9267 - DNA, 15 bp, Homo sapiens
gaataatgccagaat

SEQ ID NO: 9268 - DNA, 15 bp, Homo sapiens
ggaataatgccagaa

SEQ ID NO: 9269 - DNA, 15 bp, Homo sapiens
aggaataatgccaga

SEQ ID NO: 9270 - DNA, 15 bp, Homo sapiens
caggaataatgccag

SEQ ID NO: 9271 - DNA, 15 bp, Homo sapiens
ccaggaataatgcca

SEQ ID NO: 9272 - DNA, 15 bp, Homo sapiens
gccaggaataatgcc

SEQ ID NO: 9273 - DNA, 15 bp, Homo sapiens
ggccaggaataatgc

SEQ ID NO: 9274 - DNA, 15 bp, Homo sapiens
aggccaggaataatg

SEQ ID NO: 9275 - DNA, 15 bp, Homo sapiens
aaggccaggaataat

SEQ ID NO: 9276 - DNA, 15 bp, Homo sapiens
taaggccaggaataa

SEQ ID NO: 9277 - DNA, 15 bp, Homo sapiens
ttaaggccaggaata

SEQ ID NO: 9278 - DNA, 15 bp, Homo sapiens
gttaaggccaggaat

SEQ ID NO: 9279 - DNA, 15 bp, Homo sapiens
tgttaaggccaggaa

SEQ ID NO: 9280 - DNA, 15 bp, Homo sapiens
gtgttaaggccagga

SEQ ID NO: 9281 - DNA, 15 bp, Homo sapiens
agtgttaaggccagg

SEQ ID NO: 9282 - DNA, 15 bp, Homo sapiens
tagtgttaaggccag

SEQ ID NO: 9283 - DNA, 15 bp, Homo sapiens
ctagtgttaaggcca

SEQ ID NO: 9284 - DNA, 15 bp, Homo sapiens
tctagtgttaaggcc

SEQ ID NO: 9285 - DNA, 15 bp, Homo sapiens
ttctagtgttaaggc

SEQ ID NO: 9286 - DNA, 15 bp, Homo sapiens
attctagtgttaagg

SEQ ID NO: 9287 - DNA, 15 bp, Homo sapiens
cattctagtgttaag

SEQ ID NO: 9288 - DNA, 15 bp, Homo sapiens
gcattctagtgttaa

SEQ ID NO: 9289 - DNA, 15 bp, Homo sapiens
ggcattctagtgtta

SEQ ID NO: 9290 - DNA, 15 bp, Homo sapiens
gggcattctagtgtt

SEQ ID NO: 9291 - DNA, 15 bp, Homo sapiens
agggcattctagtgt

SEQ ID NO: 9292 - DNA, 15 bp, Homo sapiens
cagggcattctagtg

SEQ ID NO: 9293 - DNA, 15 bp, Homo sapiens
acagggcattctagt

SEQ ID NO: 9294 - DNA, 15 bp, Homo sapiens
aacagggcattctag

SEQ ID NO: 9295 - DNA, 15 bp, Homo sapiens
caacagggcattcta

SEQ ID NO: 9296 - DNA, 15 bp, Homo sapiens
tcaacagggcattct

SEQ ID NO: 9297 - DNA, 15 bp, Homo sapiens
ttcaacagggcattc

SEQ ID NO: 9298 - DNA, 15 bp, Homo sapiens
tttcaacagggcatt

SEQ ID NO: 9299 - DNA, 15 bp, Homo sapiens
ctttcaacagggcat

SEQ ID NO: 9300 - DNA, 15 bp, Homo sapiens
gctttcaacagggca

SEQ ID NO: 9301 - DNA, 15 bp, Homo sapiens
tgctttcaacagggc

SEQ ID NO: 9302 - DNA, 15 bp, Homo sapiens
atgctttcaacaggg

SEQ ID NO: 9303 - DNA, 15 bp, Homo sapiens
tatgctttcaacagg

SEQ ID NO: 9304 - DNA, 15 bp, Homo sapiens
gtatgctttcaacag

SEQ ID NO: 9305 - DNA, 15 bp, Homo sapiens
tgtatgctttcaaca

SEQ ID NO: 9306 - DNA, 15 bp, Homo sapiens
ctgtatgctttcaac

SEQ ID NO: 9307 - DNA, 15 bp, Homo sapiens
actgtatgctttcaa

SEQ ID NO: 9308 - DNA, 15 bp, Homo sapiens
tactgtatgctttca

SEQ ID NO: 9309 - DNA, 15 bp, Homo sapiens
ttactgtatgctttc

SEQ ID NO: 9310 - DNA, 15 bp, Homo sapiens
gttactgtatgcttt

SEQ ID NO: 9311 - DNA, 15 bp, Homo sapiens
tgttactgtatgctt

SEQ ID NO: 9312 - DNA, 15 bp, Homo sapiens
atgttactgtatgct

SEQ ID NO: 9313 - DNA, 15 bp, Homo sapiens
aatgttactgtatgc

SEQ ID NO: 9314 - DNA, 15 bp, Homo sapiens
aaatgttactgtatg

SEQ ID NO: 9315 - DNA, 15 bp, Homo sapiens
taaatgttactgtat

SEQ ID NO: 9316 - DNA, 15 bp, Homo sapiens
ataaatgttactgta

SEQ ID NO: 9317 - DNA, 15 bp, Homo sapiens
aataaatgttactgt

SEQ ID NO: 9318 - DNA, 15 bp, Homo sapiens
taataaatgttactg

SEQ ID NO: 9319 - DNA, 15 bp, Homo sapiens
ataataaatgttact

SEQ ID NO: 9320 - DNA, 15 bp, Homo sapiens
tataataaatgttac

SEQ ID NO: 9321 - DNA, 15 bp, Homo sapiens
gtataataaatgtta

SEQ ID NO: 9322 - DNA, 15 bp, Homo sapiens
agtataataaatgtt

SEQ ID NO: 9323 - DNA, 15 bp, Homo sapiens
gagtataataaatgt

SEQ ID NO: 9324 - DNA, 15 bp, Homo sapiens
tgagtataataaatg

SEQ ID NO: 9325 - DNA, 15 bp, Homo sapiens
atgagtataataaat

SEQ ID NO: 9326 - DNA, 15 bp, Homo sapiens
aatgagtataataaa

SEQ ID NO: 9327 - DNA, 15 bp, Homo sapiens
gaatgagtataataa

SEQ ID NO: 9328 - DNA, 15 bp, Homo sapiens
agaatgagtataata

SEQ ID NO: 9329 - DNA, 15 bp, Homo sapiens
cagaatgagtataat

SEQ ID NO: 9330 - DNA, 15 bp, Homo sapiens
ccagaatgagtataa

SEQ ID NO: 9331 - DNA, 15 bp, Homo sapiens
accagaatgagtata

SEQ ID NO: 9332 - DNA, 15 bp, Homo sapiens
aaccagaatgagtat

SEQ ID NO: 9333 - DNA, 15 bp, Homo sapiens
caaccagaatgagta

SEQ ID NO: 9334 - DNA, 15 bp, Homo sapiens
acaaccagaatgagt

SEQ ID NO: 9335 - DNA, 15 bp, Homo sapiens
gacaaccagaatgag

SEQ ID NO: 9336 - DNA, 15 bp, Homo sapiens
agacaaccagaatga

SEQ ID NO: 9337 - DNA, 15 bp, Homo sapiens
cagacaaccagaatg

SEQ ID NO: 9338 - DNA, 15 bp, Homo sapiens
acagacaaccagaat

SEQ ID NO: 9339 - DNA, 15 bp, Homo sapiens
aacagacaaccagaa

SEQ ID NO: 9340 - DNA, 15 bp, Homo sapiens
aaacagacaaccaga

SEQ ID NO: 9341 - DNA, 15 bp, Homo sapiens
caaacagacaaccag

SEQ ID NO: 9342 - DNA, 15 bp, Homo sapiens
gcaaacagacaacca

SEQ ID NO: 9343 - DNA, 15 bp, Homo sapiens
ggcaaacagacaacc

SEQ ID NO: 9344 - DNA, 15 bp, Homo sapiens
gggcaaacagacaac

SEQ ID NO: 9345 - DNA, 15 bp, Homo sapiens
agggcaaacagacaa

SEQ ID NO: 9346 - DNA, 15 bp, Homo sapiens
tagggcaaacagaca

SEQ ID NO: 9347 - DNA, 15 bp, Homo sapiens
ctagggcaaacagac

SEQ ID NO: 9348 - DNA, 15 bp, Homo sapiens
gctagggcaaacaga

SEQ ID NO: 9349 - DNA, 15 bp, Homo sapiens
agctagggcaaacag

SEQ ID NO: 9350 - DNA, 15 bp, Homo sapiens
gagctagggcaaaca

SEQ ID NO: 9351 - DNA, 15 bp, Homo sapiens
tgagctagggcaaac

SEQ ID NO: 9352 - DNA, 15 bp, Homo sapiens
gtgagctagggcaaa

SEQ ID NO: 9353 - DNA, 15 bp, Homo sapiens
agtgagctagggcaa

SEQ ID NO: 9354 - DNA, 15 bp, Homo sapiens
cagtgagctagggca

SEQ ID NO: 9355 - DNA, 15 bp, Homo sapiens
ccagtgagctagggc

SEQ ID NO: 9356 - DNA, 15 bp, Homo sapiens
tccagtgagctaggg

SEQ ID NO: 9357 - DNA, 15 bp, Homo sapiens
gtccagtgagctagg

SEQ ID NO: 9358 - DNA, 15 bp, Homo sapiens
cgtccagtgagctag

SEQ ID NO: 9359 - DNA, 15 bp, Homo sapiens
acgtccagtgagcta

SEQ ID NO: 9360 - DNA, 15 bp, Homo sapiens
aacgtccagtgagct

SEQ ID NO: 9361 - DNA, 15 bp, Homo sapiens
caacgtccagtgagc

SEQ ID NO: 9362 - DNA, 15 bp, Homo sapiens
ccaacgtccagtgag

SEQ ID NO: 9363 - DNA, 15 bp, Homo sapiens
accaacgtccagtga

SEQ ID NO: 9364 - DNA, 15 bp, Homo sapiens
caccaacgtccagtg

SEQ ID NO: 9365 - DNA, 15 bp, Homo sapiens
ccaccaacgtccagt

SEQ ID NO: 9366 - DNA, 15 bp, Homo sapiens
accaccaacgtccag

SEQ ID NO: 9367 - DNA, 15 bp, Homo sapiens
caccaccaacgtcca

SEQ ID NO: 9368 - DNA, 15 bp, Homo sapiens
tcaccaccaacgtcc

SEQ ID NO: 9369 - DNA, 15 bp, Homo sapiens
atcaccaccaacgtc

SEQ ID NO: 9370 - DNA, 15 bp, Homo sapiens
aatcaccaccaacgt

SEQ ID NO: 9371 - DNA, 15 bp, Homo sapiens
caatcaccaccaacg

SEQ ID NO: 9372 - DNA, 15 bp, Homo sapiens
ccaatcaccaccaac

SEQ ID NO: 9373 - DNA, 15 bp, Homo sapiens
gccaatcaccaccaa

SEQ ID NO: 9374 - DNA, 15 bp, Homo sapiens
tgccaatcaccacca

SEQ ID NO: 9375 - DNA, 15 bp, Homo sapiens
atgccaatcaccacc

SEQ ID NO: 9376 - DNA, 15 bp, Homo sapiens
gatgccaatcaccac

SEQ ID NO: 9377 - DNA, 15 bp, Homo sapiens
agatgccaatcacca

SEQ ID NO: 9378 - DNA, 15 bp, Homo sapiens
cagatgccaatcacc

SEQ ID NO: 9379 - DNA, 15 bp, Homo sapiens
acagatgccaatcac

SEQ ID NO: 9380 - DNA, 15 bp, Homo sapiens
gacagatgccaatca

SEQ ID NO: 9381 - DNA, 15 bp, Homo sapiens
tgacagatgccaatc

SEQ ID NO: 9382 - DNA, 15 bp, Homo sapiens
ctgacagatgccaat

SEQ ID NO: 9383 - DNA, 15 bp, Homo sapiens
cctgacagatgccaa

SEQ ID NO: 9384 - DNA, 15 bp, Homo sapiens
tcctgacagatgcca

SEQ ID NO: 9385 - DNA, 15 bp, Homo sapiens
gtcctgacagatgcc

SEQ ID NO: 9386 - DNA, 15 bp, Homo sapiens
agtcctgacagatgc

SEQ ID NO: 9387 - DNA, 15 bp, Homo sapiens
aagtcctgacagatg

SEQ ID NO: 9388 - DNA, 15 bp, Homo sapiens
caagtcctgacagat

SEQ ID NO: 9389 - DNA, 15 bp, Homo sapiens
ccaagtcctgacaga

SEQ ID NO: 9390 - DNA, 15 bp, Homo sapiens
accaagtcctgacag

SEQ ID NO: 9391 - DNA, 15 bp, Homo sapiens
caccaagtcctgaca

SEQ ID NO: 9392 - DNA, 15 bp, Homo sapiens
ccaccaagtcctgac

SEQ ID NO: 9393 - DNA, 15 bp, Homo sapiens
accaccaagtcctga

SEQ ID NO: 9394 - DNA, 15 bp, Homo sapiens
gaccaccaagtcctg

SEQ ID NO: 9395 - DNA, 15 bp, Homo sapiens
ggaccaccaagtcct

SEQ ID NO: 9396 - DNA, 15 bp, Homo sapiens
aggaccaccaagtcc

SEQ ID NO: 9397 - DNA, 15 bp, Homo sapiens
caggaccaccaagtc

SEQ ID NO: 9398 - DNA, 15 bp, Homo sapiens
ccaggaccaccaagt

SEQ ID NO: 9399 - DNA, 15 bp, Homo sapiens
accaggaccaccaag

SEQ ID NO: 9400 - DNA, 15 bp, Homo sapiens
caccaggaccaccaa

SEQ ID NO: 9401 - DNA, 15 bp, Homo sapiens
gcaccaggaccacca

SEQ ID NO: 9402 - DNA, 15 bp, Homo sapiens
ggcaccaggaccacc

SEQ ID NO: 9403 - DNA, 15 bp, Homo sapiens
aggcaccaggaccac

SEQ ID NO: 9404 - DNA, 15 bp, Homo sapiens
gaggcaccaggacca

SEQ ID NO: 9405 - DNA, 15 bp, Homo sapiens
ggaggcaccaggacc

SEQ ID NO: 9406 - DNA, 15 bp, Homo sapiens
aggaggcaccaggac

SEQ ID NO: 9407 - DNA, 15 bp, Homo sapiens
caggaggcaccagga

SEQ ID NO: 9408 - DNA, 15 bp, Homo sapiens
acaggaggcaccagg

SEQ ID NO: 9409 - DNA, 15 bp, Homo sapiens
aacaggaggcaccag

SEQ ID NO: 9410 - DNA, 15 bp, Homo sapiens
aaacaggaggcacca

SEQ ID NO: 9411 - DNA, 15 bp, Homo sapiens
aaaacaggaggcacc

SEQ ID NO: 9412 - DNA, 15 bp, Homo sapiens
aaaaacaggaggcac

SEQ ID NO: 9413 - DNA, 15 bp, Homo sapiens
taaaaacaggaggca

SEQ ID NO: 9414 - DNA, 15 bp, Homo sapiens
ataaaaacaggaggc

SEQ ID NO: 9415 - DNA, 15 bp, Homo sapiens
aataaaaacaggagg

SEQ ID NO: 9416 - DNA, 15 bp, Homo sapiens
aaataaaaacaggag

SEQ ID NO: 9417 - DNA, 15 bp, Homo sapiens
aaaataaaaacagga

SEQ ID NO: 9418 - DNA, 15 bp, Homo sapiens
aaaaataaaaacagg

SEQ ID NO: 9419 - DNA, 15 bp, Homo sapiens
gaaaaataaaaacag

SEQ ID NO: 9420 - DNA, 15 bp, Homo sapiens
agaaaaataaaaaca

SEQ ID NO: 9421 - DNA, 15 bp, Homo sapiens
aagaaaaataaaaac

SEQ ID NO: 9422 - DNA, 15 bp, Homo sapiens
aaagaaaaataaaaa

SEQ ID NO: 9423 - DNA, 15 bp, Homo sapiens
aaaagaaaaataaaa

SEQ ID NO: 9424 - DNA, 15 bp, Homo sapiens
aaaaagaaaaataaa

SEQ ID NO: 9425 - DNA, 15 bp, Homo sapiens
caaaaagaaaaataa

SEQ ID NO: 9426 - DNA, 15 bp, Homo sapiens
acaaaaagaaaaata

SEQ ID NO: 9427 - DNA, 15 bp, Homo sapiens
gacaaaaagaaaaat

SEQ ID NO: 9428 - DNA, 15 bp, Homo sapiens
ggacaaaaagaaaaa

SEQ ID NO: 9429 - DNA, 15 bp, Homo sapiens
aggacaaaaagaaaa

SEQ ID NO: 9430 - DNA, 15 bp, Homo sapiens
caggacaaaaagaaa

SEQ ID NO: 9431 - DNA, 15 bp, Homo sapiens
gcaggacaaaaagaa

SEQ ID NO: 9432 - DNA, 15 bp, Homo sapiens
agcaggacaaaaaga

SEQ ID NO: 9433 - DNA, 15 bp, Homo sapiens
gagcaggacaaaaag

SEQ ID NO: 9434 - DNA, 15 bp, Homo sapiens
tgagcaggacaaaaa

SEQ ID NO: 9435 - DNA, 15 bp, Homo sapiens
ttgagcaggacaaaa

SEQ ID NO: 9436 - DNA, 15 bp, Homo sapiens
tttgagcaggacaaa

SEQ ID NO: 9437 - DNA, 15 bp, Homo sapiens
gtttgagcaggacaa

SEQ ID NO: 9438 - DNA, 15 bp, Homo sapiens
tgtttgagcaggaca

SEQ ID NO: 9439 - DNA, 15 bp, Homo sapiens
ctgtttgagcaggac

SEQ ID NO: 9440 - DNA, 15 bp, Homo sapiens
tctgtttgagcagga

SEQ ID NO: 9441 - DNA, 15 bp, Homo sapiens
atctgtttgagcagg

SEQ ID NO: 9442 - DNA, 15 bp, Homo sapiens
tatctgtttgagcag

SEQ ID NO: 9443 - DNA, 15 bp, Homo sapiens
atatctgtttgagca

SEQ ID NO: 9444 - DNA, 15 bp, Homo sapiens
aatatctgtttgagc

SEQ ID NO: 9445 - DNA, 15 bp, Homo sapiens
aaatatctgtttgag

SEQ ID NO: 9446 - DNA, 15 bp, Homo sapiens
gaaatatctgtttga

SEQ ID NO: 9447 - DNA, 15 bp, Homo sapiens
agaaatatctgtttg

SEQ ID NO: 9448 - DNA, 15 bp, Homo sapiens
aagaaatatctgttt

SEQ ID NO: 9449 - DNA, 15 bp, Homo sapiens
taagaaatatctgtt

SEQ ID NO: 9450 - DNA, 15 bp, Homo sapiens
ataagaaatatctgt

SEQ ID NO: 9451 - DNA, 15 bp, Homo sapiens
aataagaaatatctg

SEQ ID NO: 9452 - DNA, 15 bp, Homo sapiens
gaataagaaatatct

SEQ ID NO: 9453 - DNA, 15 bp, Homo sapiens
tgaataagaaatatc

SEQ ID NO: 9454 - DNA, 15 bp, Homo sapiens
atgaataagaaatat

SEQ ID NO: 9455 - DNA, 15 bp, Homo sapiens
catgaataagaaata

SEQ ID NO: 9456 - DNA, 15 bp, Homo sapiens
gcatgaataagaaat

SEQ ID NO: 9457 - DNA, 15 bp, Homo sapiens
ggcatgaataagaaa

SEQ ID NO: 9458 - DNA, 15 bp, Homo sapiens
cggcatgaataagaa

SEQ ID NO: 9459 - DNA, 15 bp, Homo sapiens
acggcatgaataaga

SEQ ID NO: 9460 - DNA, 15 bp, Homo sapiens
gacggcatgaataag

SEQ ID NO: 9461 - DNA, 15 bp, Homo sapiens
agacggcatgaataa

SEQ ID NO: 9462 - DNA, 15 bp, Homo sapiens
aagacggcatgaata

SEQ ID NO: 9463 - DNA, 15 bp, Homo sapiens
gaagacggcatgaat

SEQ ID NO: 9464 - DNA, 15 bp, Homo sapiens
agaagacggcatgaa

SEQ ID NO: 9465 - DNA, 15 bp, Homo sapiens
tagaagacggcatga

SEQ ID NO: 9466 - DNA, 15 bp, Homo sapiens
ttagaagacggcatg

SEQ ID NO: 9467 - DNA, 15 bp, Homo sapiens
attagaagacggcat

SEQ ID NO: 9468 - DNA, 15 bp, Homo sapiens
cattagaagacggca

SEQ ID NO: 9469 - DNA, 15 bp, Homo sapiens
tcattagaagacggc

SEQ ID NO: 9470 - DNA, 15 bp, Homo sapiens
ctcattagaagacgg

SEQ ID NO: 9471 - DNA, 15 bp, Homo sapiens
actcattagaagacg

SEQ ID NO: 9472 - DNA, 15 bp, Homo sapiens
gactcattagaagac

SEQ ID NO: 9473 - DNA, 15 bp, Homo sapiens
tgactcattagaaga

SEQ ID NO: 9474 - DNA, 15 bp, Homo sapiens
atgactcattagaag

SEQ ID NO: 9475 - DNA, 15 bp, Homo sapiens
aatgactcattagaa

SEQ ID NO: 9476 - DNA, 15 bp, Homo sapiens
aaatgactcattaga

SEQ ID NO: 9477 - DNA, 15 bp, Homo sapiens
caaatgactcattag

SEQ ID NO: 9478 - DNA, 15 bp, Homo sapiens
ccaaatgactcatta

SEQ ID NO: 9479 - DNA, 15 bp, Homo sapiens
tccaaatgactcatt

SEQ ID NO: 9480 - DNA, 15 bp, Homo sapiens
atccaaatgactcat

SEQ ID NO: 9481 - DNA, 15 bp, Homo sapiens
aatccaaatgactca

SEQ ID NO: 9482 - DNA, 15 bp, Homo sapiens
gaatccaaatgactc

SEQ ID NO: 9483 - DNA, 15 bp, Homo sapiens
tgaatccaaatgact

SEQ ID NO: 9484 - DNA, 15 bp, Homo sapiens
atgaatccaaatgac

SEQ ID NO: 9485 - DNA, 15 bp, Homo sapiens
aatgaatccaaatga

SEQ ID NO: 9486 - DNA, 15 bp, Homo sapiens
taatgaatccaaatg

SEQ ID NO: 9487 - DNA, 15 bp, Homo sapiens
ataatgaatccaaat

SEQ ID NO: 9488 - DNA, 15 bp, Homo sapiens
aataatgaatccaaa

SEQ ID NO: 9489 - DNA, 15 bp, Homo sapiens
caataatgaatccaa

SEQ ID NO: 9490 - DNA, 15 bp, Homo sapiens
gcaataatgaatcca

SEQ ID NO: 9491 - DNA, 15 bp, Homo sapiens
ggcaataatgaatcc

SEQ ID NO: 9492 - DNA, 15 bp, Homo sapiens
tggcaataatgaatc

SEQ ID NO: 9493 - DNA, 15 bp, Homo sapiens
atggcaataatgaat

SEQ ID NO: 9494 - DNA, 15 bp, Homo sapiens
tatggcaataatgaa

SEQ ID NO: 9495 - DNA, 15 bp, Homo sapiens
ttatggcaataatga

SEQ ID NO: 9496 - DNA, 15 bp, Homo sapiens
tttatggcaataatg

SEQ ID NO: 9497 - DNA, 15 bp, Homo sapiens
atttatggcaataat

SEQ ID NO: 9498 - DNA, 15 bp, Homo sapiens
gatttatggcaataa

SEQ ID NO: 9499 - DNA, 15 bp, Homo sapiens
tgatttatggcaata

SEQ ID NO: 9500 - DNA, 15 bp, Homo sapiens
atgatttatggcaat

SEQ ID NO: 9501 - DNA, 15 bp, Homo sapiens
aatgatttatggcaa

SEQ ID NO: 9502 - DNA, 15 bp, Homo sapiens
aaatgatttatggca

SEQ ID NO: 9503 - DNA, 15 bp, Homo sapiens
caaatgatttatggc

SEQ ID NO: 9504 - DNA, 15 bp, Homo sapiens
ccaaatgatttatgg

SEQ ID NO: 9505 - DNA, 15 bp, Homo sapiens
tccaaatgatttatg

SEQ ID NO: 9506 - DNA, 15 bp, Homo sapiens
ctccaaatgatttat

SEQ ID NO: 9507 - DNA, 15 bp, Homo sapiens
cctccaaatgattta

SEQ ID NO: 9508 - DNA, 15 bp, Homo sapiens
tcctccaaatgattt

SEQ ID NO: 9509 - DNA, 15 bp, Homo sapiens
ctcctccaaatgatt

SEQ ID NO: 9510 - DNA, 15 bp, Homo sapiens
actcctccaaatgat

SEQ ID NO: 9511 - DNA, 15 bp, Homo sapiens
cactcctccaaatga

SEQ ID NO: 9512 - DNA, 15 bp, Homo sapiens
acactcctccaaatg

SEQ ID NO: 9513 - DNA, 15 bp, Homo sapiens
aacactcctccaaat

SEQ ID NO: 9514 - DNA, 15 bp, Homo sapiens
aaacactcctccaaa

SEQ ID NO: 9515 - DNA, 15 bp, Homo sapiens
aaaacactcctccaa

SEQ ID NO: 9516 - DNA, 15 bp, Homo sapiens
gaaaacactcctcca

SEQ ID NO: 9517 - DNA, 15 bp, Homo sapiens
tgaaaacactcctcc

SEQ ID NO: 9518 - DNA, 15 bp, Homo sapiens
atgaaaacactcctc

SEQ ID NO: 9519 - DNA, 15 bp, Homo sapiens
catgaaaacactcct

SEQ ID NO: 9520 - DNA, 15 bp, Homo sapiens
tcatgaaaacactcc

SEQ ID NO: 9521 - DNA, 15 bp, Homo sapiens
atcatgaaaacactc

SEQ ID NO: 9522 - DNA, 15 bp, Homo sapiens
aatcatgaaaacact

SEQ ID NO: 9523 - DNA, 15 bp, Homo sapiens
aaatcatgaaaacac

SEQ ID NO: 9524 - DNA, 15 bp, Homo sapiens
taaatcatgaaaaca

SEQ ID NO: 9525 - DNA, 15 bp, Homo sapiens
gtaaatcatgaaaac

SEQ ID NO: 9526 - DNA, 15 bp, Homo sapiens
agtaaatcatgaaaa

SEQ ID NO: 9527 - DNA, 15 bp, Homo sapiens
tagtaaatcatgaaa

SEQ ID NO: 9528 - DNA, 15 bp, Homo sapiens
ttagtaaatcatgaa

SEQ ID NO: 9529 - DNA, 15 bp, Homo sapiens
cttagtaaatcatga

SEQ ID NO: 9530 - DNA, 15 bp, Homo sapiens
acttagtaaatcatg

SEQ ID NO: 9531 - DNA, 15 bp, Homo sapiens
tacttagtaaatcat

SEQ ID NO: 9532 - DNA, 15 bp, Homo sapiens
ctacttagtaaatca

SEQ ID NO: 9533 - DNA, 15 bp, Homo sapiens
tctacttagtaaatc

SEQ ID NO: 9534 - DNA, 15 bp, Homo sapiens
atctacttagtaaat

SEQ ID NO: 9535 - DNA, 15 bp, Homo sapiens
gatctacttagtaaa

SEQ ID NO: 9536 - DNA, 15 bp, Homo sapiens
agatctacttagtaa

SEQ ID NO: 9537 - DNA, 15 bp, Homo sapiens
aagatctacttagta

SEQ ID NO: 9538 - DNA, 15 bp, Homo sapiens
aaagatctacttagt

SEQ ID NO: 9539 - DNA, 15 bp, Homo sapiens
aaaagatctacttag

SEQ ID NO: 9540 - DNA, 15 bp, Homo sapiens
taaaagatctactta

SEQ ID NO: 9541 - DNA, 15 bp, Homo sapiens
ttaaaagatctactt

SEQ ID NO: 9542 - DNA, 15 bp, Homo sapiens
tttaaaagatctact

SEQ ID NO: 9543 - DNA, 15 bp, Homo sapiens
ctttaaaagatctac

SEQ ID NO: 9544 - DNA, 15 bp, Homo sapiens
tctttaaaagatcta

SEQ ID NO: 9545 - DNA, 15 bp, Homo sapiens
ttctttaaaagatct

SEQ ID NO: 9546 - DNA, 15 bp, Homo sapiens
cttctttaaaagatc

SEQ ID NO: 9547 - DNA, 15 bp, Homo sapiens
tcttctttaaaagat

SEQ ID NO: 9548 - DNA, 15 bp, Homo sapiens
atcttctttaaaaga

SEQ ID NO: 9549 - DNA, 15 bp, Homo sapiens
aatcttctttaaaag

SEQ ID NO: 9550 - DNA, 15 bp, Homo sapiens
aaatcttctttaaaa

SEQ ID NO: 9551 - DNA, 15 bp, Homo sapiens
aaaatcttctttaaa

SEQ ID NO: 9552 - DNA, 15 bp, Homo sapiens
taaaatcttctttaa

SEQ ID NO: 9553 - DNA, 15 bp, Homo sapiens
ataaaatcttcttta

SEQ ID NO: 9554 - DNA, 15 bp, Homo sapiens
aataaaatcttcttt

SEQ ID NO: 9555 - DNA, 15 bp, Homo sapiens
taataaaatcttctt

SEQ ID NO: 9556 - DNA, 15 bp, Homo sapiens
ataataaaatcttct

SEQ ID NO: 9557 - DNA, 15 bp, Homo sapiens
cataataaaatcttc

SEQ ID NO: 9558 - DNA, 15 bp, Homo sapiens
tcataataaaatctt

SEQ ID NO: 9559 - DNA, 15 bp, Homo sapiens
ttcataataaaatct

SEQ ID NO: 9560 - DNA, 15 bp, Homo sapiens
tttcataataaaatc

SEQ ID NO: 9561 - DNA, 15 bp, Homo sapiens
atttcataataaaat

SEQ ID NO: 9562 - DNA, 15 bp, Homo sapiens
tatttcataataaaa

SEQ ID NO: 9563 - DNA, 15 bp, Homo sapiens
atatttcataataaa

SEQ ID NO: 9564 - DNA, 15 bp, Homo sapiens
catatttcataataa

SEQ ID NO: 9565 - DNA, 15 bp, Homo sapiens
gcatatttcataata

SEQ ID NO: 9566 - DNA, 15 bp, Homo sapiens
tgcatatttcataat

SEQ ID NO: 9567 - DNA, 15 bp, Homo sapiens
ttgcatatttcataa

SEQ ID NO: 9568 - DNA, 15 bp, Homo sapiens
tttgcatatttcata

SEQ ID NO: 9569 - DNA, 15 bp, Homo sapiens
gtttgcatatttcat

SEQ ID NO: 9570 - DNA, 15 bp, Homo sapiens
tgtttgcatatttca

SEQ ID NO: 9571 - DNA, 15 bp, Homo sapiens
atgtttgcatatttc

SEQ ID NO: 9572 - DNA, 15 bp, Homo sapiens
aatgtttgcatattt

SEQ ID NO: 9573 - DNA, 15 bp, Homo sapiens
aaatgtttgcatatt

SEQ ID NO: 9574 - DNA, 15 bp, Homo sapiens
aaaatgtttgcatat

SEQ ID NO: 9575 - DNA, 15 bp, Homo sapiens
taaaatgtttgcata

SEQ ID NO: 9576 - DNA, 15 bp, Homo sapiens
ttaaaatgtttgcat

SEQ ID NO: 9577 - DNA, 15 bp, Homo sapiens
cttaaaatgtttgca

SEQ ID NO: 9578 - DNA, 15 bp, Homo sapiens
gcttaaaatgtttgc

SEQ ID NO: 9579 - DNA, 15 bp, Homo sapiens
tgcttaaaatgtttg

SEQ ID NO: 9580 - DNA, 15 bp, Homo sapiens
ttgcttaaaatgttt

SEQ ID NO: 9581 - DNA, 15 bp, Homo sapiens
attgcttaaaatgtt

SEQ ID NO: 9582 - DNA, 15 bp, Homo sapiens
aattgcttaaaatgt

SEQ ID NO: 9583 - DNA, 15 bp, Homo sapiens
aaattgcttaaaatg

SEQ ID NO: 9584 - DNA, 15 bp, Homo sapiens
aaaattgcttaaaat

SEQ ID NO: 9585 - DNA, 15 bp, Homo sapiens
aaaaattgcttaaaa

SEQ ID NO: 9586 - DNA, 15 bp, Homo sapiens
aaaaaattgcttaaa

SEQ ID NO: 9587 - DNA, 15 bp, Homo sapiens
taaaaaattgcttaa

SEQ ID NO: 9588 - DNA, 15 bp, Homo sapiens
ttaaaaaattgctta

SEQ ID NO: 9589 - DNA, 15 bp, Homo sapiens
attaaaaaattgctt

SEQ ID NO: 9590 - DNA, 15 bp, Homo sapiens
aattaaaaaattgct

SEQ ID NO: 9591 - DNA, 15 bp, Homo sapiens
taattaaaaaattgc

SEQ ID NO: 9592 - DNA, 15 bp, Homo sapiens
ttaattaaaaaattg

SEQ ID NO: 9593 - DNA, 15 bp, Homo sapiens
tttaattaaaaaatt

SEQ ID NO: 9594 - DNA, 15 bp, Homo sapiens
ttttaattaaaaaat

SEQ ID NO: 9595 - DNA, 15 bp, Homo sapiens
tttttaattaaaaaa

SEQ ID NO: 9596 - DNA, 15 bp, Homo sapiens
ttttttaattaaaaa

SEQ ID NO: 9597 - DNA, 15 bp, Homo sapiens
tttttttaattaaaa

SEQ ID NO: 9598 - DNA, 15 bp, Homo sapiens
ttttttttaattaaa

SEQ ID NO: 9599 - DNA, 15 bp, Homo sapiens
attttttttaattaa

SEQ ID NO: 9600 - DNA, 15 bp, Homo sapiens
aattttttttaatta

SEQ ID NO: 9601 - DNA, 15 bp, Homo sapiens
gaattttttttaatt

SEQ ID NO: 9602 - DNA, 15 bp, Homo sapiens
cgaattttttttaat

SEQ ID NO: 9603 - DNA, 15 bp, Homo sapiens
tcgaattttttttaa

SEQ ID NO: 9604 - DNA, 15 bp, Homo sapiens
gtcgaatttttttta

SEQ ID NO: 9605 - DNA, 15 bp, Homo sapiens
ggtcgaatttttttt

SEQ ID NO: 9606 - DNA, 15 bp, Homo sapiens
aggtcgaattttttt

SEQ ID NO: 9607 - DNA, 15 bp, Homo sapiens
gaggtcgaatttttt

SEQ ID NO: 9608 - DNA, 15 bp, Homo sapiens
ggaggtcgaattttt

SEQ ID NO: 9609 - DNA, 15 bp, Homo sapiens
tggaggtcgaatttt

SEQ ID NO: 9610 - DNA, 15 bp, Homo sapiens
ttggaggtcgaattt

SEQ ID NO: 9611 - DNA, 15 bp, Homo sapiens
cttggaggtcgaatt

SEQ ID NO: 9612 - DNA, 15 bp, Homo sapiens
tcttggaggtcgaat

SEQ ID NO: 9613 - DNA, 15 bp, Homo sapiens
atcttggaggtcgaa

SEQ ID NO: 9614 - DNA, 15 bp, Homo sapiens
aatcttggaggtcga

SEQ ID NO: 9615 - DNA, 15 bp, Homo sapiens
taatcttggaggtcg

SEQ ID NO: 9616 - DNA, 15 bp, Homo sapiens
ttaatcttggaggtc

SEQ ID NO: 9617 - DNA, 15 bp, Homo sapiens
tttaatcttggaggt

SEQ ID NO: 9618 - DNA, 15 bp, Homo sapiens
atttaatcttggagg

SEQ ID NO: 9619 - DNA, 15 bp, Homo sapiens
gatttaatcttggag

SEQ ID NO: 9620 - DNA, 15 bp, Homo sapiens
tgatttaatcttgga

SEQ ID NO: 9621 - DNA, 15 bp, Homo sapiens
atgatttaatcttgg

SEQ ID NO: 9622 - DNA, 15 bp, Homo sapiens
aatgatttaatcttg

SEQ ID NO: 9623 - DNA, 15 bp, Homo sapiens
taatgatttaatctt

SEQ ID NO: 9624 - DNA, 15 bp, Homo sapiens
ctaatgatttaatct

SEQ ID NO: 9625 - DNA, 15 bp, Homo sapiens
tctaatgatttaatc

SEQ ID NO: 9626 - DNA, 15 bp, Homo sapiens
atctaatgatttaat

SEQ ID NO: 9627 - DNA, 15 bp, Homo sapiens
catctaatgatttaa

SEQ ID NO: 9628 - DNA, 15 bp, Homo sapiens
acatctaatgattta

SEQ ID NO: 9629 - DNA, 15 bp, Homo sapiens
cacatctaatgattt

SEQ ID NO: 9630 - DNA, 15 bp, Homo sapiens
ccacatctaatgatt

SEQ ID NO: 9631 - DNA, 15 bp, Homo sapiens
accacatctaatgat

SEQ ID NO: 9632 - DNA, 15 bp, Homo sapiens
aaccacatctaatga

SEQ ID NO: 9633 - DNA, 15 bp, Homo sapiens
taaccacatctaatg

SEQ ID NO: 9634 - DNA, 15 bp, Homo sapiens
ttaaccacatctaat

SEQ ID NO: 9635 - DNA, 15 bp, Homo sapiens
gttaaccacatctaa

SEQ ID NO: 9636 - DNA, 15 bp, Homo sapiens
tgttaaccacatcta

SEQ ID NO: 9637 - DNA, 15 bp, Homo sapiens
gtgttaaccacatct

SEQ ID NO: 9638 - DNA, 15 bp, Homo sapiens
agtgttaaccacatc

SEQ ID NO: 9639 - DNA, 15 bp, Homo sapiens
cagtgttaaccacat

SEQ ID NO: 9640 - DNA, 15 bp, Homo sapiens
acagtgttaaccaca

SEQ ID NO: 9641 - DNA, 15 bp, Homo sapiens
aacagtgttaaccac

SEQ ID NO: 9642 - DNA, 15 bp, Homo sapiens
aaacagtgttaacca

SEQ ID NO: 9643 - DNA, 15 bp, Homo sapiens
gaaacagtgttaacc

SEQ ID NO: 9644 - DNA, 15 bp, Homo sapiens
agaaacagtgttaac

SEQ ID NO: 9645 - DNA, 15 bp, Homo sapiens
cagaaacagtgttaa

SEQ ID NO: 9646 - DNA, 15 bp, Homo sapiens
ccagaaacagtgtta

SEQ ID NO: 9647 - DNA, 15 bp, Homo sapiens
tccagaaacagtgtt

SEQ ID NO: 9648 - DNA, 15 bp, Homo sapiens
atccagaaacagtgt

SEQ ID NO: 9649 - DNA, 15 bp, Homo sapiens
aatccagaaacagtg

SEQ ID NO: 9650 - DNA, 15 bp, Homo sapiens
caatccagaaacagt

SEQ ID NO: 9651 - DNA, 15 bp, Homo sapiens
ccaatccagaaacag

SEQ ID NO: 9652 - DNA, 15 bp, Homo sapiens
accaatccagaaaca

SEQ ID NO: 9653 - DNA, 15 bp, Homo sapiens
taccaatccagaaac

SEQ ID NO: 9654 - DNA, 15 bp, Homo sapiens
ttaccaatccagaaa

SEQ ID NO: 9655 - DNA, 15 bp, Homo sapiens
cttaccaatccagaa

SEQ ID NO: 9656 - DNA, 15 bp, Homo sapiens
acttaccaatccaga

SEQ ID NO: 9657 - DNA, 15 bp, Homo sapiens
aacttaccaatccag

SEQ ID NO: 9658 - DNA, 15 bp, Homo sapiens
aaacttaccaatcca

SEQ ID NO: 9659 - DNA, 15 bp, Homo sapiens
gaaacttaccaatcc

SEQ ID NO: 9660 - DNA, 15 bp, Homo sapiens
ggaaacttaccaatc

SEQ ID NO: 9661 - DNA, 15 bp, Homo sapiens
tggaaacttaccaat

SEQ ID NO: 9662 - DNA, 15 bp, Homo sapiens
gtggaaacttaccaa

SEQ ID NO: 9663 - DNA, 15 bp, Homo sapiens
tgtggaaacttacca

SEQ ID NO: 9664 - DNA, 15 bp, Homo sapiens
ttgtggaaacttacc

SEQ ID NO: 9665 - DNA, 15 bp, Homo sapiens
tttgtggaaacttac

SEQ ID NO: 9666 - DNA, 15 bp, Homo sapiens
ttttgtggaaactta

SEQ ID NO: 9667 - DNA, 15 bp, Homo sapiens
tttttgtggaaactt

SEQ ID NO: 9668 - DNA, 15 bp, Homo sapiens
ctttttgtggaaact

SEQ ID NO: 9669 - DNA, 15 bp, Homo sapiens
tctttttgtggaaac

SEQ ID NO: 9670 - DNA, 15 bp, Homo sapiens
ctctttttgtggaaa

SEQ ID NO: 9671 - DNA, 15 bp, Homo sapiens
cctctttttgtggaa

SEQ ID NO: 9672 - DNA, 15 bp, Homo sapiens
acctctttttgtgga

SEQ ID NO: 9673 - DNA, 15 bp, Homo sapiens
aacctctttttgtgg

SEQ ID NO: 9674 - DNA, 15 bp, Homo sapiens
aaacctctttttgtg

SEQ ID NO: 9675 - DNA, 15 bp, Homo sapiens
aaaacctctttttgt

SEQ ID NO: 9676 - DNA, 15 bp, Homo sapiens
aaaaacctctttttg

SEQ ID NO: 9677 - DNA, 15 bp, Homo sapiens
taaaaacctcttttt

SEQ ID NO: 9678 - DNA, 15 bp, Homo sapiens
ttaaaaacctctttt

SEQ ID NO: 9679 - DNA, 15 bp, Homo sapiens
tttaaaaacctcttt

SEQ ID NO: 9680 - DNA, 15 bp, Homo sapiens
atttaaaaacctctt

SEQ ID NO: 9681 - DNA, 15 bp, Homo sapiens
aatttaaaaacctct

SEQ ID NO: 9682 - DNA, 15 bp, Homo sapiens
aaatttaaaaacctc

SEQ ID NO: 9683 - DNA, 15 bp, Homo sapiens
aaaatttaaaaacct

SEQ ID NO: 9684 - DNA, 15 bp, Homo sapiens
aaaaatttaaaaacc

SEQ ID NO: 9685 - DNA, 15 bp, Homo sapiens
taaaaatttaaaaac

SEQ ID NO: 9686 - DNA, 15 bp, Homo sapiens
ttaaaaatttaaaaa

SEQ ID NO: 9687 - DNA, 15 bp, Homo sapiens
gttaaaaatttaaaa

SEQ ID NO: 9688 - DNA, 15 bp, Homo sapiens
ggttaaaaatttaaa

SEQ ID NO: 9689 - DNA, 15 bp, Homo sapiens
tggttaaaaatttaa

SEQ ID NO: 9690 - DNA, 15 bp, Homo sapiens
gtggttaaaaattta

SEQ ID NO: 9691 - DNA, 15 bp, Homo sapiens
tgtggttaaaaattt

SEQ ID NO: 9692 - DNA, 15 bp, Homo sapiens
atgtggttaaaaatt

SEQ ID NO: 9693 - DNA, 15 bp, Homo sapiens
tatgtggttaaaaat

SEQ ID NO: 9694 - DNA, 15 bp, Homo sapiens
ctatgtggttaaaaa

SEQ ID NO: 9695 - DNA, 15 bp, Homo sapiens
tctatgtggttaaaa

SEQ ID NO: 9696 - DNA, 15 bp, Homo sapiens
gtctatgtggttaaa

SEQ ID NO: 9697 - DNA, 15 bp, Homo sapiens
ggtctatgtggttaa

SEQ ID NO: 9698 - DNA, 15 bp, Homo sapiens
tggtctatgtggtta

SEQ ID NO: 9699 - DNA, 15 bp, Homo sapiens
gtggtctatgtggtt

SEQ ID NO: 9700 - DNA, 15 bp, Homo sapiens
agtggtctatgtggt

SEQ ID NO: 9701 - DNA, 15 bp, Homo sapiens
gagtggtctatgtgg

SEQ ID NO: 9702 - DNA, 15 bp, Homo sapiens
agagtggtctatgtg

SEQ ID NO: 9703 - DNA, 15 bp, Homo sapiens
aagagtggtctatgt

SEQ ID NO: 9704 - DNA, 15 bp, Homo sapiens
aaagagtggtctatg

SEQ ID NO: 9705 - DNA, 15 bp, Homo sapiens
taaagagtggtctat

SEQ ID NO: 9706 - DNA, 15 bp, Homo sapiens
gtaaagagtggtcta

SEQ ID NO: 9707 - DNA, 15 bp, Homo sapiens
ggtaaagagtggtct

SEQ ID NO: 9708 - DNA, 15 bp, Homo sapiens
tggtaaagagtggtc

SEQ ID NO: 9709 - DNA, 15 bp, Homo sapiens
atggtaaagagtggt

SEQ ID NO: 9710 - DNA, 15 bp, Homo sapiens
tatggtaaagagtgg

SEQ ID NO: 9711 - DNA, 15 bp, Homo sapiens
atatggtaaagagtg

SEQ ID NO: 9712 - DNA, 15 bp, Homo sapiens
aatatggtaaagagt

SEQ ID NO: 9713 - DNA, 15 bp, Homo sapiens
gaatatggtaaagag

SEQ ID NO: 9714 - DNA, 15 bp, Homo sapiens
tgaatatggtaaaga

SEQ ID NO: 9715 - DNA, 15 bp, Homo sapiens
atgaatatggtaaag

SEQ ID NO: 9716 - DNA, 15 bp, Homo sapiens
aatgaatatggtaaa

SEQ ID NO: 9717 - DNA, 15 bp, Homo sapiens
taatgaatatggtaa

SEQ ID NO: 9718 - DNA, 15 bp, Homo sapiens
ataatgaatatggta

SEQ ID NO: 9719 - DNA, 15 bp, Homo sapiens
aataatgaatatggt

SEQ ID NO: 9720 - DNA, 15 bp, Homo sapiens
gaataatgaatatgg

SEQ ID NO: 9721 - DNA, 15 bp, Homo sapiens
agaataatgaatatg

SEQ ID NO: 9722 - DNA, 15 bp, Homo sapiens
aagaataatgaatat

SEQ ID NO: 9723 - DNA, 15 bp, Homo sapiens
taagaataatgaata

SEQ ID NO: 9724 - DNA, 15 bp, Homo sapiens
ctaagaataatgaat

SEQ ID NO: 9725 - DNA, 15 bp, Homo sapiens
actaagaataatgaa

SEQ ID NO: 9726 - DNA, 15 bp, Homo sapiens
tactaagaataatga

SEQ ID NO: 9727 - DNA, 15 bp, Homo sapiens
atactaagaataatg

SEQ ID NO: 9728 - DNA, 15 bp, Homo sapiens
aatactaagaataat

SEQ ID NO: 9729 - DNA, 15 bp, Homo sapiens
gaatactaagaataa

SEQ ID NO: 9730 - DNA, 15 bp, Homo sapiens
tgaatactaagaata

SEQ ID NO: 9731 - DNA, 15 bp, Homo sapiens
atgaatactaagaat

SEQ ID NO: 9732 - DNA, 15 bp, Homo sapiens
aatgaatactaagaa

SEQ ID NO: 9733 - DNA, 15 bp, Homo sapiens
caatgaatactaaga

SEQ ID NO: 9734 - DNA, 15 bp, Homo sapiens
acaatgaatactaag

SEQ ID NO: 9735 - DNA, 15 bp, Homo sapiens
cacaatgaatactaa

SEQ ID NO: 9736 - DNA, 15 bp, Homo sapiens
ccacaatgaatacta

SEQ ID NO: 9737 - DNA, 15 bp, Homo sapiens
accacaatgaatact

SEQ ID NO: 9738 - DNA, 15 bp, Homo sapiens
caccacaatgaatac

SEQ ID NO: 9739 - DNA, 15 bp, Homo sapiens
tcaccacaatgaata

SEQ ID NO: 9740 - DNA, 15 bp, Homo sapiens
ctcaccacaatgaat

SEQ ID NO: 9741 - DNA, 15 bp, Homo sapiens
actcaccacaatgaa

SEQ ID NO: 9742 - DNA, 15 bp, Homo sapiens
aactcaccacaatga

SEQ ID NO: 9743 - DNA, 15 bp, Homo sapiens
gaactcaccacaatg

SEQ ID NO: 9744 - DNA, 15 bp, Homo sapiens
agaactcaccacaat

SEQ ID NO: 9745 - DNA, 15 bp, Homo sapiens
gagaactcaccacaa

SEQ ID NO: 9746 - DNA, 15 bp, Homo sapiens
agagaactcaccaca

SEQ ID NO: 9747 - DNA, 15 bp, Homo sapiens
gagagaactcaccac

SEQ ID NO: 9748 - DNA, 15 bp, Homo sapiens
agagagaactcacca

SEQ ID NO: 9749 - DNA, 15 bp, Homo sapiens
aagagagaactcacc

SEQ ID NO: 9750 - DNA, 15 bp, Homo sapiens
aaagagagaactcac

SEQ ID NO: 9751 - DNA, 15 bp, Homo sapiens
aaaagagagaactca

SEQ ID NO: 9752 - DNA, 15 bp, Homo sapiens
aaaaagagagaactc

SEQ ID NO: 9753 - DNA, 15 bp, Homo sapiens
taaaaagagagaact

SEQ ID NO: 9754 - DNA, 15 bp, Homo sapiens
gtaaaaagagagaac

SEQ ID NO: 9755 - DNA, 15 bp, Homo sapiens
ggtaaaaagagagaa

SEQ ID NO: 9756 - DNA, 15 bp, Homo sapiens
tggtaaaaagagaga

SEQ ID NO: 9757 - DNA, 15 bp, Homo sapiens
gtggtaaaaagagag

SEQ ID NO: 9758 - DNA, 15 bp, Homo sapiens
cgtggtaaaaagaga

SEQ ID NO: 9759 - DNA, 15 bp, Homo sapiens
acgtggtaaaaagag

SEQ ID NO: 9760 - DNA, 15 bp, Homo sapiens
aacgtggtaaaaaga

SEQ ID NO: 9761 - DNA, 15 bp, Homo sapiens
aaacgtggtaaaaag

SEQ ID NO: 9762 - DNA, 15 bp, Homo sapiens
taaacgtggtaaaaa

SEQ ID NO: 9763 - DNA, 15 bp, Homo sapiens
ataaacgtggtaaaa

SEQ ID NO: 9764 - DNA, 15 bp, Homo sapiens
tataaacgtggtaaa

SEQ ID NO: 9765 - DNA, 15 bp, Homo sapiens
ctataaacgtggtaa

SEQ ID NO: 9766 - DNA, 15 bp, Homo sapiens
actataaacgtggta

SEQ ID NO: 9767 - DNA, 15 bp, Homo sapiens
aactataaacgtggt

SEQ ID NO: 9768 - DNA, 15 bp, Homo sapiens
caactataaacgtgg

SEQ ID NO: 9769 - DNA, 15 bp, Homo sapiens
acaactataaacgtg

SEQ ID NO: 9770 - DNA, 15 bp, Homo sapiens
aacaactataaacgt

SEQ ID NO: 9771 - DNA, 15 bp, Homo sapiens
caacaactataaacg

SEQ ID NO: 9772 - DNA, 15 bp, Homo sapiens
ccaacaactataaac

SEQ ID NO: 9773 - DNA, 15 bp, Homo sapiens
tccaacaactataaa

SEQ ID NO: 9774 - DNA, 15 bp, Homo sapiens
atccaacaactataa

SEQ ID NO: 9775 - DNA, 15 bp, Homo sapiens
aatccaacaactata

SEQ ID NO: 9776 - DNA, 15 bp, Homo sapiens
caatccaacaactat

SEQ ID NO: 9777 - DNA, 15 bp, Homo sapiens
ccaatccaacaacta

SEQ ID NO: 9778 - DNA, 15 bp, Homo sapiens
cccaatccaacaact

SEQ ID NO: 9779 - DNA, 15 bp, Homo sapiens
tcccaatccaacaac

SEQ ID NO: 9780 - DNA, 15 bp, Homo sapiens
ttcccaatccaacaa

SEQ ID NO: 9781 - DNA, 15 bp, Homo sapiens
cttcccaatccaaca

SEQ ID NO: 9782 - DNA, 15 bp, Homo sapiens
acttcccaatccaac

SEQ ID NO: 9783 - DNA, 15 bp, Homo sapiens
cacttcccaatccaa

SEQ ID NO: 9784 - DNA, 15 bp, Homo sapiens
gcacttcccaatcca

SEQ ID NO: 9785 - DNA, 15 bp, Homo sapiens
tgcacttcccaatcc

SEQ ID NO: 9786 - DNA, 15 bp, Homo sapiens
ctgcacttcccaatc

SEQ ID NO: 9787 - DNA, 15 bp, Homo sapiens
actgcacttcccaat

SEQ ID NO: 9788 - DNA, 15 bp, Homo sapiens
cactgcacttcccaa

SEQ ID NO: 9789 - DNA, 15 bp, Homo sapiens
acactgcacttccca

SEQ ID NO: 9790 - DNA, 15 bp, Homo sapiens
cacactgcacttccc

SEQ ID NO: 9791 - DNA, 15 bp, Homo sapiens
tcacactgcacttcc

SEQ ID NO: 9792 - DNA, 15 bp, Homo sapiens
gtcacactgcacttc

SEQ ID NO: 9793 - DNA, 15 bp, Homo sapiens
agtcacactgcactt

SEQ ID NO: 9794 - DNA, 15 bp, Homo sapiens
gagtcacactgcact

SEQ ID NO: 9795 - DNA, 15 bp, Homo sapiens
agagtcacactgcac

SEQ ID NO: 9796 - DNA, 15 bp, Homo sapiens
aagagtcacactgca

SEQ ID NO: 9797 - DNA, 15 bp, Homo sapiens
taagagtcacactgc

SEQ ID NO: 9798 - DNA, 15 bp, Homo sapiens
gtaagagtcacactg

SEQ ID NO: 9799 - DNA, 15 bp, Homo sapiens
agtaagagtcacact

SEQ ID NO: 9800 - DNA, 15 bp, Homo sapiens
aagtaagagtcacac

SEQ ID NO: 9801 - DNA, 15 bp, Homo sapiens
aaagtaagagtcaca

SEQ ID NO: 9802 - DNA, 15 bp, Homo sapiens
caaagtaagagtcac

SEQ ID NO: 9803 - DNA, 15 bp, Homo sapiens
acaaagtaagagtca

SEQ ID NO: 9804 - DNA, 15 bp, Homo sapiens
tacaaagtaagagtc

SEQ ID NO: 9805 - DNA, 15 bp, Homo sapiens
ctacaaagtaagagt

SEQ ID NO: 9806 - DNA, 15 bp, Homo sapiens
actacaaagtaagag

SEQ ID NO: 9807 - DNA, 15 bp, Homo sapiens
aactacaaagtaaga

SEQ ID NO: 9808 - DNA, 15 bp, Homo sapiens
aaactacaaagtaag

SEQ ID NO: 9809 - DNA, 15 bp, Homo sapiens
aaaactacaaagtaa

SEQ ID NO: 9810 - DNA, 15 bp, Homo sapiens
aaaaactacaaagta

SEQ ID NO: 9811 - DNA, 15 bp, Homo sapiens
taaaaactacaaagt

SEQ ID NO: 9812 - DNA, 15 bp, Homo sapiens
ttaaaaactacaaag

SEQ ID NO: 9813 - DNA, 15 bp, Homo sapiens
tttaaaaactacaaa

SEQ ID NO: 9814 - DNA, 15 bp, Homo sapiens
atttaaaaactacaa

SEQ ID NO: 9815 - DNA, 15 bp, Homo sapiens
gatttaaaaactaca

SEQ ID NO: 9816 - DNA, 15 bp, Homo sapiens
agatttaaaaactac

SEQ ID NO: 9817 - DNA, 15 bp, Homo sapiens
aagatttaaaaacta

SEQ ID NO: 9818 - DNA, 15 bp, Homo sapiens
taagatttaaaaact

SEQ ID NO: 9819 - DNA, 15 bp, Homo sapiens
ttaagatttaaaaac

SEQ ID NO: 9820 - DNA, 15 bp, Homo sapiens
gttaagatttaaaaa

SEQ ID NO: 9821 - DNA, 15 bp, Homo sapiens
tgttaagatttaaaa

SEQ ID NO: 9822 - DNA, 15 bp, Homo sapiens
ttgttaagatttaaa

SEQ ID NO: 9823 - DNA, 15 bp, Homo sapiens
cttgttaagatttaa

SEQ ID NO: 9824 - DNA, 15 bp, Homo sapiens
acttgttaagattta

SEQ ID NO: 9825 - DNA, 15 bp, Homo sapiens
aacttgttaagattt

SEQ ID NO: 9826 - DNA, 15 bp, Homo sapiens
aaacttgttaagatt

SEQ ID NO: 9827 - DNA, 15 bp, Homo sapiens
taaacttgttaagat

SEQ ID NO: 9828 - DNA, 15 bp, Homo sapiens
ataaacttgttaaga

SEQ ID NO: 9829 - DNA, 15 bp, Homo sapiens
tataaacttgttaag

SEQ ID NO: 9830 - DNA, 15 bp, Homo sapiens
ctataaacttgttaa

SEQ ID NO: 9831 - DNA, 15 bp, Homo sapiens
actataaacttgtta

SEQ ID NO: 9832 - DNA, 15 bp, Homo sapiens
aactataaacttgtt

SEQ ID NO: 9833 - DNA, 15 bp, Homo sapiens
caactataaacttgt

SEQ ID NO: 9834 - DNA, 15 bp, Homo sapiens
acaactataaacttg

SEQ ID NO: 9835 - DNA, 15 bp, Homo sapiens
tacaactataaactt

SEQ ID NO: 9836 - DNA, 15 bp, Homo sapiens
atacaactataaact

SEQ ID NO: 9837 - DNA, 15 bp, Homo sapiens
catacaactataaac

SEQ ID NO: 9838 - DNA, 15 bp, Homo sapiens
tcatacaactataaa

SEQ ID NO: 9839 - DNA, 15 bp, Homo sapiens
ctcatacaactataa

SEQ ID NO: 9840 - DNA, 15 bp, Homo sapiens
gctcatacaactata

SEQ ID NO: 9841 - DNA, 15 bp, Homo sapiens
agctcatacaactat

SEQ ID NO: 9842 - DNA, 15 bp, Homo sapiens
tagctcatacaacta

SEQ ID NO: 9843 - DNA, 15 bp, Homo sapiens
ttagctcatacaact

SEQ ID NO: 9844 - DNA, 15 bp, Homo sapiens
tttagctcatacaac

SEQ ID NO: 9845 - DNA, 15 bp, Homo sapiens
ttttagctcatacaa

SEQ ID NO: 9846 - DNA, 15 bp, Homo sapiens
cttttagctcataca

SEQ ID NO: 9847 - DNA, 15 bp, Homo sapiens
acttttagctcatac

SEQ ID NO: 9848 - DNA, 15 bp, Homo sapiens
aacttttagctcata

SEQ ID NO: 9849 - DNA, 15 bp, Homo sapiens
aaacttttagctcat

SEQ ID NO: 9850 - DNA, 15 bp, Homo sapiens
taaacttttagctca

SEQ ID NO: 9851 - DNA, 15 bp, Homo sapiens
ttaaacttttagctc

SEQ ID NO: 9852 - DNA, 15 bp, Homo sapiens
tttaaacttttagct

SEQ ID NO: 9853 - DNA, 15 bp, Homo sapiens
gtttaaacttttagc

SEQ ID NO: 9854 - DNA, 15 bp, Homo sapiens
ggtttaaacttttag

SEQ ID NO: 9855 - DNA, 15 bp, Homo sapiens
aggtttaaactttta

SEQ ID NO: 9856 - DNA, 15 bp, Homo sapiens
gaggtttaaactttt

SEQ ID NO: 9857 - DNA, 15 bp, Homo sapiens
agaggtttaaacttt

SEQ ID NO: 9858 - DNA, 15 bp, Homo sapiens
cagaggtttaaactt

SEQ ID NO: 9859 - DNA, 15 bp, Homo sapiens
gcagaggtttaaact

SEQ ID NO: 9860 - DNA, 15 bp, Homo sapiens
ggcagaggtttaaac

SEQ ID NO: 9861 - DNA, 15 bp, Homo sapiens
gggcagaggtttaaa

SEQ ID NO: 9862 - DNA, 15 bp, Homo sapiens
ggggcagaggtttaa

SEQ ID NO: 9863 - DNA, 15 bp, Homo sapiens
tggggcagaggttta

SEQ ID NO: 9864 - DNA, 15 bp, Homo sapiens
atggggcagaggttt

SEQ ID NO: 9865 - DNA, 15 bp, Homo sapiens
aatggggcagaggtt

SEQ ID NO: 9866 - DNA, 15 bp, Homo sapiens
aaatggggcagaggt

SEQ ID NO: 9867 - DNA, 15 bp, Homo sapiens
aaaatggggcagagg

SEQ ID NO: 9868 - DNA, 15 bp, Homo sapiens
gaaaatggggcagag

SEQ ID NO: 9869 - DNA, 15 bp, Homo sapiens
agaaaatggggcaga

SEQ ID NO: 9870 - DNA, 15 bp, Homo sapiens
aagaaaatggggcag

SEQ ID NO: 9871 - DNA, 15 bp, Homo sapiens
caagaaaatggggca

SEQ ID NO: 9872 - DNA, 15 bp, Homo sapiens
ccaagaaaatggggc

SEQ ID NO: 9873 - DNA, 15 bp, Homo sapiens
cccaagaaaatgggg

SEQ ID NO: 9874 - DNA, 15 bp, Homo sapiens
ccccaagaaaatggg

SEQ ID NO: 9875 - DNA, 15 bp, Homo sapiens
gccccaagaaaatgg

SEQ ID NO: 9876 - DNA, 15 bp, Homo sapiens
tgccccaagaaaatg

SEQ ID NO: 9877 - DNA, 15 bp, Homo sapiens
ctgccccaagaaaat

SEQ ID NO: 9878 - DNA, 15 bp, Homo sapiens
actgccccaagaaaa

SEQ ID NO: 9879 - DNA, 15 bp, Homo sapiens
cactgccccaagaaa

SEQ ID NO: 9880 - DNA, 15 bp, Homo sapiens
acactgccccaagaa

SEQ ID NO: 9881 - DNA, 15 bp, Homo sapiens
aacactgccccaaga

SEQ ID NO: 9882 - DNA, 15 bp, Homo sapiens
gaacactgccccaag

SEQ ID NO: 9883 - DNA, 15 bp, Homo sapiens
agaacactgccccaa

SEQ ID NO: 9884 - DNA, 15 bp, Homo sapiens
cagaacactgcccca

SEQ ID NO: 9885 - DNA, 15 bp, Homo sapiens
acagaacactgcccc

SEQ ID NO: 9886 - DNA, 15 bp, Homo sapiens
cacagaacactgccc

SEQ ID NO: 9887 - DNA, 15 bp, Homo sapiens
tcacagaacactgcc

SEQ ID NO: 9888 - DNA, 15 bp, Homo sapiens
gtcacagaacactgc

SEQ ID NO: 9889 - DNA, 15 bp, Homo sapiens
ggtcacagaacactg

SEQ ID NO: 9890 - DNA, 15 bp, Homo sapiens
tggtcacagaacact

SEQ ID NO: 9891 - DNA, 15 bp, Homo sapiens
ctggtcacagaacac

SEQ ID NO: 9892 - DNA, 15 bp, Homo sapiens
actggtcacagaaca

SEQ ID NO: 9893 - DNA, 15 bp, Homo sapiens
aactggtcacagaac

SEQ ID NO: 9894 - DNA, 15 bp, Homo sapiens
taactggtcacagaa

SEQ ID NO: 9895 - DNA, 15 bp, Homo sapiens
gtaactggtcacaga

SEQ ID NO: 9896 - DNA, 15 bp, Homo sapiens
tgtaactggtcacag

SEQ ID NO: 9897 - DNA, 15 bp, Homo sapiens
atgtaactggtcaca

SEQ ID NO: 9898 - DNA, 15 bp, Homo sapiens
aatgtaactggtcac

SEQ ID NO: 9899 - DNA, 15 bp, Homo sapiens
aaatgtaactggtca

SEQ ID NO: 9900 - DNA, 15 bp, Homo sapiens
aaaatgtaactggtc

SEQ ID NO: 9901 - DNA, 15 bp, Homo sapiens
aaaaatgtaactggt

SEQ ID NO: 9902 - DNA, 15 bp, Homo sapiens
caaaaatgtaactgg

SEQ ID NO: 9903 - DNA, 15 bp, Homo sapiens
ccaaaaatgtaactg

SEQ ID NO: 9904 - DNA, 15 bp, Homo sapiens
tccaaaaatgtaact

SEQ ID NO: 9905 - DNA, 15 bp, Homo sapiens
gtccaaaaatgtaac

SEQ ID NO: 9906 - DNA, 15 bp, Homo sapiens
agtccaaaaatgtaa

SEQ ID NO: 9907 - DNA, 15 bp, Homo sapiens
aagtccaaaaatgta

SEQ ID NO: 9908 - DNA, 15 bp, Homo sapiens
taagtccaaaaatgt

SEQ ID NO: 9909 - DNA, 15 bp, Homo sapiens
ctaagtccaaaaatg

SEQ ID NO: 9910 - DNA, 15 bp, Homo sapiens
cctaagtccaaaaat

SEQ ID NO: 9911 - DNA, 15 bp, Homo sapiens
acctaagtccaaaaa

SEQ ID NO: 9912 - DNA, 15 bp, Homo sapiens
aacctaagtccaaaa

SEQ ID NO: 9913 - DNA, 15 bp, Homo sapiens
taacctaagtccaaa

SEQ ID NO: 9914 - DNA, 15 bp, Homo sapiens
ataacctaagtccaa

SEQ ID NO: 9915 - DNA, 15 bp, Homo sapiens
gataacctaagtcca

SEQ ID NO: 9916 - DNA, 15 bp, Homo sapiens
agataacctaagtcc

SEQ ID NO: 9917 - DNA, 15 bp, Homo sapiens
gagataacctaagtc

SEQ ID NO: 9918 - DNA, 15 bp, Homo sapiens
agagataacctaagt

SEQ ID NO: 9919 - DNA, 15 bp, Homo sapiens
cagagataacctaag

SEQ ID NO: 9920 - DNA, 15 bp, Homo sapiens
tcagagataacctaa

SEQ ID NO: 9921 - DNA, 15 bp, Homo sapiens
ttcagagataaccta

SEQ ID NO: 9922 - DNA, 15 bp, Homo sapiens
cttcagagataacct

SEQ ID NO: 9923 - DNA, 15 bp, Homo sapiens
acttcagagataacc

SEQ ID NO: 9924 - DNA, 15 bp, Homo sapiens
cacttcagagataac

SEQ ID NO: 9925 - DNA, 15 bp, Homo sapiens
gcacttcagagataa

SEQ ID NO: 9926 - DNA, 15 bp, Homo sapiens
agcacttcagagata

SEQ ID NO: 9927 - DNA, 15 bp, Homo sapiens
cagcacttcagagat

SEQ ID NO: 9928 - DNA, 15 bp, Homo sapiens
acagcacttcagaga

SEQ ID NO: 9929 - DNA, 15 bp, Homo sapiens
cacagcacttcagag

SEQ ID NO: 9930 - DNA, 15 bp, Homo sapiens
acacagcacttcaga

SEQ ID NO: 9931 - DNA, 15 bp, Homo sapiens
aacacagcacttcag

SEQ ID NO: 9932 - DNA, 15 bp, Homo sapiens
caacacagcacttca

SEQ ID NO: 9933 - DNA, 15 bp, Homo sapiens
gcaacacagcacttc

SEQ ID NO: 9934 - DNA, 15 bp, Homo sapiens
agcaacacagcactt

SEQ ID NO: 9935 - DNA, 15 bp, Homo sapiens
cagcaacacagcact

SEQ ID NO: 9936 - DNA, 15 bp, Homo sapiens
acagcaacacagcac

SEQ ID NO: 9937 - DNA, 15 bp, Homo sapiens
tacagcaacacagca

SEQ ID NO: 9938 - DNA, 15 bp, Homo sapiens
atacagcaacacagc

SEQ ID NO: 9939 - DNA, 15 bp, Homo sapiens
tatacagcaacacag

SEQ ID NO: 9940 - DNA, 15 bp, Homo sapiens
ttatacagcaacaca

SEQ ID NO: 9941 - DNA, 15 bp, Homo sapiens
tttatacagcaacac

SEQ ID NO: 9942 - DNA, 15 bp, Homo sapiens
atttatacagcaaca

SEQ ID NO: 9943 - DNA, 15 bp, Homo sapiens
catttatacagcaac

SEQ ID NO: 9944 - DNA, 15 bp, Homo sapiens
acatttatacagcaa

SEQ ID NO: 9945 - DNA, 15 bp, Homo sapiens
gacatttatacagca

SEQ ID NO: 9946 - DNA, 15 bp, Homo sapiens
tgacatttatacagc

SEQ ID NO: 9947 - DNA, 15 bp, Homo sapiens
atgacatttatacag

SEQ ID NO: 9948 - DNA, 15 bp, Homo sapiens
tatgacatttataca

SEQ ID NO: 9949 - DNA, 15 bp, Homo sapiens
atatgacatttatac

SEQ ID NO: 9950 - DNA, 15 bp, Homo sapiens
catatgacatttata

SEQ ID NO: 9951 - DNA, 15 bp, Homo sapiens
ccatatgacatttat

SEQ ID NO: 9952 - DNA, 15 bp, Homo sapiens
tccatatgacattta

SEQ ID NO: 9953 - DNA, 15 bp, Homo sapiens
ctccatatgacattt

SEQ ID NO: 9954 - DNA, 15 bp, Homo sapiens
cctccatatgacatt

SEQ ID NO: 9955 - DNA, 15 bp, Homo sapiens
tcctccatatgacat

SEQ ID NO: 9956 - DNA, 15 bp, Homo sapiens
atcctccatatgaca

SEQ ID NO: 9957 - DNA, 15 bp, Homo sapiens
tatcctccatatgac

SEQ ID NO: 9958 - DNA, 15 bp, Homo sapiens
ttatcctccatatga

SEQ ID NO: 9959 - DNA, 15 bp, Homo sapiens
gttatcctccatatg

SEQ ID NO: 9960 - DNA, 15 bp, Homo sapiens
ggttatcctccatat

SEQ ID NO: 9961 - DNA, 15 bp, Homo sapiens
aggttatcctccata

SEQ ID NO: 9962 - DNA, 15 bp, Homo sapiens
taggttatcctccat

SEQ ID NO: 9963 - DNA, 15 bp, Homo sapiens
gtaggttatcctcca

SEQ ID NO: 9964 - DNA, 15 bp, Homo sapiens
tgtaggttatcctcc

SEQ ID NO: 9965 - DNA, 15 bp, Homo sapiens
ttgtaggttatcctc

SEQ ID NO: 9966 - DNA, 15 bp, Homo sapiens
tttgtaggttatcct

SEQ ID NO: 9967 - DNA, 15 bp, Homo sapiens
ttttgtaggttatcc

SEQ ID NO: 9968 - DNA, 15 bp, Homo sapiens
attttgtaggttatc

SEQ ID NO: 9969 - DNA, 15 bp, Homo sapiens
tattttgtaggttat

SEQ ID NO: 9970 - DNA, 15 bp, Homo sapiens
gtattttgtaggtta

SEQ ID NO: 9971 - DNA, 15 bp, Homo sapiens
tgtattttgtaggtt

SEQ ID NO: 9972 - DNA, 15 bp, Homo sapiens
gtgtattttgtaggt

SEQ ID NO: 9973 - DNA, 15 bp, Homo sapiens
agtgtattttgtagg

SEQ ID NO: 9974 - DNA, 15 bp, Homo sapiens
aagtgtattttgtag

SEQ ID NO: 9975 - DNA, 15 bp, Homo sapiens
gaagtgtattttgta

SEQ ID NO: 9976 - DNA, 15 bp, Homo sapiens
cgaagtgtattttgt

SEQ ID NO: 9977 - DNA, 15 bp, Homo sapiens
ccgaagtgtattttg

SEQ ID NO: 9978 - DNA, 15 bp, Homo sapiens
tccgaagtgtatttt

SEQ ID NO: 9979 - DNA, 15 bp, Homo sapiens
atccgaagtgtattt

SEQ ID NO: 9980 - DNA, 15 bp, Homo sapiens
gatccgaagtgtatt

SEQ ID NO: 9981 - DNA, 15 bp, Homo sapiens
agatccgaagtgtat

SEQ ID NO: 9982 - DNA, 15 bp, Homo sapiens
gagatccgaagtgta

SEQ ID NO: 9983 - DNA, 15 bp, Homo sapiens
ggagatccgaagtgt

SEQ ID NO: 9984 - DNA, 15 bp, Homo sapiens
gggagatccgaagtg

SEQ ID NO: 9985 - DNA, 15 bp, Homo sapiens
tgggagatccgaagt

SEQ ID NO: 9986 - DNA, 15 bp, Homo sapiens
ttgggagatccgaag

SEQ ID NO: 9987 - DNA, 15 bp, Homo sapiens
gttgggagatccgaa

SEQ ID NO: 9988 - DNA, 15 bp, Homo sapiens
tgttgggagatccga

SEQ ID NO: 9989 - DNA, 15 bp, Homo sapiens
ctgttgggagatccg

SEQ ID NO: 9990 - DNA, 15 bp, Homo sapiens
gctgttgggagatcc

SEQ ID NO: 9991 - DNA, 15 bp, Homo sapiens
agctgttgggagatc

SEQ ID NO: 9992 - DNA, 15 bp, Homo sapiens
aagctgttgggagat

SEQ ID NO: 9993 - DNA, 15 bp, Homo sapiens
aaagctgttgggaga

SEQ ID NO: 9994 - DNA, 15 bp, Homo sapiens
caaagctgttgggag

SEQ ID NO: 9995 - DNA, 15 bp, Homo sapiens
gcaaagctgttggga

SEQ ID NO: 9996 - DNA, 15 bp, Homo sapiens
cgcaaagctgttggg

SEQ ID NO: 9997 - DNA, 15 bp, Homo sapiens
ccgcaaagctgttgg

SEQ ID NO: 9998 - DNA, 15 bp, Homo sapiens
accgcaaagctgttg

SEQ ID NO: 9999 - DNA, 15 bp, Homo sapiens
aaccgcaaagctgtt

SEQ ID NO: 10000 - DNA, 15 bp, Homo sapiens
gaaccgcaaagctgt

SEQ ID NO: 10001 - DNA, 15 bp, Homo sapiens
agaaccgcaaagctg

SEQ ID NO: 10002 - DNA, 15 bp, Homo sapiens
cagaaccgcaaagct

SEQ ID NO: 10003 - DNA, 15 bp, Homo sapiens
tcagaaccgcaaagc

SEQ ID NO: 10004 - DNA, 15 bp, Homo sapiens
ttcagaaccgcaaag

SEQ ID NO: 10005 - DNA, 15 bp, Homo sapiens
tttcagaaccgcaaa

SEQ ID NO: 10006 - DNA, 15 bp, Homo sapiens
gtttcagaaccgcaa

SEQ ID NO: 10007 - DNA, 15 bp, Homo sapiens
tgtttcagaaccgca

SEQ ID NO: 10008 - DNA, 15 bp, Homo sapiens
ctgtttcagaaccgc

SEQ ID NO: 10009 - DNA, 15 bp, Homo sapiens
gctgtttcagaaccg

SEQ ID NO: 10010 - DNA, 15 bp, Homo sapiens
ggctgtttcagaacc

SEQ ID NO: 10011 - DNA, 15 bp, Homo sapiens
aggctgtttcagaac

SEQ ID NO: 10012 - DNA, 15 bp, Homo sapiens
aaggctgtttcagaa

SEQ ID NO: 10013 - DNA, 15 bp, Homo sapiens
gaaggctgtttcaga

SEQ ID NO: 10014 - DNA, 15 bp, Homo sapiens
tgaaggctgtttcag

SEQ ID NO: 10015 - DNA, 15 bp, Homo sapiens
ctgaaggctgtttca

SEQ ID NO: 10016 - DNA, 15 bp, Homo sapiens
actgaaggctgtttc

SEQ ID NO: 10017 - DNA, 15 bp, Homo sapiens
tactgaaggctgttt

SEQ ID NO: 10018 - DNA, 15 bp, Homo sapiens
ctactgaaggctgtt

SEQ ID NO: 10019 - DNA, 15 bp, Homo sapiens
actactgaaggctgt

SEQ ID NO: 10020 - DNA, 15 bp, Homo sapiens
tactactgaaggctg

SEQ ID NO: 10021 - DNA, 15 bp, Homo sapiens
gtactactgaaggct

SEQ ID NO: 10022 - DNA, 15 bp, Homo sapiens
ggtactactgaaggc

SEQ ID NO: 10023 - DNA, 15 bp, Homo sapiens
tggtactactgaagg

SEQ ID NO: 10024 - DNA, 15 bp, Homo sapiens
gtggtactactgaag

SEQ ID NO: 10025 - DNA, 15 bp, Homo sapiens
agtggtactactgaa

SEQ ID NO: 10026 - DNA, 15 bp, Homo sapiens
cagtggtactactga

SEQ ID NO: 10027 - DNA, 15 bp, Homo sapiens
tcagtggtactactg

SEQ ID NO: 10028 - DNA, 15 bp, Homo sapiens
ttcagtggtactact

SEQ ID NO: 10029 - DNA, 15 bp, Homo sapiens
tttcagtggtactac

SEQ ID NO: 10030 - DNA, 15 bp, Homo sapiens
ttttcagtggtacta

SEQ ID NO: 10031 - DNA, 15 bp, Homo sapiens
cttttcagtggtact

SEQ ID NO: 10032 - DNA, 15 bp, Homo sapiens
tcttttcagtggtac

SEQ ID NO: 10033 - DNA, 15 bp, Homo sapiens
ttcttttcagtggta

SEQ ID NO: 10034 - DNA, 15 bp, Homo sapiens
tttcttttcagtggt

SEQ ID NO: 10035 - DNA, 15 bp, Homo sapiens
gtttcttttcagtgg

SEQ ID NO: 10036 - DNA, 15 bp, Homo sapiens
cgtttcttttcagtg

SEQ ID NO: 10037 - DNA, 15 bp, Homo sapiens
ccgtttcttttcagt

SEQ ID NO: 10038 - DNA, 15 bp, Homo sapiens
cccgtttcttttcag

SEQ ID NO: 10039 - DNA, 15 bp, Homo sapiens
ccccgtttcttttca

SEQ ID NO: 10040 - DNA, 15 bp, Homo sapiens
tccccgtttcttttc

SEQ ID NO: 10041 - DNA, 15 bp, Homo sapiens
ttccccgtttctttt

SEQ ID NO: 10042 - DNA, 15 bp, Homo sapiens
attccccgtttcttt

SEQ ID NO: 10043 - DNA, 15 bp, Homo sapiens
aattccccgtttctt

SEQ ID NO: 10044 - DNA, 15 bp, Homo sapiens
taattccccgtttct

SEQ ID NO: 10045 - DNA, 15 bp, Homo sapiens
ttaattccccgtttc

SEQ ID NO: 10046 - DNA, 15 bp, Homo sapiens
gttaattccccgttt

SEQ ID NO: 10047 - DNA, 15 bp, Homo sapiens
agttaattccccgtt

SEQ ID NO: 10048 - DNA, 15 bp, Homo sapiens
cagttaattccccgt

SEQ ID NO: 10049 - DNA, 15 bp, Homo sapiens
ccagttaattccccg

SEQ ID NO: 10050 - DNA, 15 bp, Homo sapiens
accagttaattcccc

SEQ ID NO: 10051 - DNA, 15 bp, Homo sapiens
aaccagttaattccc

SEQ ID NO: 10052 - DNA, 15 bp, Homo sapiens
aaaccagttaattcc

SEQ ID NO: 10053 - DNA, 15 bp, Homo sapiens
aaaaccagttaattc

SEQ ID NO: 10054 - DNA, 15 bp, Homo sapiens
aaaaaccagttaatt

SEQ ID NO: 10055 - DNA, 15 bp, Homo sapiens
aaaaaaccagttaat

SEQ ID NO: 10056 - DNA, 15 bp, Homo sapiens
caaaaaaccagttaa

SEQ ID NO: 10057 - DNA, 15 bp, Homo sapiens
acaaaaaaccagtta

SEQ ID NO: 10058 - DNA, 15 bp, Homo sapiens
aacaaaaaaccagtt

SEQ ID NO: 10059 - DNA, 15 bp, Homo sapiens
aaacaaaaaaccagt

SEQ ID NO: 10060 - DNA, 15 bp, Homo sapiens
gaaacaaaaaaccag

SEQ ID NO: 10061 - DNA, 15 bp, Homo sapiens
agaaacaaaaaacca

SEQ ID NO: 10062 - DNA, 15 bp, Homo sapiens
aagaaacaaaaaacc

SEQ ID NO: 10063 - DNA, 15 bp, Homo sapiens
aaagaaacaaaaaac

SEQ ID NO: 10064 - DNA, 15 bp, Homo sapiens
aaaagaaacaaaaaa

SEQ ID NO: 10065 - DNA, 15 bp, Homo sapiens
taaaagaaacaaaaa

SEQ ID NO: 10066 - DNA, 15 bp, Homo sapiens
ataaaagaaacaaaa

SEQ ID NO: 10067 - DNA, 15 bp, Homo sapiens
tataaaagaaacaaa

SEQ ID NO: 10068 - DNA, 15 bp, Homo sapiens
ctataaaagaaacaa

SEQ ID NO: 10069 - DNA, 15 bp, Homo sapiens
tctataaaagaaaca

SEQ ID NO: 10070 - DNA, 15 bp, Homo sapiens
ctctataaaagaaac

SEQ ID NO: 10071 - DNA, 15 bp, Homo sapiens
tctctataaaagaaa

SEQ ID NO: 10072 - DNA, 15 bp, Homo sapiens
atctctataaaagaa

SEQ ID NO: 10073 - DNA, 15 bp, Homo sapiens
catctctataaaaga

SEQ ID NO: 10074 - DNA, 15 bp, Homo sapiens
tcatctctataaaag

SEQ ID NO: 10075 - DNA, 15 bp, Homo sapiens
ctcatctctataaaa

SEQ ID NO: 10076 - DNA, 15 bp, Homo sapiens
cctcatctctataaa

SEQ ID NO: 10077 - DNA, 15 bp, Homo sapiens
ccctcatctctataa

SEQ ID NO: 10078 - DNA, 15 bp, Homo sapiens
accctcatctctata

SEQ ID NO: 10079 - DNA, 15 bp, Homo sapiens
gaccctcatctctat

SEQ ID NO: 10080 - DNA, 15 bp, Homo sapiens
agaccctcatctcta

SEQ ID NO: 10081 - DNA, 15 bp, Homo sapiens
gagaccctcatctct

SEQ ID NO: 10082 - DNA, 15 bp, Homo sapiens
cgagaccctcatctc

SEQ ID NO: 10083 - DNA, 15 bp, Homo sapiens
gcgagaccctcatct

SEQ ID NO: 10084 - DNA, 15 bp, Homo sapiens
agcgagaccctcatc

SEQ ID NO: 10085 - DNA, 15 bp, Homo sapiens
tagcgagaccctcat

SEQ ID NO: 10086 - DNA, 15 bp, Homo sapiens
atagcgagaccctca

SEQ ID NO: 10087 - DNA, 15 bp, Homo sapiens
catagcgagaccctc

SEQ ID NO: 10088 - DNA, 15 bp, Homo sapiens
acatagcgagaccct

SEQ ID NO: 10089 - DNA, 15 bp, Homo sapiens
aacatagcgagaccc

SEQ ID NO: 10090 - DNA, 15 bp, Homo sapiens
caacatagcgagacc

SEQ ID NO: 10091 - DNA, 15 bp, Homo sapiens
gcaacatagcgagac

SEQ ID NO: 10092 - DNA, 15 bp, Homo sapiens
ggcaacatagcgaga

SEQ ID NO: 10093 - DNA, 15 bp, Homo sapiens
gggcaacatagcgag

SEQ ID NO: 10094 - DNA, 15 bp, Homo sapiens
tgggcaacatagcga

SEQ ID NO: 10095 - DNA, 15 bp, Homo sapiens
ctgggcaacatagcg

SEQ ID NO: 10096 - DNA, 15 bp, Homo sapiens
cctgggcaacatagc

SEQ ID NO: 10097 - DNA, 15 bp, Homo sapiens
gcctgggcaacatag

SEQ ID NO: 10098 - DNA, 15 bp, Homo sapiens
agcctgggcaacata

SEQ ID NO: 10099 - DNA, 15 bp, Homo sapiens
cagcctgggcaacat

SEQ ID NO: 10100 - DNA, 15 bp, Homo sapiens
ccagcctgggcaaca

SEQ ID NO: 10101 - DNA, 15 bp, Homo sapiens
accagcctgggcaac

SEQ ID NO: 10102 - DNA, 15 bp, Homo sapiens
cttgagaccagcctg

SEQ ID NO: 10103 - DNA, 15 bp, Homo sapiens
gcttgagaccagcct

SEQ ID NO: 10104 - DNA, 15 bp, Homo sapiens
agcttgagaccagcc

SEQ ID NO: 10105 - DNA, 15 bp, Homo sapiens
gagcttgagaccagc

SEQ ID NO: 10106 - DNA, 15 bp, Homo sapiens
ggagcttgagaccag

SEQ ID NO: 10107 - DNA, 15 bp, Homo sapiens
aggagcttgagacca

SEQ ID NO: 10108 - DNA, 15 bp, Homo sapiens
caggagcttgagacc

SEQ ID NO: 10109 - DNA, 15 bp, Homo sapiens
ccaggagcttgagac

SEQ ID NO: 10110 - DNA, 15 bp, Homo sapiens
gccaggagcttgaga

SEQ ID NO: 10111 - DNA, 15 bp, Homo sapiens
tgccaggagcttgag

SEQ ID NO: 10112 - DNA, 15 bp, Homo sapiens
atgccaggagcttga

SEQ ID NO: 10113 - DNA, 15 bp, Homo sapiens
catgccaggagcttg

SEQ ID NO: 10114 - DNA, 15 bp, Homo sapiens
tcatgccaggagctt

SEQ ID NO: 10115 - DNA, 15 bp, Homo sapiens
ttcatgccaggagct

SEQ ID NO: 10116 - DNA, 15 bp, Homo sapiens
tttcatgccaggagc

SEQ ID NO: 10117 - DNA, 15 bp, Homo sapiens
atttcatgccaggag

SEQ ID NO: 10118 - DNA, 15 bp, Homo sapiens
catttcatgccagga

SEQ ID NO: 10119 - DNA, 15 bp, Homo sapiens
tcatttcatgccagg

SEQ ID NO: 10120 - DNA, 15 bp, Homo sapiens
atcatttcatgccag

SEQ ID NO: 10121 - DNA, 15 bp, Homo sapiens
gatcatttcatgcca

SEQ ID NO: 10122 - DNA, 15 bp, Homo sapiens
ggatcatttcatgcc

SEQ ID NO: 10123 - DNA, 15 bp, Homo sapiens
aggatcatttcatgc

SEQ ID NO: 10124 - DNA, 15 bp, Homo sapiens
gaggatcatttcatg

SEQ ID NO: 10125 - DNA, 15 bp, Homo sapiens
ggaggatcatttcat

SEQ ID NO: 10126 - DNA, 15 bp, Homo sapiens
aggaggatcatttca

SEQ ID NO: 10127 - DNA, 15 bp, Homo sapiens
caggaggatcatttc

SEQ ID NO: 10128 - DNA, 15 bp, Homo sapiens
gcaggaggatcattt

SEQ ID NO: 10129 - DNA, 15 bp, Homo sapiens
ggcaggaggatcatt

SEQ ID NO: 10130 - DNA, 15 bp, Homo sapiens
aggcaggaggatcat

SEQ ID NO: 10131 - DNA, 15 bp, Homo sapiens
aaggcaggaggatca

SEQ ID NO: 10132 - DNA, 15 bp, Homo sapiens
caaggcaggaggatc

SEQ ID NO: 10133 - DNA, 15 bp, Homo sapiens
ccaaggcaggaggat

SEQ ID NO: 10134 - DNA, 15 bp, Homo sapiens
gccaaggcaggagga

SEQ ID NO: 10135 - DNA, 15 bp, Homo sapiens
ggccaaggcaggagg

SEQ ID NO: 10136 - DNA, 15 bp, Homo sapiens
aggccaaggcaggag

SEQ ID NO: 10137 - DNA, 15 bp, Homo sapiens
gaggccaaggcagga

SEQ ID NO: 10138 - DNA, 15 bp, Homo sapiens
ttgggaggccaaggc

SEQ ID NO: 10139 - DNA, 15 bp, Homo sapiens
tttgggaggccaagg

SEQ ID NO: 10140 - DNA, 15 bp, Homo sapiens
ctttgggaggccaag

SEQ ID NO: 10141 - DNA, 15 bp, Homo sapiens
actttgggaggccaa

SEQ ID NO: 10142 - DNA, 15 bp, Homo sapiens
cactttgggaggcca

SEQ ID NO: 10143 - DNA, 15 bp, Homo sapiens
gcactttgggaggcc

SEQ ID NO: 10144 - DNA, 15 bp, Homo sapiens
ggcactttgggaggc

SEQ ID NO: 10145 - DNA, 15 bp, Homo sapiens
cggcactttgggagg

SEQ ID NO: 10146 - DNA, 15 bp, Homo sapiens
ccggcactttgggag

SEQ ID NO: 10147 - DNA, 15 bp, Homo sapiens
cccggcactttggga

SEQ ID NO: 10148 - DNA, 15 bp, Homo sapiens
tcccggcactttggg

SEQ ID NO: 10149 - DNA, 15 bp, Homo sapiens
atcccggcactttgg

SEQ ID NO: 10150 - DNA, 15 bp, Homo sapiens
aatcccggcactttg

SEQ ID NO: 10151 - DNA, 15 bp, Homo sapiens
taatcccggcacttt

SEQ ID NO: 10152 - DNA, 15 bp, Homo sapiens
ataatcccggcactt

SEQ ID NO: 10153 - DNA, 15 bp, Homo sapiens
tataatcccggcact

SEQ ID NO: 10154 - DNA, 15 bp, Homo sapiens
ctataatcccggcac

SEQ ID NO: 10155 - DNA, 15 bp, Homo sapiens
cctataatcccggca

SEQ ID NO: 10156 - DNA, 15 bp, Homo sapiens
gcctataatcccggc

SEQ ID NO: 10157 - DNA, 15 bp, Homo sapiens
tgcctataatcccgg

SEQ ID NO: 10158 - DNA, 15 bp, Homo sapiens
atgcctataatcccg

SEQ ID NO: 10159 - DNA, 15 bp, Homo sapiens
catgcctataatccc

SEQ ID NO: 10160 - DNA, 15 bp, Homo sapiens
agtggctcatgccta

SEQ ID NO: 10161 - DNA, 15 bp, Homo sapiens
cagtggctcatgcct

SEQ ID NO: 10162 - DNA, 15 bp, Homo sapiens
acagtggctcatgcc

SEQ ID NO: 10163 - DNA, 15 bp, Homo sapiens
aacagtggctcatgc

SEQ ID NO: 10164 - DNA, 15 bp, Homo sapiens
gaacagtggctcatg

SEQ ID NO: 10165 - DNA, 15 bp, Homo sapiens
ggaacagtggctcat

SEQ ID NO: 10166 - DNA, 15 bp, Homo sapiens
gggaacagtggctca

SEQ ID NO: 10167 - DNA, 15 bp, Homo sapiens
cgggaacagtggctc

SEQ ID NO: 10168 - DNA, 15 bp, Homo sapiens
ccgggaacagtggct

SEQ ID NO: 10169 - DNA, 15 bp, Homo sapiens
gccgggaacagtggc

SEQ ID NO: 10170 - DNA, 15 bp, Homo sapiens
ggccgggaacagtgg

SEQ ID NO: 10171 - DNA, 15 bp, Homo sapiens
aggccgggaacagtg

SEQ ID NO: 10172 - DNA, 15 bp, Homo sapiens
taggccgggaacagt

SEQ ID NO: 10173 - DNA, 15 bp, Homo sapiens
ctaggccgggaacag

SEQ ID NO: 10174 - DNA, 15 bp, Homo sapiens
tctaggccgggaaca

SEQ ID NO: 10175 - DNA, 15 bp, Homo sapiens
ttctaggccgggaac

SEQ ID NO: 10176 - DNA, 15 bp, Homo sapiens
attctaggccgggaa

SEQ ID NO: 10177 - DNA, 15 bp, Homo sapiens
aattctaggccggga

SEQ ID NO: 10178 - DNA, 15 bp, Homo sapiens
taattctaggccggg

SEQ ID NO: 10179 - DNA, 15 bp, Homo sapiens
ttaattctaggccgg

SEQ ID NO: 10180 - DNA, 15 bp, Homo sapiens
tttaattctaggccg

SEQ ID NO: 10181 - DNA, 15 bp, Homo sapiens
gtttaattctaggcc

SEQ ID NO: 10182 - DNA, 15 bp, Homo sapiens
tgtttaattctaggc

SEQ ID NO: 10183 - DNA, 15 bp, Homo sapiens
ctgtttaattctagg

SEQ ID NO: 10184 - DNA, 15 bp, Homo sapiens
actgtttaattctag

SEQ ID NO: 10185 - DNA, 15 bp, Homo sapiens
aactgtttaattcta

SEQ ID NO: 10186 - DNA, 15 bp, Homo sapiens
aaactgtttaattct

SEQ ID NO: 10187 - DNA, 15 bp, Homo sapiens
taaactgtttaattc

SEQ ID NO: 10188 - DNA, 15 bp, Homo sapiens
ataaactgtttaatt

SEQ ID NO: 10189 - DNA, 15 bp, Homo sapiens
tataaactgtttaat

SEQ ID NO: 10190 - DNA, 15 bp, Homo sapiens
atataaactgtttaa

SEQ ID NO: 10191 - DNA, 15 bp, Homo sapiens
tatataaactgttta

SEQ ID NO: 10192 - DNA, 15 bp, Homo sapiens
atatataaactgttt

SEQ ID NO: 10193 - DNA, 15 bp, Homo sapiens
catatataaactgtt

SEQ ID NO: 10194 - DNA, 15 bp, Homo sapiens
gcatatataaactgt

SEQ ID NO: 10195 - DNA, 15 bp, Homo sapiens
agcatatataaactg

SEQ ID NO: 10196 - DNA, 15 bp, Homo sapiens
gagcatatataaact

SEQ ID NO: 10197 - DNA, 15 bp, Homo sapiens
agagcatatataaac

SEQ ID NO: 10198 - DNA, 15 bp, Homo sapiens
tagagcatatataaa

SEQ ID NO: 10199 - DNA, 15 bp, Homo sapiens
ttagagcatatataa

SEQ ID NO: 10200 - DNA, 15 bp, Homo sapiens
tttagagcatatata

SEQ ID NO: 10201 - DNA, 15 bp, Homo sapiens
ttttagagcatatat

SEQ ID NO: 10202 - DNA, 15 bp, Homo sapiens
attttagagcatata

SEQ ID NO: 10203 - DNA, 15 bp, Homo sapiens
aattttagagcatat

SEQ ID NO: 10204 - DNA, 15 bp, Homo sapiens
aaattttagagcata

SEQ ID NO: 10205 - DNA, 15 bp, Homo sapiens
taaattttagagcat

SEQ ID NO: 10206 - DNA, 15 bp, Homo sapiens
ttaaattttagagca

SEQ ID NO: 10207 - DNA, 15 bp, Homo sapiens
cttaaattttagagc

SEQ ID NO: 10208 - DNA, 15 bp, Homo sapiens
acttaaattttagag

SEQ ID NO: 10209 - DNA, 15 bp, Homo sapiens
gacttaaattttaga

SEQ ID NO: 10210 - DNA, 15 bp, Homo sapiens
tgacttaaattttag

SEQ ID NO: 10211 - DNA, 15 bp, Homo sapiens
ctgacttaaatttta

SEQ ID NO: 10212 - DNA, 15 bp, Homo sapiens
actgacttaaatttt

SEQ ID NO: 10213 - DNA, 15 bp, Homo sapiens
cactgacttaaattt

SEQ ID NO: 10214 - DNA, 15 bp, Homo sapiens
tcactgacttaaatt

SEQ ID NO: 10215 - DNA, 15 bp, Homo sapiens
atcactgacttaaat

SEQ ID NO: 10216 - DNA, 15 bp, Homo sapiens
gatcactgacttaaa

SEQ ID NO: 10217 - DNA, 15 bp, Homo sapiens
tgatcactgacttaa

SEQ ID NO: 10218 - DNA, 15 bp, Homo sapiens
ttgatcactgactta

SEQ ID NO: 10219 - DNA, 15 bp, Homo sapiens
cttgatcactgactt

SEQ ID NO: 10220 - DNA, 15 bp, Homo sapiens
acttgatcactgact

SEQ ID NO: 10221 - DNA, 15 bp, Homo sapiens
aacttgatcactgac

SEQ ID NO: 10222 - DNA, 15 bp, Homo sapiens
caacttgatcactga

SEQ ID NO: 10223 - DNA, 15 bp, Homo sapiens
acaacttgatcactg

SEQ ID NO: 10224 - DNA, 15 bp, Homo sapiens
aacaacttgatcact

SEQ ID NO: 10225 - DNA, 15 bp, Homo sapiens
aaacaacttgatcac

SEQ ID NO: 10226 - DNA, 15 bp, Homo sapiens
taaacaacttgatca

SEQ ID NO: 10227 - DNA, 15 bp, Homo sapiens
ataaacaacttgatc

SEQ ID NO: 10228 - DNA, 15 bp, Homo sapiens
tataaacaacttgat

SEQ ID NO: 10229 - DNA, 15 bp, Homo sapiens
gtataaacaacttga

SEQ ID NO: 10230 - DNA, 15 bp, Homo sapiens
agtataaacaacttg

SEQ ID NO: 10231 - DNA, 15 bp, Homo sapiens
cagtataaacaactt

SEQ ID NO: 10232 - DNA, 15 bp, Homo sapiens
acagtataaacaact

SEQ ID NO: 10233 - DNA, 15 bp, Homo sapiens
cacagtataaacaac

SEQ ID NO: 10234 - DNA, 15 bp, Homo sapiens
ccacagtataaacaa

SEQ ID NO: 10235 - DNA, 15 bp, Homo sapiens
tccacagtataaaca

SEQ ID NO: 10236 - DNA, 15 bp, Homo sapiens
atccacagtataaac

SEQ ID NO: 10237 - DNA, 15 bp, Homo sapiens
aatccacagtataaa

SEQ ID NO: 10238 - DNA, 15 bp, Homo sapiens
aaatccacagtataa

SEQ ID NO: 10239 - DNA, 15 bp, Homo sapiens
taaatccacagtata

SEQ ID NO: 10240 - DNA, 15 bp, Homo sapiens
ataaatccacagtat

SEQ ID NO: 10241 - DNA, 15 bp, Homo sapiens
cataaatccacagta

SEQ ID NO: 10242 - DNA, 15 bp, Homo sapiens
acataaatccacagt

SEQ ID NO: 10243 - DNA, 15 bp, Homo sapiens
gacataaatccacag

SEQ ID NO: 10244 - DNA, 15 bp, Homo sapiens
tgacataaatccaca

SEQ ID NO: 10245 - DNA, 15 bp, Homo sapiens
gtgacataaatccac

SEQ ID NO: 10246 - DNA, 15 bp, Homo sapiens
tgtgacataaatcca

SEQ ID NO: 10247 - DNA, 15 bp, Homo sapiens
atgtgacataaatcc

SEQ ID NO: 10248 - DNA, 15 bp, Homo sapiens
catgtgacataaatc

SEQ ID NO: 10249 - DNA, 15 bp, Homo sapiens
ccatgtgacataaat

SEQ ID NO: 10250 - DNA, 15 bp, Homo sapiens
tccatgtgacataaa

SEQ ID NO: 10251 - DNA, 15 bp, Homo sapiens
atccatgtgacataa

SEQ ID NO: 10252 - DNA, 15 bp, Homo sapiens
tatccatgtgacata

SEQ ID NO: 10253 - DNA, 15 bp, Homo sapiens
atatccatgtgacat

SEQ ID NO: 10254 - DNA, 15 bp, Homo sapiens
aatatccatgtgaca

SEQ ID NO: 10255 - DNA, 15 bp, Homo sapiens
taatatccatgtgac

SEQ ID NO: 10256 - DNA, 15 bp, Homo sapiens
gtaatatccatgtga

SEQ ID NO: 10257 - DNA, 15 bp, Homo sapiens
agtaatatccatgtg

SEQ ID NO: 10258 - DNA, 15 bp, Homo sapiens
aagtaatatccatgt

SEQ ID NO: 10259 - DNA, 15 bp, Homo sapiens
caagtaatatccatg

SEQ ID NO: 10260 - DNA, 15 bp, Homo sapiens
tcaagtaatatccat

SEQ ID NO: 10261 - DNA, 15 bp, Homo sapiens
atcaagtaatatcca

SEQ ID NO: 10262 - DNA, 15 bp, Homo sapiens
tatcaagtaatatcc

SEQ ID NO: 10263 - DNA, 15 bp, Homo sapiens
atatcaagtaatatc

SEQ ID NO: 10264 - DNA, 15 bp, Homo sapiens
catatcaagtaatat

SEQ ID NO: 10265 - DNA, 15 bp, Homo sapiens
tcatatcaagtaata

SEQ ID NO: 10266 - DNA, 15 bp, Homo sapiens
ttcatatcaagtaat

SEQ ID NO: 10267 - DNA, 15 bp, Homo sapiens
attcatatcaagtaa

SEQ ID NO: 10268 - DNA, 15 bp, Homo sapiens
tattcatatcaagta

SEQ ID NO: 10269 - DNA, 15 bp, Homo sapiens
ttattcatatcaagt

SEQ ID NO: 10270 - DNA, 15 bp, Homo sapiens
attattcatatcaag

SEQ ID NO: 10271 - DNA, 15 bp, Homo sapiens
tattattcatatcaa

SEQ ID NO: 10272 - DNA, 15 bp, Homo sapiens
ttattattcatatca

SEQ ID NO: 10273 - DNA, 15 bp, Homo sapiens
gttattattcatatc

SEQ ID NO: 10274 - DNA, 15 bp, Homo sapiens
agttattattcatat

SEQ ID NO: 10275 - DNA, 15 bp, Homo sapiens
tagttattattcata

SEQ ID NO: 10276 - DNA, 15 bp, Homo sapiens
ttagttattattcat

SEQ ID NO: 10277 - DNA, 15 bp, Homo sapiens
tttagttattattca

SEQ ID NO: 10278 - DNA, 15 bp, Homo sapiens
atttagttattattc

SEQ ID NO: 10279 - DNA, 15 bp, Homo sapiens
catttagttattatt

SEQ ID NO: 10280 - DNA, 15 bp, Homo sapiens
tcatttagttattat

SEQ ID NO: 10281 - DNA, 15 bp, Homo sapiens
ttcatttagttatta

SEQ ID NO: 10282 - DNA, 15 bp, Homo sapiens
gttcatttagttatt

SEQ ID NO: 10283 - DNA, 15 bp, Homo sapiens
tgttcatttagttat

SEQ ID NO: 10284 - DNA, 15 bp, Homo sapiens
atgttcatttagtta

SEQ ID NO: 10285 - DNA, 15 bp, Homo sapiens
catgttcatttagtt

SEQ ID NO: 10286 - DNA, 15 bp, Homo sapiens
tcatgttcatttagt

SEQ ID NO: 10287 - DNA, 15 bp, Homo sapiens
gtcatgttcatttag

SEQ ID NO: 10288 - DNA, 15 bp, Homo sapiens
agtcatgttcattta

SEQ ID NO: 10289 - DNA, 15 bp, Homo sapiens
cagtcatgttcattt

SEQ ID NO: 10290 - DNA, 15 bp, Homo sapiens
acagtcatgttcatt

SEQ ID NO: 10291 - DNA, 15 bp, Homo sapiens
aacagtcatgttcat

SEQ ID NO: 10292 - DNA, 15 bp, Homo sapiens
taacagtcatgttca

SEQ ID NO: 10293 - DNA, 15 bp, Homo sapiens
ctaacagtcatgttc

SEQ ID NO: 10294 - DNA, 15 bp, Homo sapiens
tctaacagtcatgtt

SEQ ID NO: 10295 - DNA, 15 bp, Homo sapiens
atctaacagtcatgt

SEQ ID NO: 10296 - DNA, 15 bp, Homo sapiens
catctaacagtcatg

SEQ ID NO: 10297 - DNA, 15 bp, Homo sapiens
tcatctaacagtcat

SEQ ID NO: 10298 - DNA, 15 bp, Homo sapiens
atcatctaacagtca

SEQ ID NO: 10299 - DNA, 15 bp, Homo sapiens
gatcatctaacagtc

SEQ ID NO: 10300 - DNA, 15 bp, Homo sapiens
tgatcatctaacagt

SEQ ID NO: 10301 - DNA, 15 bp, Homo sapiens
gtgatcatctaacag

SEQ ID NO: 10302 - DNA, 15 bp, Homo sapiens
ggtgatcatctaaca

SEQ ID NO: 10303 - DNA, 15 bp, Homo sapiens
aggtgatcatctaac

SEQ ID NO: 10304 - DNA, 15 bp, Homo sapiens
aaggtgatcatctaa

SEQ ID NO: 10305 - DNA, 15 bp, Homo sapiens
aaaggtgatcatcta

SEQ ID NO: 10306 - DNA, 15 bp, Homo sapiens
aaaaggtgatcatct

SEQ ID NO: 10307 - DNA, 15 bp, Homo sapiens
taaaaggtgatcatc

SEQ ID NO: 10308 - DNA, 15 bp, Homo sapiens
gtaaaaggtgatcat

SEQ ID NO: 10309 - DNA, 15 bp, Homo sapiens
agtaaaaggtgatca

SEQ ID NO: 10310 - DNA, 15 bp, Homo sapiens
aagtaaaaggtgatc

SEQ ID NO: 10311 - DNA, 15 bp, Homo sapiens
aaagtaaaaggtgat

SEQ ID NO: 10312 - DNA, 15 bp, Homo sapiens
taaagtaaaaggtga

SEQ ID NO: 10313 - DNA, 15 bp, Homo sapiens
ttaaagtaaaaggtg

SEQ ID NO: 10314 - DNA, 15 bp, Homo sapiens
attaaagtaaaaggt

SEQ ID NO: 10315 - DNA, 15 bp, Homo sapiens
gattaaagtaaaagg

SEQ ID NO: 10316 - DNA, 15 bp, Homo sapiens
tgattaaagtaaaag

SEQ ID NO: 10317 - DNA, 15 bp, Homo sapiens
ttgattaaagtaaaa

SEQ ID NO: 10318 - DNA, 15 bp, Homo sapiens
cttgattaaagtaaa

SEQ ID NO: 10319 - DNA, 15 bp, Homo sapiens
tcttgattaaagtaa

SEQ ID NO: 10320 - DNA, 15 bp, Homo sapiens
ttcttgattaaagta

SEQ ID NO: 10321 - DNA, 15 bp, Homo sapiens
attcttgattaaagt

SEQ ID NO: 10322 - DNA, 15 bp, Homo sapiens
aattcttgattaaag

SEQ ID NO: 10323 - DNA, 15 bp, Homo sapiens
caattcttgattaaa

SEQ ID NO: 10324 - DNA, 15 bp, Homo sapiens
tcaattcttgattaa

SEQ ID NO: 10325 - DNA, 15 bp, Homo sapiens
ttcaattcttgatta

SEQ ID NO: 10326 - DNA, 15 bp, Homo sapiens
cttcaattcttgatt

SEQ ID NO: 10327 - DNA, 15 bp, Homo sapiens
acttcaattcttgat

SEQ ID NO: 10328 - DNA, 15 bp, Homo sapiens
aacttcaattcttga

SEQ ID NO: 10329 - DNA, 15 bp, Homo sapiens
aaacttcaattcttg

SEQ ID NO: 10330 - DNA, 15 bp, Homo sapiens
aaaacttcaattctt

SEQ ID NO: 10331 - DNA, 15 bp, Homo sapiens
taaaacttcaattct

SEQ ID NO: 10332 - DNA, 15 bp, Homo sapiens
ataaaacttcaattc

SEQ ID NO: 10333 - DNA, 15 bp, Homo sapiens
aataaaacttcaatt

SEQ ID NO: 10334 - DNA, 15 bp, Homo sapiens
aaataaaacttcaat

SEQ ID NO: 10335 - DNA, 15 bp, Homo sapiens
aaaataaaacttcaa

SEQ ID NO: 10336 - DNA, 15 bp, Homo sapiens
aaaaataaaacttca

SEQ ID NO: 10337 - DNA, 15 bp, Homo sapiens
aaaaaataaaacttc

SEQ ID NO: 10338 - DNA, 15 bp, Homo sapiens
gaaaaaataaaactt

SEQ ID NO: 10339 - DNA, 15 bp, Homo sapiens
agaaaaaataaaact

SEQ ID NO: 10340 - DNA, 15 bp, Homo sapiens
tagaaaaaataaaac

SEQ ID NO: 10341 - DNA, 15 bp, Homo sapiens
ttagaaaaaataaaa

SEQ ID NO: 10342 - DNA, 15 bp, Homo sapiens
tttagaaaaaataaa

SEQ ID NO: 10343 - DNA, 15 bp, Homo sapiens
atttagaaaaaataa

SEQ ID NO: 10344 - DNA, 15 bp, Homo sapiens
tatttagaaaaaata

SEQ ID NO: 10345 - DNA, 15 bp, Homo sapiens
ctatttagaaaaaat

SEQ ID NO: 10346 - DNA, 15 bp, Homo sapiens
tctatttagaaaaaa

SEQ ID NO: 10347 - DNA, 15 bp, Homo sapiens
atctatttagaaaaa

SEQ ID NO: 10348 - DNA, 15 bp, Homo sapiens
tatctatttagaaaa

SEQ ID NO: 10349 - DNA, 15 bp, Homo sapiens
gtatctatttagaaa

SEQ ID NO: 10350 - DNA, 15 bp, Homo sapiens
tgtatctatttagaa

SEQ ID NO: 10351 - DNA, 15 bp, Homo sapiens
atgtatctatttaga

SEQ ID NO: 10352 - DNA, 15 bp, Homo sapiens
tatgtatctatttag

SEQ ID NO: 10353 - DNA, 15 bp, Homo sapiens
atatgtatctattta

SEQ ID NO: 10354 - DNA, 15 bp, Homo sapiens
tatatgtatctattt

SEQ ID NO: 10355 - DNA, 15 bp, Homo sapiens
ttatatgtatctatt

SEQ ID NO: 10356 - DNA, 15 bp, Homo sapiens
tttatatgtatctat

SEQ ID NO: 10357 - DNA, 15 bp, Homo sapiens
ttttatatgtatcta

SEQ ID NO: 10358 - DNA, 15 bp, Homo sapiens
attttatatgtatct

SEQ ID NO: 10359 - DNA, 15 bp, Homo sapiens
cattttatatgtatc

SEQ ID NO: 10360 - DNA, 15 bp, Homo sapiens
tcattttatatgtat

SEQ ID NO: 10361 - DNA, 15 bp, Homo sapiens
ttcattttatatgta

SEQ ID NO: 10362 - DNA, 15 bp, Homo sapiens
attcattttatatgt

SEQ ID NO: 10363 - DNA, 15 bp, Homo sapiens
cattcattttatatg

SEQ ID NO: 10364 - DNA, 15 bp, Homo sapiens
ccattcattttatat

SEQ ID NO: 10365 - DNA, 15 bp, Homo sapiens
tccattcattttata

SEQ ID NO: 10366 - DNA, 15 bp, Homo sapiens
ttccattcattttat

SEQ ID NO: 10367 - DNA, 15 bp, Homo sapiens
attccattcatttta

SEQ ID NO: 10368 - DNA, 15 bp, Homo sapiens
aattccattcatttt

SEQ ID NO: 10369 - DNA, 15 bp, Homo sapiens
aaattccattcattt

SEQ ID NO: 10370 - DNA, 15 bp, Homo sapiens
taaattccattcatt

SEQ ID NO: 10371 - DNA, 15 bp, Homo sapiens
ataaattccattcat

SEQ ID NO: 10372 - DNA, 15 bp, Homo sapiens
aataaattccattca

SEQ ID NO: 10373 - DNA, 15 bp, Homo sapiens
gaataaattccattc

SEQ ID NO: 10374 - DNA, 15 bp, Homo sapiens
ggaataaattccatt

SEQ ID NO: 10375 - DNA, 15 bp, Homo sapiens
gggaataaattccat

SEQ ID NO: 10376 - DNA, 15 bp, Homo sapiens
agggaataaattcca

SEQ ID NO: 10377 - DNA, 15 bp, Homo sapiens
gagggaataaattcc

SEQ ID NO: 10378 - DNA, 15 bp, Homo sapiens
agagggaataaattc

SEQ ID NO: 10379 - DNA, 15 bp, Homo sapiens
gagagggaataaatt

SEQ ID NO: 10380 - DNA, 15 bp, Homo sapiens
ggagagggaataaat

SEQ ID NO: 10381 - DNA, 15 bp, Homo sapiens
gggagagggaataaa

SEQ ID NO: 10382 - DNA, 15 bp, Homo sapiens
ggggagagggaataa

SEQ ID NO: 10383 - DNA, 15 bp, Homo sapiens
tggggagagggaata

SEQ ID NO: 10384 - DNA, 15 bp, Homo sapiens
ctggggagagggaat

SEQ ID NO: 10385 - DNA, 15 bp, Homo sapiens
tctggggagagggaa

SEQ ID NO: 10386 - DNA, 15 bp, Homo sapiens
atctggggagaggga

SEQ ID NO: 10387 - DNA, 15 bp, Homo sapiens
aatctggggagaggg

SEQ ID NO: 10388 - DNA, 15 bp, Homo sapiens
aaatctggggagagg

SEQ ID NO: 10389 - DNA, 15 bp, Homo sapiens
aaaatctggggagag

SEQ ID NO: 10390 - DNA, 15 bp, Homo sapiens
taaaatctggggaga

SEQ ID NO: 10391 - DNA, 15 bp, Homo sapiens
ataaaatctggggag

SEQ ID NO: 10392 - DNA, 15 bp, Homo sapiens
aataaaatctgggga

SEQ ID NO: 10393 - DNA, 15 bp, Homo sapiens
aaataaaatctgggg

SEQ ID NO: 10394 - DNA, 15 bp, Homo sapiens
caaataaaatctggg

SEQ ID NO: 10395 - DNA, 15 bp, Homo sapiens
ccaaataaaatctgg

SEQ ID NO: 10396 - DNA, 15 bp, Homo sapiens
tccaaataaaatctg

SEQ ID NO: 10397 - DNA, 15 bp, Homo sapiens
atccaaataaaatct

SEQ ID NO: 10398 - DNA, 15 bp, Homo sapiens
aatccaaataaaatc

SEQ ID NO: 10399 - DNA, 15 bp, Homo sapiens
gaatccaaataaaat

SEQ ID NO: 10400 - DNA, 15 bp, Homo sapiens
agaatccaaataaaa

SEQ ID NO: 10401 - DNA, 15 bp, Homo sapiens
tagaatccaaataaa

SEQ ID NO: 10402 - DNA, 15 bp, Homo sapiens
ttagaatccaaataa

SEQ ID NO: 10403 - DNA, 15 bp, Homo sapiens
tttagaatccaaata

SEQ ID NO: 10404 - DNA, 15 bp, Homo sapiens
ttttagaatccaaat

SEQ ID NO: 10405 - DNA, 15 bp, Homo sapiens
attttagaatccaaa

SEQ ID NO: 10406 - DNA, 15 bp, Homo sapiens
cattttagaatccaa

SEQ ID NO: 10407 - DNA, 15 bp, Homo sapiens
ccattttagaatcca

SEQ ID NO: 10408 - DNA, 15 bp, Homo sapiens
tccattttagaatcc

SEQ ID NO: 10409 - DNA, 15 bp, Homo sapiens
ttccattttagaatc

SEQ ID NO: 10410 - DNA, 15 bp, Homo sapiens
attccattttagaat

SEQ ID NO: 10411 - DNA, 15 bp, Homo sapiens
aattccattttagaa

SEQ ID NO: 10412 - DNA, 15 bp, Homo sapiens
taattccattttaga

SEQ ID NO: 10413 - DNA, 15 bp, Homo sapiens
ataattccattttag

SEQ ID NO: 10414 - DNA, 15 bp, Homo sapiens
aataattccatttta

SEQ ID NO: 10415 - DNA, 15 bp, Homo sapiens
taataattccatttt

SEQ ID NO: 10416 - DNA, 15 bp, Homo sapiens
gtaataattccattt

SEQ ID NO: 10417 - DNA, 15 bp, Homo sapiens
tgtaataattccatt

SEQ ID NO: 10418 - DNA, 15 bp, Homo sapiens
atgtaataattccat

SEQ ID NO: 10419 - DNA, 15 bp, Homo sapiens
gatgtaataattcca

SEQ ID NO: 10420 - DNA, 15 bp, Homo sapiens
tgatgtaataattcc

SEQ ID NO: 10421 - DNA, 15 bp, Homo sapiens
ttgatgtaataattc

SEQ ID NO: 10422 - DNA, 15 bp, Homo sapiens
tttgatgtaataatt

SEQ ID NO: 10423 - DNA, 15 bp, Homo sapiens
ttttgatgtaataat

SEQ ID NO: 10424 - DNA, 15 bp, Homo sapiens
cttttgatgtaataa

SEQ ID NO: 10425 - DNA, 15 bp, Homo sapiens
tcttttgatgtaata

SEQ ID NO: 10426 - DNA, 15 bp, Homo sapiens
atcttttgatgtaat

SEQ ID NO: 10427 - DNA, 15 bp, Homo sapiens
tatcttttgatgtaa

SEQ ID NO: 10428 - DNA, 15 bp, Homo sapiens
ttatcttttgatgta

SEQ ID NO: 10429 - DNA, 15 bp, Homo sapiens
cttatcttttgatgt

SEQ ID NO: 10430 - DNA, 15 bp, Homo sapiens
ccttatcttttgatg

SEQ ID NO: 10431 - DNA, 15 bp, Homo sapiens
accttatcttttgat

SEQ ID NO: 10432 - DNA, 15 bp, Homo sapiens
taccttatcttttga

SEQ ID NO: 10433 - DNA, 15 bp, Homo sapiens
ataccttatcttttg

SEQ ID NO: 10434 - DNA, 15 bp, Homo sapiens
aataccttatctttt

SEQ ID NO: 10435 - DNA, 15 bp, Homo sapiens
aaataccttatcttt

SEQ ID NO: 10436 - DNA, 15 bp, Homo sapiens
aaaataccttatctt

SEQ ID NO: 10437 - DNA, 15 bp, Homo sapiens
aaaaataccttatct

SEQ ID NO: 10438 - DNA, 15 bp, Homo sapiens
taaaaataccttatc

SEQ ID NO: 10439 - DNA, 15 bp, Homo sapiens
ttaaaaataccttat

SEQ ID NO: 10440 - DNA, 15 bp, Homo sapiens
cttaaaaatacctta

SEQ ID NO: 10441 - DNA, 15 bp, Homo sapiens
tcttaaaaatacctt

SEQ ID NO: 10442 - DNA, 15 bp, Homo sapiens
ttcttaaaaatacct

SEQ ID NO: 10443 - DNA, 15 bp, Homo sapiens
cttcttaaaaatacc

SEQ ID NO: 10444 - DNA, 15 bp, Homo sapiens
acttcttaaaaatac

SEQ ID NO: 10445 - DNA, 15 bp, Homo sapiens
tacttcttaaaaata

SEQ ID NO: 10446 - DNA, 15 bp, Homo sapiens
atacttcttaaaaat

SEQ ID NO: 10447 - DNA, 15 bp, Homo sapiens
tatacttcttaaaaa

SEQ ID NO: 10448 - DNA, 15 bp, Homo sapiens
ctatacttcttaaaa

SEQ ID NO: 10449 - DNA, 15 bp, Homo sapiens
actatacttcttaaa

SEQ ID NO: 10450 - DNA, 15 bp, Homo sapiens
aactatacttcttaa

SEQ ID NO: 10451 - DNA, 15 bp, Homo sapiens
caactatacttctta

SEQ ID NO: 10452 - DNA, 15 bp, Homo sapiens
acaactatacttctt

SEQ ID NO: 10453 - DNA, 15 bp, Homo sapiens
aacaactatacttct

SEQ ID NO: 10454 - DNA, 15 bp, Homo sapiens
aaacaactatacttc

SEQ ID NO: 10455 - DNA, 15 bp, Homo sapiens
aaaacaactatactt

SEQ ID NO: 10456 - DNA, 15 bp, Homo sapiens
aaaaacaactatact

SEQ ID NO: 10457 - DNA, 15 bp, Homo sapiens
aaaaaacaactatac

SEQ ID NO: 10458 - DNA, 15 bp, Homo sapiens
aaaaaaacaactata

SEQ ID NO: 10459 - DNA, 15 bp, Homo sapiens
caaaaaaacaactat

SEQ ID NO: 10460 - DNA, 15 bp, Homo sapiens
tcaaaaaaacaacta

SEQ ID NO: 10461 - DNA, 15 bp, Homo sapiens
ctcaaaaaaacaact

SEQ ID NO: 10462 - DNA, 15 bp, Homo sapiens
tctcaaaaaaacaac

SEQ ID NO: 10463 - DNA, 15 bp, Homo sapiens
gtctcaaaaaaacaa

SEQ ID NO: 10464 - DNA, 15 bp, Homo sapiens
agtctcaaaaaaaca

SEQ ID NO: 10465 - DNA, 15 bp, Homo sapiens
cagtctcaaaaaaac

SEQ ID NO: 10466 - DNA, 15 bp, Homo sapiens
tcagtctcaaaaaaa

SEQ ID NO: 10467 - DNA, 15 bp, Homo sapiens
ctcagtctcaaaaaa

SEQ ID NO: 10468 - DNA, 15 bp, Homo sapiens
actcagtctcaaaaa

SEQ ID NO: 10469 - DNA, 15 bp, Homo sapiens
gactcagtctcaaaa

SEQ ID NO: 10470 - DNA, 15 bp, Homo sapiens
agactcagtctcaaa

SEQ ID NO: 10471 - DNA, 15 bp, Homo sapiens
aagactcagtctcaa

SEQ ID NO: 10472 - DNA, 15 bp, Homo sapiens
caagactcagtctca

SEQ ID NO: 10473 - DNA, 15 bp, Homo sapiens
gcaagactcagtctc

SEQ ID NO: 10474 - DNA, 15 bp, Homo sapiens
agcaagactcagtct

SEQ ID NO: 10475 - DNA, 15 bp, Homo sapiens
gagcaagactcagtc

SEQ ID NO: 10476 - DNA, 15 bp, Homo sapiens
agagcaagactcagt

SEQ ID NO: 10477 - DNA, 15 bp, Homo sapiens
tagagcaagactcag

SEQ ID NO: 10478 - DNA, 15 bp, Homo sapiens
ttagagcaagactca

SEQ ID NO: 10479 - DNA, 15 bp, Homo sapiens
gttagagcaagactc

SEQ ID NO: 10480 - DNA, 15 bp, Homo sapiens
cgttagagcaagact

SEQ ID NO: 10481 - DNA, 15 bp, Homo sapiens
gcgttagagcaagac

SEQ ID NO: 10482 - DNA, 15 bp, Homo sapiens
ggcgttagagcaaga

SEQ ID NO: 10483 - DNA, 15 bp, Homo sapiens
gggcgttagagcaag

SEQ ID NO: 10484 - DNA, 15 bp, Homo sapiens
tgggcgttagagcaa

SEQ ID NO: 10485 - DNA, 15 bp, Homo sapiens
ctgggcgttagagca

SEQ ID NO: 10486 - DNA, 15 bp, Homo sapiens
cctgggcgttagagc

SEQ ID NO: 10487 - DNA, 15 bp, Homo sapiens
gcctgggcgttagag

SEQ ID NO: 10488 - DNA, 15 bp, Homo sapiens
agcctgggcgttaga

SEQ ID NO: 10489 - DNA, 15 bp, Homo sapiens
cagcctgggcgttag

SEQ ID NO: 10490 - DNA, 15 bp, Homo sapiens
ccagcctgggcgtta

SEQ ID NO: 10491 - DNA, 15 bp, Homo sapiens
accagcctgggcgtt

SEQ ID NO: 10492 - DNA, 15 bp, Homo sapiens
caccagcctgggcgt

SEQ ID NO: 10493 - DNA, 15 bp, Homo sapiens
acaccagcctgggcg

SEQ ID NO: 10494 - DNA, 15 bp, Homo sapiens
cacaccagcctgggc

SEQ ID NO: 10495 - DNA, 15 bp, Homo sapiens
gcacaccagcctggg

SEQ ID NO: 10496 - DNA, 15 bp, Homo sapiens
tgcacaccagcctgg

SEQ ID NO: 10497 - DNA, 15 bp, Homo sapiens
ctgcacaccagcctg

SEQ ID NO: 10498 - DNA, 15 bp, Homo sapiens
actgcacaccagcct

SEQ ID NO: 10499 - DNA, 15 bp, Homo sapiens
cactgcacaccagcc

SEQ ID NO: 10500 - DNA, 15 bp, Homo sapiens
ccactgcacaccagc

SEQ ID NO: 10501 - DNA, 15 bp, Homo sapiens
accactgcacaccag

SEQ ID NO: 10502 - DNA, 15 bp, Homo sapiens
caccactgcacacca

SEQ ID NO: 10503 - DNA, 15 bp, Homo sapiens
gcaccactgcacacc

SEQ ID NO: 10504 - DNA, 15 bp, Homo sapiens
cgcaccactgcacac

SEQ ID NO: 10505 - DNA, 15 bp, Homo sapiens
tcgcaccactgcaca

SEQ ID NO: 10506 - DNA, 15 bp, Homo sapiens
tgagatcgcaccact

SEQ ID NO: 10507 - DNA, 15 bp, Homo sapiens
ctgagatcgcaccac

SEQ ID NO: 10508 - DNA, 15 bp, Homo sapiens
gctgagatcgcacca

SEQ ID NO: 10509 - DNA, 15 bp, Homo sapiens
agctgagatcgcacc

SEQ ID NO: 10510 - DNA, 15 bp, Homo sapiens
gagctgagatcgcac

SEQ ID NO: 10511 - DNA, 15 bp, Homo sapiens
tgagctgagatcgca

SEQ ID NO: 10512 - DNA, 15 bp, Homo sapiens
gtgagctgagatcgc

SEQ ID NO: 10513 - DNA, 15 bp, Homo sapiens
agtgagctgagatcg

SEQ ID NO: 10514 - DNA, 15 bp, Homo sapiens
cagtgagctgagatc

SEQ ID NO: 10515 - DNA, 15 bp, Homo sapiens
gcagtgagctgagat

SEQ ID NO: 10516 - DNA, 15 bp, Homo sapiens
tgcagtgagctgaga

SEQ ID NO: 10517 - DNA, 15 bp, Homo sapiens
ttgcagtgagctgag

SEQ ID NO: 10518 - DNA, 15 bp, Homo sapiens
gttgcagtgagctga

SEQ ID NO: 10519 - DNA, 15 bp, Homo sapiens
ggttgcagtgagctg

SEQ ID NO: 10520 - DNA, 15 bp, Homo sapiens
aggttgcagtgagct

SEQ ID NO: 10521 - DNA, 15 bp, Homo sapiens
aaggttgcagtgagc

SEQ ID NO: 10522 - DNA, 15 bp, Homo sapiens
aaaggttgcagtgag

SEQ ID NO: 10523 - DNA, 15 bp, Homo sapiens
caaaggttgcagtga

SEQ ID NO: 10524 - DNA, 15 bp, Homo sapiens
gcaaaggttgcagtg

SEQ ID NO: 10525 - DNA, 15 bp, Homo sapiens
ggcaaaggttgcagt

SEQ ID NO: 10526 - DNA, 15 bp, Homo sapiens
aggcaaaggttgcag

SEQ ID NO: 10527 - DNA, 15 bp, Homo sapiens
gaggcaaaggttgca

SEQ ID NO: 10528 - DNA, 15 bp, Homo sapiens
ggaggcaaaggttgc

SEQ ID NO: 10529 - DNA, 15 bp, Homo sapiens
gggaggcaaaggttg

SEQ ID NO: 10530 - DNA, 15 bp, Homo sapiens
tgggaggcaaaggtt

SEQ ID NO: 10531 - DNA, 15 bp, Homo sapiens
ctgggaggcaaaggt

SEQ ID NO: 10532 - DNA, 15 bp, Homo sapiens
cctgggaggcaaagg

SEQ ID NO: 10533 - DNA, 15 bp, Homo sapiens
acctgggaggcaaag

SEQ ID NO: 10534 - DNA, 15 bp, Homo sapiens
aacctgggaggcaaa

SEQ ID NO: 10535 - DNA, 15 bp, Homo sapiens
gaacctgggaggcaa

SEQ ID NO: 10536 - DNA, 15 bp, Homo sapiens
tgaacctgggaggca

SEQ ID NO: 10537 - DNA, 15 bp, Homo sapiens
ttgaacctgggaggc

SEQ ID NO: 10538 - DNA, 15 bp, Homo sapiens
cttgaacctgggagg

SEQ ID NO: 10539 - DNA, 15 bp, Homo sapiens
gcttgaacctgggag

SEQ ID NO: 10540 - DNA, 15 bp, Homo sapiens
cgcttgaacctggga

SEQ ID NO: 10541 - DNA, 15 bp, Homo sapiens
tcgcttgaacctggg

SEQ ID NO: 10542 - DNA, 15 bp, Homo sapiens
atcgcttgaacctgg

SEQ ID NO: 10543 - DNA, 15 bp, Homo sapiens
aatcgcttgaacctg

SEQ ID NO: 10544 - DNA, 15 bp, Homo sapiens
gaatcgcttgaacct

SEQ ID NO: 10545 - DNA, 15 bp, Homo sapiens
agaatcgcttgaacc

SEQ ID NO: 10546 - DNA, 15 bp, Homo sapiens
gagaatcgcttgaac

SEQ ID NO: 10547 - DNA, 15 bp, Homo sapiens
aggcaggagaatcgc

SEQ ID NO: 10548 - DNA, 15 bp, Homo sapiens
gaggcaggagaatcg

SEQ ID NO: 10549 - DNA, 15 bp, Homo sapiens
agctgaggcaggaga

SEQ ID NO: 10550 - DNA, 15 bp, Homo sapiens
aagctgaggcaggag

SEQ ID NO: 10551 - DNA, 15 bp, Homo sapiens
gaagctgaggcagga

SEQ ID NO: 10552 - DNA, 15 bp, Homo sapiens
gttgggaagctgagg

SEQ ID NO: 10553 - DNA, 15 bp, Homo sapiens
agttgggaagctgag

SEQ ID NO: 10554 - DNA, 15 bp, Homo sapiens
tagttgggaagctga

SEQ ID NO: 10555 - DNA, 15 bp, Homo sapiens
ctagttgggaagctg

SEQ ID NO: 10556 - DNA, 15 bp, Homo sapiens
gctagttgggaagct

SEQ ID NO: 10557 - DNA, 15 bp, Homo sapiens
agctagttgggaagc

SEQ ID NO: 10558 - DNA, 15 bp, Homo sapiens
tagctagttgggaag

SEQ ID NO: 10559 - DNA, 15 bp, Homo sapiens
ctagctagttgggaa

SEQ ID NO: 10560 - DNA, 15 bp, Homo sapiens
cctagctagttggga

SEQ ID NO: 10561 - DNA, 15 bp, Homo sapiens
tcctagctagttggg

SEQ ID NO: 10562 - DNA, 15 bp, Homo sapiens
gtcctagctagttgg

SEQ ID NO: 10563 - DNA, 15 bp, Homo sapiens
agtcctagctagttg

SEQ ID NO: 10564 - DNA, 15 bp, Homo sapiens
cagtcctagctagtt

SEQ ID NO: 10565 - DNA, 15 bp, Homo sapiens
gcagtcctagctagt

SEQ ID NO: 10566 - DNA, 15 bp, Homo sapiens
tgcagtcctagctag

SEQ ID NO: 10567 - DNA, 15 bp, Homo sapiens
ctgcagtcctagcta

SEQ ID NO: 10568 - DNA, 15 bp, Homo sapiens
cctgcagtcctagct

SEQ ID NO: 10569 - DNA, 15 bp, Homo sapiens
acctgcagtcctagc

SEQ ID NO: 10570 - DNA, 15 bp, Homo sapiens
cacctgcagtcctag

SEQ ID NO: 10571 - DNA, 15 bp, Homo sapiens
acacctgcagtccta

SEQ ID NO: 10572 - DNA, 15 bp, Homo sapiens
cacacctgcagtcct

SEQ ID NO: 10573 - DNA, 15 bp, Homo sapiens
gcacacctgcagtcc

SEQ ID NO: 10574 - DNA, 15 bp, Homo sapiens
cgcacacctgcagtc

SEQ ID NO: 10575 - DNA, 15 bp, Homo sapiens
gcgcacacctgcagt

SEQ ID NO: 10576 - DNA, 15 bp, Homo sapiens
ggcgcacacctgcag

SEQ ID NO: 10577 - DNA, 15 bp, Homo sapiens
tggcgcacacctgca

SEQ ID NO: 10578 - DNA, 15 bp, Homo sapiens
gtggcgcacacctgc

SEQ ID NO: 10579 - DNA, 15 bp, Homo sapiens
ggtggcgcacacctg

SEQ ID NO: 10580 - DNA, 15 bp, Homo sapiens
tggtggcgcacacct

SEQ ID NO: 10581 - DNA, 15 bp, Homo sapiens
gtggtggcgcacacc

SEQ ID NO: 10582 - DNA, 15 bp, Homo sapiens
tgtggtggcgcacac

SEQ ID NO: 10583 - DNA, 15 bp, Homo sapiens
gtgtggtggcgcaca

SEQ ID NO: 10584 - DNA, 15 bp, Homo sapiens
ggtgtggtggcgcac

SEQ ID NO: 10585 - DNA, 15 bp, Homo sapiens
aaaaattagccaggt

SEQ ID NO: 10586 - DNA, 15 bp, Homo sapiens
aaaaaattagccagg

SEQ ID NO: 10587 - DNA, 15 bp, Homo sapiens
caaaaaattagccag

SEQ ID NO: 10588 - DNA, 15 bp, Homo sapiens
acaaaaaattagcca

SEQ ID NO: 10589 - DNA, 15 bp, Homo sapiens
cacaaaaaattagcc

SEQ ID NO: 10590 - DNA, 15 bp, Homo sapiens
acacaaaaaattagc

SEQ ID NO: 10591 - DNA, 15 bp, Homo sapiens
aacacaaaaaattag

SEQ ID NO: 10592 - DNA, 15 bp, Homo sapiens
aaacacaaaaaatta

SEQ ID NO: 10593 - DNA, 15 bp, Homo sapiens
gaaacacaaaaaatt

SEQ ID NO: 10594 - DNA, 15 bp, Homo sapiens
agaaacacaaaaaat

SEQ ID NO: 10595 - DNA, 15 bp, Homo sapiens
tagaaacacaaaaaa

SEQ ID NO: 10596 - DNA, 15 bp, Homo sapiens
ctagaaacacaaaaa

SEQ ID NO: 10597 - DNA, 15 bp, Homo sapiens
actagaaacacaaaa

SEQ ID NO: 10598 - DNA, 15 bp, Homo sapiens
tactagaaacacaaa

SEQ ID NO: 10599 - DNA, 15 bp, Homo sapiens
ctactagaaacacaa

SEQ ID NO: 10600 - DNA, 15 bp, Homo sapiens
tctactagaaacaca

SEQ ID NO: 10601 - DNA, 15 bp, Homo sapiens
ctctactagaaacac

SEQ ID NO: 10602 - DNA, 15 bp, Homo sapiens
cctctactagaaaca

SEQ ID NO: 10603 - DNA, 15 bp, Homo sapiens
acctctactagaaac

SEQ ID NO: 10604 - DNA, 15 bp, Homo sapiens
cacctctactagaaa

SEQ ID NO: 10605 - DNA, 15 bp, Homo sapiens
ccacctctactagaa

SEQ ID NO: 10606 - DNA, 15 bp, Homo sapiens
accacctctactaga

SEQ ID NO: 10607 - DNA, 15 bp, Homo sapiens
aaccacctctactag

SEQ ID NO: 10608 - DNA, 15 bp, Homo sapiens
aaaccacctctacta

SEQ ID NO: 10609 - DNA, 15 bp, Homo sapiens
gaaaccacctctact

SEQ ID NO: 10610 - DNA, 15 bp, Homo sapiens
tgaaaccacctctac

SEQ ID NO: 10611 - DNA, 15 bp, Homo sapiens
gtgaaaccacctcta

SEQ ID NO: 10612 - DNA, 15 bp, Homo sapiens
ggtgaaaccacctct

SEQ ID NO: 10613 - DNA, 15 bp, Homo sapiens
aggtgaaaccacctc

SEQ ID NO: 10614 - DNA, 15 bp, Homo sapiens
aaggtgaaaccacct

SEQ ID NO: 10615 - DNA, 15 bp, Homo sapiens
caaggtgaaaccacc

SEQ ID NO: 10616 - DNA, 15 bp, Homo sapiens
acaaggtgaaaccac

SEQ ID NO: 10617 - DNA, 15 bp, Homo sapiens
aacaaggtgaaacca

SEQ ID NO: 10618 - DNA, 15 bp, Homo sapiens
caacaaggtgaaacc

SEQ ID NO: 10619 - DNA, 15 bp, Homo sapiens
ccaacaaggtgaaac

SEQ ID NO: 10620 - DNA, 15 bp, Homo sapiens
gccaacaaggtgaaa

SEQ ID NO: 10621 - DNA, 15 bp, Homo sapiens
ggccaacaaggtgaa

SEQ ID NO: 10622 - DNA, 15 bp, Homo sapiens
tggccaacaaggtga

SEQ ID NO: 10623 - DNA, 15 bp, Homo sapiens
ctggccaacaaggtg

SEQ ID NO: 10624 - DNA, 15 bp, Homo sapiens
cctggccaacaaggt

SEQ ID NO: 10625 - DNA, 15 bp, Homo sapiens
ccctggccaacaagg

SEQ ID NO: 10626 - DNA, 15 bp, Homo sapiens
accctggccaacaag

SEQ ID NO: 10627 - DNA, 15 bp, Homo sapiens
caccctggccaacaa

SEQ ID NO: 10628 - DNA, 15 bp, Homo sapiens
ccaccctggccaaca

SEQ ID NO: 10629 - DNA, 15 bp, Homo sapiens
accaccctggccaac

SEQ ID NO: 10630 - DNA, 15 bp, Homo sapiens
gaccaccctggccaa

SEQ ID NO: 10631 - DNA, 15 bp, Homo sapiens
agaccaccctggcca

SEQ ID NO: 10632 - DNA, 15 bp, Homo sapiens
gagaccaccctggcc

SEQ ID NO: 10633 - DNA, 15 bp, Homo sapiens
cgagaccaccctggc

SEQ ID NO: 10634 - DNA, 15 bp, Homo sapiens
tcgagaccaccctgg

SEQ ID NO: 10635 - DNA, 15 bp, Homo sapiens
ttcgagaccaccctg

SEQ ID NO: 10636 - DNA, 15 bp, Homo sapiens
attcgagaccaccct

SEQ ID NO: 10637 - DNA, 15 bp, Homo sapiens
aattcgagaccaccc

SEQ ID NO: 10638 - DNA, 15 bp, Homo sapiens
gaattcgagaccacc

SEQ ID NO: 10639 - DNA, 15 bp, Homo sapiens
ggaattcgagaccac

SEQ ID NO: 10640 - DNA, 15 bp, Homo sapiens
aggaattcgagacca

SEQ ID NO: 10641 - DNA, 15 bp, Homo sapiens
caggaattcgagacc

SEQ ID NO: 10642 - DNA, 15 bp, Homo sapiens
tcaggaattcgagac

SEQ ID NO: 10643 - DNA, 15 bp, Homo sapiens
gtcaggaattcgaga

SEQ ID NO: 10644 - DNA, 15 bp, Homo sapiens
ggtcaggaattcgag

SEQ ID NO: 10645 - DNA, 15 bp, Homo sapiens
aggtcaggaattcga

SEQ ID NO: 10646 - DNA, 15 bp, Homo sapiens
gaggtcaggaattcg

SEQ ID NO: 10647 - DNA, 15 bp, Homo sapiens
tgaggtcaggaattc

SEQ ID NO: 10648 - DNA, 15 bp, Homo sapiens
ctgaggtcaggaatt

SEQ ID NO: 10649 - DNA, 15 bp, Homo sapiens
cctgaggtcaggaat

SEQ ID NO: 10650 - DNA, 15 bp, Homo sapiens
gcctgaggtcaggaa

SEQ ID NO: 10651 - DNA, 15 bp, Homo sapiens
cgcctgaggtcagga

SEQ ID NO: 10652 - DNA, 15 bp, Homo sapiens
tcgcctgaggtcagg

SEQ ID NO: 10653 - DNA, 15 bp, Homo sapiens
atcgcctgaggtcag

SEQ ID NO: 10654 - DNA, 15 bp, Homo sapiens
gatcgcctgaggtca

SEQ ID NO: 10655 - DNA, 15 bp, Homo sapiens
agatcgcctgaggtc

SEQ ID NO: 10656 - DNA, 15 bp, Homo sapiens
tagatcgcctgaggt

SEQ ID NO: 10657 - DNA, 15 bp, Homo sapiens
gtagatcgcctgagg

SEQ ID NO: 10658 - DNA, 15 bp, Homo sapiens
ggtagatcgcctgag

SEQ ID NO: 10659 - DNA, 15 bp, Homo sapiens
aggtagatcgcctga

SEQ ID NO: 10660 - DNA, 15 bp, Homo sapiens
caggtagatcgcctg

SEQ ID NO: 10661 - DNA, 15 bp, Homo sapiens
acaggtagatcgcct

SEQ ID NO: 10662 - DNA, 15 bp, Homo sapiens
gacaggtagatcgcc

SEQ ID NO: 10663 - DNA, 15 bp, Homo sapiens
agacaggtagatcgc

SEQ ID NO: 10664 - DNA, 15 bp, Homo sapiens
gagacaggtagatcg

SEQ ID NO: 10665 - DNA, 15 bp, Homo sapiens
cgagacaggtagatc

SEQ ID NO: 10666 - DNA, 15 bp, Homo sapiens
ccgagacaggtagat

SEQ ID NO: 10667 - DNA, 15 bp, Homo sapiens
gccgagacaggtaga

SEQ ID NO: 10668 - DNA, 15 bp, Homo sapiens
ggccgagacaggtag

SEQ ID NO: 10669 - DNA, 15 bp, Homo sapiens
aggccgagacaggta

SEQ ID NO: 10670 - DNA, 15 bp, Homo sapiens
gaggccgagacaggt

SEQ ID NO: 10671 - DNA, 15 bp, Homo sapiens
ggaggccgagacagg

SEQ ID NO: 10672 - DNA, 15 bp, Homo sapiens
gggaggccgagacag

SEQ ID NO: 10673 - DNA, 15 bp, Homo sapiens
tgggaggccgagaca

SEQ ID NO: 10674 - DNA, 15 bp, Homo sapiens
ttgggaggccgagac

SEQ ID NO: 10675 - DNA, 15 bp, Homo sapiens
tttgggaggccgaga

SEQ ID NO: 10676 - DNA, 15 bp, Homo sapiens
ctttgggaggccgag

SEQ ID NO: 10677 - DNA, 15 bp, Homo sapiens
actttgggaggccga

SEQ ID NO: 10678 - DNA, 15 bp, Homo sapiens
cactttgggaggccg

SEQ ID NO: 10679 - DNA, 15 bp, Homo sapiens
agtctgtaatcccag

SEQ ID NO: 10680 - DNA, 15 bp, Homo sapiens
aagtctgtaatccca

SEQ ID NO: 10681 - DNA, 15 bp, Homo sapiens
caagtctgtaatccc

SEQ ID NO: 10682 - DNA, 15 bp, Homo sapiens
tcaagtctgtaatcc

SEQ ID NO: 10683 - DNA, 15 bp, Homo sapiens
ttcaagtctgtaatc

SEQ ID NO: 10684 - DNA, 15 bp, Homo sapiens
gttcaagtctgtaat

SEQ ID NO: 10685 - DNA, 15 bp, Homo sapiens
ggttcaagtctgtaa

SEQ ID NO: 10686 - DNA, 15 bp, Homo sapiens
tggttcaagtctgta

SEQ ID NO: 10687 - DNA, 15 bp, Homo sapiens
gtggttcaagtctgt

SEQ ID NO: 10688 - DNA, 15 bp, Homo sapiens
ggtggttcaagtctg

SEQ ID NO: 10689 - DNA, 15 bp, Homo sapiens
tggtggttcaagtct

SEQ ID NO: 10690 - DNA, 15 bp, Homo sapiens
gtggtggttcaagtc

SEQ ID NO: 10691 - DNA, 15 bp, Homo sapiens
tgtggtggttcaagt

SEQ ID NO: 10692 - DNA, 15 bp, Homo sapiens
gtgtggtggttcaag

SEQ ID NO: 10693 - DNA, 15 bp, Homo sapiens
ggtgtggtggttcaa

SEQ ID NO: 10694 - DNA, 15 bp, Homo sapiens
gggtgtggtggttca

SEQ ID NO: 10695 - DNA, 15 bp, Homo sapiens
tgggtgtggtggttc

SEQ ID NO: 10696 - DNA, 15 bp, Homo sapiens
ctgggtgtggtggtt

SEQ ID NO: 10697 - DNA, 15 bp, Homo sapiens
tggctgggtgtggtg

SEQ ID NO: 10698 - DNA, 15 bp, Homo sapiens
atggctgggtgtggt

SEQ ID NO: 10699 - DNA, 15 bp, Homo sapiens
catggctgggtgtgg

SEQ ID NO: 10700 - DNA, 15 bp, Homo sapiens
tcatggctgggtgtg

SEQ ID NO: 10701 - DNA, 15 bp, Homo sapiens
ttcatggctgggtgt

SEQ ID NO: 10702 - DNA, 15 bp, Homo sapiens
cttcatggctgggtg

SEQ ID NO: 10703 - DNA, 15 bp, Homo sapiens
acttcatggctgggt

SEQ ID NO: 10704 - DNA, 15 bp, Homo sapiens
tacttcatggctggg

SEQ ID NO: 10705 - DNA, 15 bp, Homo sapiens
atacttcatggctgg

SEQ ID NO: 10706 - DNA, 15 bp, Homo sapiens
tatacttcatggctg

SEQ ID NO: 10707 - DNA, 15 bp, Homo sapiens
ctatacttcatggct

SEQ ID NO: 10708 - DNA, 15 bp, Homo sapiens
actatacttcatggc

SEQ ID NO: 10709 - DNA, 15 bp, Homo sapiens
aactatacttcatgg

SEQ ID NO: 10710 - DNA, 15 bp, Homo sapiens
aaactatacttcatg

SEQ ID NO: 10711 - DNA, 15 bp, Homo sapiens
aaaactatacttcat

SEQ ID NO: 10712 - DNA, 15 bp, Homo sapiens
aaaaactatacttca

SEQ ID NO: 10713 - DNA, 15 bp, Homo sapiens
aaaaaactatacttc

SEQ ID NO: 10714 - DNA, 15 bp, Homo sapiens
caaaaaactatactt

SEQ ID NO: 10715 - DNA, 15 bp, Homo sapiens
acaaaaaactatact

SEQ ID NO: 10716 - DNA, 15 bp, Homo sapiens
aacaaaaaactatac

SEQ ID NO: 10717 - DNA, 15 bp, Homo sapiens
aaacaaaaaactata

SEQ ID NO: 10718 - DNA, 15 bp, Homo sapiens
caaacaaaaaactat

SEQ ID NO: 10719 - DNA, 15 bp, Homo sapiens
acaaacaaaaaacta

SEQ ID NO: 10720 - DNA, 15 bp, Homo sapiens
aacaaacaaaaaact

SEQ ID NO: 10721 - DNA, 15 bp, Homo sapiens
aaacaaacaaaaaac

SEQ ID NO: 10722 - DNA, 15 bp, Homo sapiens
aaaacaaacaaaaaa

SEQ ID NO: 10723 - DNA, 15 bp, Homo sapiens
aaaaacaaacaaaaa

SEQ ID NO: 10724 - DNA, 15 bp, Homo sapiens
aaaaaacaaacaaaa

SEQ ID NO: 10725 - DNA, 15 bp, Homo sapiens
caaaaaacaaacaaa

SEQ ID NO: 10726 - DNA, 15 bp, Homo sapiens
tcaaaaaacaaacaa

SEQ ID NO: 10727 - DNA, 15 bp, Homo sapiens
ctcaaaaaacaaaca

SEQ ID NO: 10728 - DNA, 15 bp, Homo sapiens
actcaaaaaacaaac

SEQ ID NO: 10729 - DNA, 15 bp, Homo sapiens
aactcaaaaaacaaa

SEQ ID NO: 10730 - DNA, 15 bp, Homo sapiens
aaactcaaaaaacaa

SEQ ID NO: 10731 - DNA, 15 bp, Homo sapiens
aaaactcaaaaaaca

SEQ ID NO: 10732 - DNA, 15 bp, Homo sapiens
caaaactcaaaaaac

SEQ ID NO: 10733 - DNA, 15 bp, Homo sapiens
gcaaaactcaaaaaa

SEQ ID NO: 10734 - DNA, 15 bp, Homo sapiens
agcaaaactcaaaaa

SEQ ID NO: 10735 - DNA, 15 bp, Homo sapiens
aagcaaaactcaaaa

SEQ ID NO: 10736 - DNA, 15 bp, Homo sapiens
aaagcaaaactcaaa

SEQ ID NO: 10737 - DNA, 15 bp, Homo sapiens
aaaagcaaaactcaa

SEQ ID NO: 10738 - DNA, 15 bp, Homo sapiens
caaaagcaaaactca

SEQ ID NO: 10739 - DNA, 15 bp, Homo sapiens
acaaaagcaaaactc

SEQ ID NO: 10740 - DNA, 15 bp, Homo sapiens
aacaaaagcaaaact

SEQ ID NO: 10741 - DNA, 15 bp, Homo sapiens
caacaaaagcaaaac

SEQ ID NO: 10742 - DNA, 15 bp, Homo sapiens
gcaacaaaagcaaaa

SEQ ID NO: 10743 - DNA, 15 bp, Homo sapiens
ggcaacaaaagcaaa

SEQ ID NO: 10744 - DNA, 15 bp, Homo sapiens
gggcaacaaaagcaa

SEQ ID NO: 10745 - DNA, 15 bp, Homo sapiens
tgggcaacaaaagca

SEQ ID NO: 10746 - DNA, 15 bp, Homo sapiens
ctgggcaacaaaagc

SEQ ID NO: 10747 - DNA, 15 bp, Homo sapiens
cctgggcaacaaaag

SEQ ID NO: 10748 - DNA, 15 bp, Homo sapiens
gcctgggcaacaaaa

SEQ ID NO: 10749 - DNA, 15 bp, Homo sapiens
agcctgggcaacaaa

SEQ ID NO: 10750 - DNA, 15 bp, Homo sapiens
cagcctgggcaacaa

SEQ ID NO: 10751 - DNA, 15 bp, Homo sapiens
tccagcctgggcaac

SEQ ID NO: 10752 - DNA, 15 bp, Homo sapiens
ctccagcctgggcaa

SEQ ID NO: 10753 - DNA, 15 bp, Homo sapiens
actccagcctgggca

SEQ ID NO: 10754 - DNA, 15 bp, Homo sapiens
accattgcactccag

SEQ ID NO: 10755 - DNA, 15 bp, Homo sapiens
caccattgcactcca

SEQ ID NO: 10756 - DNA, 15 bp, Homo sapiens
gcaccattgcactcc

SEQ ID NO: 10757 - DNA, 15 bp, Homo sapiens
cgcaccattgcactc

SEQ ID NO: 10758 - DNA, 15 bp, Homo sapiens
tcgcaccattgcact

SEQ ID NO: 10759 - DNA, 15 bp, Homo sapiens
atcgcaccattgcac

SEQ ID NO: 10760 - DNA, 15 bp, Homo sapiens
gatcgcaccattgca

SEQ ID NO: 10761 - DNA, 15 bp, Homo sapiens
agatcgcaccattgc

SEQ ID NO: 10762 - DNA, 15 bp, Homo sapiens
aagatcgcaccattg

SEQ ID NO: 10763 - DNA, 15 bp, Homo sapiens
caagatcgcaccatt

SEQ ID NO: 10764 - DNA, 15 bp, Homo sapiens
ccaagatcgcaccat

SEQ ID NO: 10765 - DNA, 15 bp, Homo sapiens
ggtgagccaagatcg

SEQ ID NO: 10766 - DNA, 15 bp, Homo sapiens
cggtgagccaagatc

SEQ ID NO: 10767 - DNA, 15 bp, Homo sapiens
gcggtgagccaagat

SEQ ID NO: 10768 - DNA, 15 bp, Homo sapiens
tgcggtgagccaaga

SEQ ID NO: 10769 - DNA, 15 bp, Homo sapiens
ttgcggtgagccaag

SEQ ID NO: 10770 - DNA, 15 bp, Homo sapiens
gttgcggtgagccaa

SEQ ID NO: 10771 - DNA, 15 bp, Homo sapiens
ggttgcggtgagcca

SEQ ID NO: 10772 - DNA, 15 bp, Homo sapiens
aggttgcggtgagcc

SEQ ID NO: 10773 - DNA, 15 bp, Homo sapiens
gaggttgcggtgagc

SEQ ID NO: 10774 - DNA, 15 bp, Homo sapiens
agaggttgcggtgag

SEQ ID NO: 10775 - DNA, 15 bp, Homo sapiens
cagaggttgcggtga

SEQ ID NO: 10776 - DNA, 15 bp, Homo sapiens
gcagaggttgcggtg

SEQ ID NO: 10777 - DNA, 15 bp, Homo sapiens
ggcagaggttgcggt

SEQ ID NO: 10778 - DNA, 15 bp, Homo sapiens
aggcagaggttgcgg

SEQ ID NO: 10779 - DNA, 15 bp, Homo sapiens
gaggcagaggttgcg

SEQ ID NO: 10780 - DNA, 15 bp, Homo sapiens
cgcttgaacccggga

SEQ ID NO: 10781 - DNA, 15 bp, Homo sapiens
tcgcttgaacccggg

SEQ ID NO: 10782 - DNA, 15 bp, Homo sapiens
atcgcttgaacccgg

SEQ ID NO: 10783 - DNA, 15 bp, Homo sapiens
aatcgcttgaacccg

SEQ ID NO: 10784 - DNA, 15 bp, Homo sapiens
gaatcgcttgaaccc

SEQ ID NO: 10785 - DNA, 15 bp, Homo sapiens
tgtggtggtgcatgc

SEQ ID NO: 10786 - DNA, 15 bp, Homo sapiens
gtgtggtggtgcatg

SEQ ID NO: 10787 - DNA, 15 bp, Homo sapiens
tgtgtggtggtgcat

SEQ ID NO: 10788 - DNA, 15 bp, Homo sapiens
gtgtgtggtggtgca

SEQ ID NO: 10789 - DNA, 15 bp, Homo sapiens
agtgtgtggtggtgc

SEQ ID NO: 10790 - DNA, 15 bp, Homo sapiens
cagtgtgtggtggtg

SEQ ID NO: 10791 - DNA, 15 bp, Homo sapiens
gcagtgtgtggtggt

SEQ ID NO: 10792 - DNA, 15 bp, Homo sapiens
agcagtgtgtggtgg

SEQ ID NO: 10793 - DNA, 15 bp, Homo sapiens
tagcagtgtgtggtg

SEQ ID NO: 10794 - DNA, 15 bp, Homo sapiens
ttagcagtgtgtggt

SEQ ID NO: 10795 - DNA, 15 bp, Homo sapiens
attagcagtgtgtgg

SEQ ID NO: 10796 - DNA, 15 bp, Homo sapiens
aattagcagtgtgtg

SEQ ID NO: 10797 - DNA, 15 bp, Homo sapiens
aaattagcagtgtgt

SEQ ID NO: 10798 - DNA, 15 bp, Homo sapiens
aaaattagcagtgtg

SEQ ID NO: 10799 - DNA, 15 bp, Homo sapiens
caaaattagcagtgt

SEQ ID NO: 10800 - DNA, 15 bp, Homo sapiens
acaaaattagcagtg

SEQ ID NO: 10801 - DNA, 15 bp, Homo sapiens
tacaaaattagcagt

SEQ ID NO: 10802 - DNA, 15 bp, Homo sapiens
ttacaaaattagcag

SEQ ID NO: 10803 - DNA, 15 bp, Homo sapiens
attacaaaattagca

SEQ ID NO: 10804 - DNA, 15 bp, Homo sapiens
aattacaaaattagc

SEQ ID NO: 10805 - DNA, 15 bp, Homo sapiens
aaattacaaaattag

SEQ ID NO: 10806 - DNA, 15 bp, Homo sapiens
aaaattacaaaatta

SEQ ID NO: 10807 - DNA, 15 bp, Homo sapiens
taaaattacaaaatt

SEQ ID NO: 10808 - DNA, 15 bp, Homo sapiens
ctaaaattacaaaat

SEQ ID NO: 10809 - DNA, 15 bp, Homo sapiens
actaaaattacaaaa

SEQ ID NO: 10810 - DNA, 15 bp, Homo sapiens
tactaaaattacaaa

SEQ ID NO: 10811 - DNA, 15 bp, Homo sapiens
ctactaaaattacaa

SEQ ID NO: 10812 - DNA, 15 bp, Homo sapiens
tctactaaaattaca

SEQ ID NO: 10813 - DNA, 15 bp, Homo sapiens
ctctactaaaattac

SEQ ID NO: 10814 - DNA, 15 bp, Homo sapiens
tctctactaaaatta

SEQ ID NO: 10815 - DNA, 15 bp, Homo sapiens
atctctactaaaatt

SEQ ID NO: 10816 - DNA, 15 bp, Homo sapiens
tatctctactaaaat

SEQ ID NO: 10817 - DNA, 15 bp, Homo sapiens
ctatctctactaaaa

SEQ ID NO: 10818 - DNA, 15 bp, Homo sapiens
cctatctctactaaa

SEQ ID NO: 10819 - DNA, 15 bp, Homo sapiens
ccctatctctactaa

SEQ ID NO: 10820 - DNA, 15 bp, Homo sapiens
accctatctctacta

SEQ ID NO: 10821 - DNA, 15 bp, Homo sapiens
aaccctatctctact

SEQ ID NO: 10822 - DNA, 15 bp, Homo sapiens
aaaccctatctctac

SEQ ID NO: 10823 - DNA, 15 bp, Homo sapiens
gaaaccctatctcta

SEQ ID NO: 10824 - DNA, 15 bp, Homo sapiens
agaaaccctatctct

SEQ ID NO: 10825 - DNA, 15 bp, Homo sapiens
aagaaaccctatctc

SEQ ID NO: 10826 - DNA, 15 bp, Homo sapiens
gaagaaaccctatct

SEQ ID NO: 10827 - DNA, 15 bp, Homo sapiens
cgaagaaaccctatc

SEQ ID NO: 10828 - DNA, 15 bp, Homo sapiens
acgaagaaaccctat

SEQ ID NO: 10829 - DNA, 15 bp, Homo sapiens
cacgaagaaacccta

SEQ ID NO: 10830 - DNA, 15 bp, Homo sapiens
acacgaagaaaccct

SEQ ID NO: 10831 - DNA, 15 bp, Homo sapiens
aacacgaagaaaccc

SEQ ID NO: 10832 - DNA, 15 bp, Homo sapiens
caacacgaagaaacc

SEQ ID NO: 10833 - DNA, 15 bp, Homo sapiens
ccaacacgaagaaac

SEQ ID NO: 10834 - DNA, 15 bp, Homo sapiens
accaacacgaagaaa

SEQ ID NO: 10835 - DNA, 15 bp, Homo sapiens
gaccaacacgaagaa

SEQ ID NO: 10836 - DNA, 15 bp, Homo sapiens
tgaccaacacgaaga

SEQ ID NO: 10837 - DNA, 15 bp, Homo sapiens
ctgaccaacacgaag

SEQ ID NO: 10838 - DNA, 15 bp, Homo sapiens
cctgaccaacacgaa

SEQ ID NO: 10839 - DNA, 15 bp, Homo sapiens
gcctgaccaacacga

SEQ ID NO: 10840 - DNA, 15 bp, Homo sapiens
agcctgaccaacacg

SEQ ID NO: 10841 - DNA, 15 bp, Homo sapiens
cagcctgaccaacac

SEQ ID NO: 10842 - DNA, 15 bp, Homo sapiens
ctcgagaccagcctg

SEQ ID NO: 10843 - DNA, 15 bp, Homo sapiens
gctcgagaccagcct

SEQ ID NO: 10844 - DNA, 15 bp, Homo sapiens
agctcgagaccagcc

SEQ ID NO: 10845 - DNA, 15 bp, Homo sapiens
gagctcgagaccagc

SEQ ID NO: 10846 - DNA, 15 bp, Homo sapiens
ggagctcgagaccag

SEQ ID NO: 10847 - DNA, 15 bp, Homo sapiens
tggagctcgagacca

SEQ ID NO: 10848 - DNA, 15 bp, Homo sapiens
ctggagctcgagacc

SEQ ID NO: 10849 - DNA, 15 bp, Homo sapiens
tctggagctcgagac

SEQ ID NO: 10850 - DNA, 15 bp, Homo sapiens
gtctggagctcgaga

SEQ ID NO: 10851 - DNA, 15 bp, Homo sapiens
ggtctggagctcgag

SEQ ID NO: 10852 - DNA, 15 bp, Homo sapiens
aggtctggagctcga

SEQ ID NO: 10853 - DNA, 15 bp, Homo sapiens
gaggtctggagctcg

SEQ ID NO: 10854 - DNA, 15 bp, Homo sapiens
tgaggtctggagctc

SEQ ID NO: 10855 - DNA, 15 bp, Homo sapiens
ctgaggtctggagct

SEQ ID NO: 10856 - DNA, 15 bp, Homo sapiens
cctgaggtctggagc

SEQ ID NO: 10857 - DNA, 15 bp, Homo sapiens
acctgaggtctggag

SEQ ID NO: 10858 - DNA, 15 bp, Homo sapiens
cacctgaggtctgga

SEQ ID NO: 10859 - DNA, 15 bp, Homo sapiens
tcacctgaggtctgg

SEQ ID NO: 10860 - DNA, 15 bp, Homo sapiens
atcacctgaggtctg

SEQ ID NO: 10861 - DNA, 15 bp, Homo sapiens
gatcacctgaggtct

SEQ ID NO: 10862 - DNA, 15 bp, Homo sapiens
gggatcacctgaggt

SEQ ID NO: 10863 - DNA, 15 bp, Homo sapiens
ggggatcacctgagg

SEQ ID NO: 10864 - DNA, 15 bp, Homo sapiens
gggggatcacctgag

SEQ ID NO: 10865 - DNA, 15 bp, Homo sapiens
ggggggatcacctga

SEQ ID NO: 10866 - DNA, 15 bp, Homo sapiens
cggggggatcacctg

SEQ ID NO: 10867 - DNA, 15 bp, Homo sapiens
gcggggggatcacct

SEQ ID NO: 10868 - DNA, 15 bp, Homo sapiens
ggcggggggatcacc

SEQ ID NO: 10869 - DNA, 15 bp, Homo sapiens
aggcggggggatcac

SEQ ID NO: 10870 - DNA, 15 bp, Homo sapiens
aaggcggggggatca

SEQ ID NO: 10871 - DNA, 15 bp, Homo sapiens
caaggcggggggatc

SEQ ID NO: 10872 - DNA, 15 bp, Homo sapiens
ccaaggcggggggat

SEQ ID NO: 10873 - DNA, 15 bp, Homo sapiens
gccaaggcgggggga

SEQ ID NO: 10874 - DNA, 15 bp, Homo sapiens
ggccaaggcgggggg

SEQ ID NO: 10875 - DNA, 15 bp, Homo sapiens
aggccaaggcggggg

SEQ ID NO: 10876 - DNA, 15 bp, Homo sapiens
gaggccaaggcgggg

SEQ ID NO: 10877 - DNA, 15 bp, Homo sapiens
ggaggccaaggcggg

SEQ ID NO: 10878 - DNA, 15 bp, Homo sapiens
gggaggccaaggcgg

SEQ ID NO: 10879 - DNA, 15 bp, Homo sapiens
tgggaggccaaggcg

SEQ ID NO: 10880 - DNA, 15 bp, Homo sapiens
tccagcactttggga

SEQ ID NO: 10881 - DNA, 15 bp, Homo sapiens
ttccagcactttggg

SEQ ID NO: 10882 - DNA, 15 bp, Homo sapiens
attccagcactttgg

SEQ ID NO: 10883 - DNA, 15 bp, Homo sapiens
gcctgtaattccagc

SEQ ID NO: 10884 - DNA, 15 bp, Homo sapiens
cgcctgtaattccag

SEQ ID NO: 10885 - DNA, 15 bp, Homo sapiens
acgcctgtaattcca

SEQ ID NO: 10886 - DNA, 15 bp, Homo sapiens
cacgcctgtaattcc

SEQ ID NO: 10887 - DNA, 15 bp, Homo sapiens
tcacgcctgtaattc

SEQ ID NO: 10888 - DNA, 15 bp, Homo sapiens
ctcacgcctgtaatt

SEQ ID NO: 10889 - DNA, 15 bp, Homo sapiens
tggctcacgcctgta

SEQ ID NO: 10890 - DNA, 15 bp, Homo sapiens
atggctcacgcctgt

SEQ ID NO: 10891 - DNA, 15 bp, Homo sapiens
gatggctcacgcctg

SEQ ID NO: 10892 - DNA, 15 bp, Homo sapiens
cgatggctcacgcct

SEQ ID NO: 10893 - DNA, 15 bp, Homo sapiens
gcgatggctcacgcc

SEQ ID NO: 10894 - DNA, 15 bp, Homo sapiens
tgcgatggctcacgc

SEQ ID NO: 10895 - DNA, 15 bp, Homo sapiens
gtgcgatggctcacg

SEQ ID NO: 10896 - DNA, 15 bp, Homo sapiens
ggtgcgatggctcac

SEQ ID NO: 10897 - DNA, 15 bp, Homo sapiens
gggtgcgatggctca

SEQ ID NO: 10898 - DNA, 15 bp, Homo sapiens
cgggtgcgatggctc

SEQ ID NO: 10899 - DNA, 15 bp, Homo sapiens
ccgggtgcgatggct

SEQ ID NO: 10900 - DNA, 15 bp, Homo sapiens
gccgggtgcgatggc

SEQ ID NO: 10901 - DNA, 15 bp, Homo sapiens
agccgggtgcgatgg

SEQ ID NO: 10902 - DNA, 15 bp, Homo sapiens
aagccgggtgcgatg

SEQ ID NO: 10903 - DNA, 15 bp, Homo sapiens
aaagccgggtgcgat

SEQ ID NO: 10904 - DNA, 15 bp, Homo sapiens
aaaagccgggtgcga

SEQ ID NO: 10905 - DNA, 15 bp, Homo sapiens
aaaaagccgggtgcg

SEQ ID NO: 10906 - DNA, 15 bp, Homo sapiens
aaaaaagccgggtgc

SEQ ID NO: 10907 - DNA, 15 bp, Homo sapiens
aaaaaaagccgggtg

SEQ ID NO: 10908 - DNA, 15 bp, Homo sapiens
aaaaaaaagccgggt

SEQ ID NO: 10909 - DNA, 15 bp, Homo sapiens
aaaaaaaaagccggg

SEQ ID NO: 10910 - DNA, 15 bp, Homo sapiens
aaaaaaaaaagccgg

SEQ ID NO: 10911 - DNA, 15 bp, Homo sapiens
caaaaaaaaaagccg

SEQ ID NO: 10912 - DNA, 15 bp, Homo sapiens
acaaaaaaaaaagcc

SEQ ID NO: 10913 - DNA, 15 bp, Homo sapiens
aacaaaaaaaaaagc

SEQ ID NO: 10914 - DNA, 15 bp, Homo sapiens
aaacaaaaaaaaaag

SEQ ID NO: 10915 - DNA, 15 bp, Homo sapiens
aaaacaaaaaaaaaa

SEQ ID NO: 10916 - DNA, 15 bp, Homo sapiens
caaaacaaaaaaaaa

SEQ ID NO: 10917 - DNA, 15 bp, Homo sapiens
tcaaaacaaaaaaaa

SEQ ID NO: 10918 - DNA, 15 bp, Homo sapiens
ctcaaaacaaaaaaa

SEQ ID NO: 10919 - DNA, 15 bp, Homo sapiens
tctcaaaacaaaaaa

SEQ ID NO: 10920 - DNA, 15 bp, Homo sapiens
gtctcaaaacaaaaa

SEQ ID NO: 10921 - DNA, 15 bp, Homo sapiens
ggtctcaaaacaaaa

SEQ ID NO: 10922 - DNA, 15 bp, Homo sapiens
cggtctcaaaacaaa

SEQ ID NO: 10923 - DNA, 15 bp, Homo sapiens
tcggtctcaaaacaa

SEQ ID NO: 10924 - DNA, 15 bp, Homo sapiens
ctcggtctcaaaaca

SEQ ID NO: 10925 - DNA, 15 bp, Homo sapiens
actcggtctcaaaac

SEQ ID NO: 10926 - DNA, 15 bp, Homo sapiens
gactcggtctcaaaa

SEQ ID NO: 10927 - DNA, 15 bp, Homo sapiens
agactcggtctcaaa

SEQ ID NO: 10928 - DNA, 15 bp, Homo sapiens
aagactcggtctcaa

SEQ ID NO: 10929 - DNA, 15 bp, Homo sapiens
caagactcggtctca

SEQ ID NO: 10930 - DNA, 15 bp, Homo sapiens
gcaagactcggtctc

SEQ ID NO: 10931 - DNA, 15 bp, Homo sapiens
agcaagactcggtct

SEQ ID NO: 10932 - DNA, 15 bp, Homo sapiens
gagcaagactcggtc

SEQ ID NO: 10933 - DNA, 15 bp, Homo sapiens
agagcaagactcggt

SEQ ID NO: 10934 - DNA, 15 bp, Homo sapiens
cagagcaagactcgg

SEQ ID NO: 10935 - DNA, 15 bp, Homo sapiens
acagagcaagactcg

SEQ ID NO: 10936 - DNA, 15 bp, Homo sapiens
aacagagcaagactc

SEQ ID NO: 10937 - DNA, 15 bp, Homo sapiens
caacagagcaagact

SEQ ID NO: 10938 - DNA, 15 bp, Homo sapiens
gcaacagagcaagac

SEQ ID NO: 10939 - DNA, 15 bp, Homo sapiens
ggcaacagagcaaga

SEQ ID NO: 10940 - DNA, 15 bp, Homo sapiens
gggcaacagagcaag

SEQ ID NO: 10941 - DNA, 15 bp, Homo sapiens
tgggcaacagagcaa

SEQ ID NO: 10942 - DNA, 15 bp, Homo sapiens
ctgggcaacagagca

SEQ ID NO: 10943 - DNA, 15 bp, Homo sapiens
cctgggcaacagagc

SEQ ID NO: 10944 - DNA, 15 bp, Homo sapiens
cagcctgggcaacag

SEQ ID NO: 10945 - DNA, 15 bp, Homo sapiens
tgccactgcactcca

SEQ ID NO: 10946 - DNA, 15 bp, Homo sapiens
gtgccactgcactcc

SEQ ID NO: 10947 - DNA, 15 bp, Homo sapiens
cgtgccactgcactc

SEQ ID NO: 10948 - DNA, 15 bp, Homo sapiens
tcgtgccactgcact

SEQ ID NO: 10949 - DNA, 15 bp, Homo sapiens
atcgtgccactgcac

SEQ ID NO: 10950 - DNA, 15 bp, Homo sapiens
gatcgtgccactgca

SEQ ID NO: 10951 - DNA, 15 bp, Homo sapiens
agatcgtgccactgc

SEQ ID NO: 10952 - DNA, 15 bp, Homo sapiens
gagatcgtgccactg

SEQ ID NO: 10953 - DNA, 15 bp, Homo sapiens
cgagatcgtgccact

SEQ ID NO: 10954 - DNA, 15 bp, Homo sapiens
ccgagatcgtgccac

SEQ ID NO: 10955 - DNA, 15 bp, Homo sapiens
gccgagatcgtgcca

SEQ ID NO: 10956 - DNA, 15 bp, Homo sapiens
agccgagatcgtgcc

SEQ ID NO: 10957 - DNA, 15 bp, Homo sapiens
gagccgagatcgtgc

SEQ ID NO: 10958 - DNA, 15 bp, Homo sapiens
tgagccgagatcgtg

SEQ ID NO: 10959 - DNA, 15 bp, Homo sapiens
gtgagccgagatcgt

SEQ ID NO: 10960 - DNA, 15 bp, Homo sapiens
ggcagtgagccgaga

SEQ ID NO: 10961 - DNA, 15 bp, Homo sapiens
tggcagtgagccgag

SEQ ID NO: 10962 - DNA, 15 bp, Homo sapiens
gtggcagtgagccga

SEQ ID NO: 10963 - DNA, 15 bp, Homo sapiens
ggtggcagtgagccg

SEQ ID NO: 10964 - DNA, 15 bp, Homo sapiens
aggtggcagtgagcc

SEQ ID NO: 10965 - DNA, 15 bp, Homo sapiens
gaggtggcagtgagc

SEQ ID NO: 10966 - DNA, 15 bp, Homo sapiens
ggaggtggcagtgag

SEQ ID NO: 10967 - DNA, 15 bp, Homo sapiens
cggaggtggcagtga

SEQ ID NO: 10968 - DNA, 15 bp, Homo sapiens
gcggaggtggcagtg

SEQ ID NO: 10969 - DNA, 15 bp, Homo sapiens
ggcggaggtggcagt

SEQ ID NO: 10970 - DNA, 15 bp, Homo sapiens
aggcggaggtggcag

SEQ ID NO: 10971 - DNA, 15 bp, Homo sapiens
gaggcggaggtggca

SEQ ID NO: 10972 - DNA, 15 bp, Homo sapiens
ggaggcggaggtggc

SEQ ID NO: 10973 - DNA, 15 bp, Homo sapiens
aggaggcggaggtgg

SEQ ID NO: 10974 - DNA, 15 bp, Homo sapiens
taggaggcggaggtg

SEQ ID NO: 10975 - DNA, 15 bp, Homo sapiens
ctaggaggcggaggt

SEQ ID NO: 10976 - DNA, 15 bp, Homo sapiens
cctaggaggcggagg

SEQ ID NO: 10977 - DNA, 15 bp, Homo sapiens
acctaggaggcggag

SEQ ID NO: 10978 - DNA, 15 bp, Homo sapiens
tacctaggaggcgga

SEQ ID NO: 10979 - DNA, 15 bp, Homo sapiens
gtacctaggaggcgg

SEQ ID NO: 10980 - DNA, 15 bp, Homo sapiens
tgtacctaggaggcg

SEQ ID NO: 10981 - DNA, 15 bp, Homo sapiens
ttgtacctaggaggc

SEQ ID NO: 10982 - DNA, 15 bp, Homo sapiens
cttgtacctaggagg

SEQ ID NO: 10983 - DNA, 15 bp, Homo sapiens
acttgtacctaggag

SEQ ID NO: 10984 - DNA, 15 bp, Homo sapiens
cacttgtacctagga

SEQ ID NO: 10985 - DNA, 15 bp, Homo sapiens
tcacttgtacctagg

SEQ ID NO: 10986 - DNA, 15 bp, Homo sapiens
atcacttgtacctag

SEQ ID NO: 10987 - DNA, 15 bp, Homo sapiens
aatcacttgtaccta

SEQ ID NO: 10988 - DNA, 15 bp, Homo sapiens
gaatcacttgtacct

SEQ ID NO: 10989 - DNA, 15 bp, Homo sapiens
agaatcacttgtacc

SEQ ID NO: 10990 - DNA, 15 bp, Homo sapiens
gagaatcacttgtac

SEQ ID NO: 10991 - DNA, 15 bp, Homo sapiens
agagaatcacttgta

SEQ ID NO: 10992 - DNA, 15 bp, Homo sapiens
aagagaatcacttgt

SEQ ID NO: 10993 - DNA, 15 bp, Homo sapiens
caagagaatcacttg

SEQ ID NO: 10994 - DNA, 15 bp, Homo sapiens
gcaagagaatcactt

SEQ ID NO: 10995 - DNA, 15 bp, Homo sapiens
ggcaagagaatcact

SEQ ID NO: 10996 - DNA, 15 bp, Homo sapiens
aggcaagagaatcac

SEQ ID NO: 10997 - DNA, 15 bp, Homo sapiens
gaggcaagagaatca

SEQ ID NO: 10998 - DNA, 15 bp, Homo sapiens
tgaggcaagagaatc

SEQ ID NO: 10999 - DNA, 15 bp, Homo sapiens
ctgaggcaagagaat

SEQ ID NO: 11000 - DNA, 15 bp, Homo sapiens
gctgaggcaagagaa

SEQ ID NO: 11001 - DNA, 15 bp, Homo sapiens
ggctgaggcaagaga

SEQ ID NO: 11002 - DNA, 15 bp, Homo sapiens
aggctgaggcaagag

SEQ ID NO: 11003 - DNA, 15 bp, Homo sapiens
gaggctgaggcaaga

SEQ ID NO: 11004 - DNA, 15 bp, Homo sapiens
ggaggctgaggcaag

SEQ ID NO: 11005 - DNA, 15 bp, Homo sapiens
gggaggctgaggcaa

SEQ ID NO: 11006 - DNA, 15 bp, Homo sapiens
ggggaggctgaggca

SEQ ID NO: 11007 - DNA, 15 bp, Homo sapiens
tggggaggctgaggc

SEQ ID NO: 11008 - DNA, 15 bp, Homo sapiens
ctggggaggctgagg

SEQ ID NO: 11009 - DNA, 15 bp, Homo sapiens
actggggaggctgag

SEQ ID NO: 11010 - DNA, 15 bp, Homo sapiens
tactggggaggctga

SEQ ID NO: 11011 - DNA, 15 bp, Homo sapiens
cctactggggaggct

SEQ ID NO: 11012 - DNA, 15 bp, Homo sapiens
acctactggggaggc

SEQ ID NO: 11013 - DNA, 15 bp, Homo sapiens
cacctactggggagg

SEQ ID NO: 11014 - DNA, 15 bp, Homo sapiens
ccacctactggggag

SEQ ID NO: 11015 - DNA, 15 bp, Homo sapiens
cccacctactgggga

SEQ ID NO: 11016 - DNA, 15 bp, Homo sapiens
tcccacctactgggg

SEQ ID NO: 11017 - DNA, 15 bp, Homo sapiens
atcccacctactggg

SEQ ID NO: 11018 - DNA, 15 bp, Homo sapiens
aatcccacctactgg

SEQ ID NO: 11019 - DNA, 15 bp, Homo sapiens
taatcccacctactg

SEQ ID NO: 11020 - DNA, 15 bp, Homo sapiens
gtaatcccacctact

SEQ ID NO: 11021 - DNA, 15 bp, Homo sapiens
agtaatcccacctac

SEQ ID NO: 11022 - DNA, 15 bp, Homo sapiens
cagtaatcccaccta

SEQ ID NO: 11023 - DNA, 15 bp, Homo sapiens
tcagtaatcccacct

SEQ ID NO: 11024 - DNA, 15 bp, Homo sapiens
gtcagtaatcccacc

SEQ ID NO: 11025 - DNA, 15 bp, Homo sapiens
tgtcagtaatcccac

SEQ ID NO: 11026 - DNA, 15 bp, Homo sapiens
gtgtcagtaatccca

SEQ ID NO: 11027 - DNA, 15 bp, Homo sapiens
tgtgtcagtaatccc

SEQ ID NO: 11028 - DNA, 15 bp, Homo sapiens
gtgtgtcagtaatcc

SEQ ID NO: 11029 - DNA, 15 bp, Homo sapiens
tgtgtgtcagtaatc

SEQ ID NO: 11030 - DNA, 15 bp, Homo sapiens
atgtgtgtcagtaat

SEQ ID NO: 11031 - DNA, 15 bp, Homo sapiens
gatgtgtgtcagtaa

SEQ ID NO: 11032 - DNA, 15 bp, Homo sapiens
tgatgtgtgtcagta

SEQ ID NO: 11033 - DNA, 15 bp, Homo sapiens
gtgatgtgtgtcagt

SEQ ID NO: 11034 - DNA, 15 bp, Homo sapiens
ggtgatgtgtgtcag

SEQ ID NO: 11035 - DNA, 15 bp, Homo sapiens
tggtgatgtgtgtca

SEQ ID NO: 11036 - DNA, 15 bp, Homo sapiens
atggtgatgtgtgtc

SEQ ID NO: 11037 - DNA, 15 bp, Homo sapiens
catggtgatgtgtgt

SEQ ID NO: 11038 - DNA, 15 bp, Homo sapiens
gcatggtgatgtgtg

SEQ ID NO: 11039 - DNA, 15 bp, Homo sapiens
ggcatggtgatgtgt

SEQ ID NO: 11040 - DNA, 15 bp, Homo sapiens
gggcatggtgatgtg

SEQ ID NO: 11041 - DNA, 15 bp, Homo sapiens
tgggcatggtgatgt

SEQ ID NO: 11042 - DNA, 15 bp, Homo sapiens
ctgggcatggtgatg

SEQ ID NO: 11043 - DNA, 15 bp, Homo sapiens
cctgggcatggtgat

SEQ ID NO: 11044 - DNA, 15 bp, Homo sapiens
acctgggcatggtga

SEQ ID NO: 11045 - DNA, 15 bp, Homo sapiens
tacctgggcatggtg

SEQ ID NO: 11046 - DNA, 15 bp, Homo sapiens
ttacctgggcatggt

SEQ ID NO: 11047 - DNA, 15 bp, Homo sapiens
attacctgggcatgg

SEQ ID NO: 11048 - DNA, 15 bp, Homo sapiens
aattacctgggcatg

SEQ ID NO: 11049 - DNA, 15 bp, Homo sapiens
aaattacctgggcat

SEQ ID NO: 11050 - DNA, 15 bp, Homo sapiens
aaaattacctgggca

SEQ ID NO: 11051 - DNA, 15 bp, Homo sapiens
aaaaattacctgggc

SEQ ID NO: 11052 - DNA, 15 bp, Homo sapiens
aaaaaattacctggg

SEQ ID NO: 11053 - DNA, 15 bp, Homo sapiens
aaaaaaattacctgg

SEQ ID NO: 11054 - DNA, 15 bp, Homo sapiens
caaaaaaattacctg

SEQ ID NO: 11055 - DNA, 15 bp, Homo sapiens
acaaaaaaattacct

SEQ ID NO: 11056 - DNA, 15 bp, Homo sapiens
tacaaaaaaattacc

SEQ ID NO: 11057 - DNA, 15 bp, Homo sapiens
atacaaaaaaattac

SEQ ID NO: 11058 - DNA, 15 bp, Homo sapiens
aatacaaaaaaatta

SEQ ID NO: 11059 - DNA, 15 bp, Homo sapiens
aaatacaaaaaaatt

SEQ ID NO: 11060 - DNA, 15 bp, Homo sapiens
aaaatacaaaaaaat

SEQ ID NO: 11061 - DNA, 15 bp, Homo sapiens
aaaaatacaaaaaaa

SEQ ID NO: 11062 - DNA, 15 bp, Homo sapiens
cgaaaccccgtctct

SEQ ID NO: 11063 - DNA, 15 bp, Homo sapiens
gcgaaaccccgtctc

SEQ ID NO: 11064 - DNA, 15 bp, Homo sapiens
ggcgaaaccccgtct

SEQ ID NO: 11065 - DNA, 15 bp, Homo sapiens
tggcgaaaccccgtc

SEQ ID NO: 11066 - DNA, 15 bp, Homo sapiens
atggcgaaaccccgt

SEQ ID NO: 11067 - DNA, 15 bp, Homo sapiens
catggcgaaaccccg

SEQ ID NO: 11068 - DNA, 15 bp, Homo sapiens
acatggcgaaacccc

SEQ ID NO: 11069 - DNA, 15 bp, Homo sapiens
gacatggcgaaaccc

SEQ ID NO: 11070 - DNA, 15 bp, Homo sapiens
cgacatggcgaaacc

SEQ ID NO: 11071 - DNA, 15 bp, Homo sapiens
ccgacatggcgaaac

SEQ ID NO: 11072 - DNA, 15 bp, Homo sapiens
gccgacatggcgaaa

SEQ ID NO: 11073 - DNA, 15 bp, Homo sapiens
ggccgacatggcgaa

SEQ ID NO: 11074 - DNA, 15 bp, Homo sapiens
tggccgacatggcga

SEQ ID NO: 11075 - DNA, 15 bp, Homo sapiens
ctggccgacatggcg

SEQ ID NO: 11076 - DNA, 15 bp, Homo sapiens
cctggccgacatggc

SEQ ID NO: 11077 - DNA, 15 bp, Homo sapiens
gcctggccgacatgg

SEQ ID NO: 11078 - DNA, 15 bp, Homo sapiens
agcctggccgacatg

SEQ ID NO: 11079 - DNA, 15 bp, Homo sapiens
cagcctggccgacat

SEQ ID NO: 11080 - DNA, 15 bp, Homo sapiens
ccagcctggccgaca

SEQ ID NO: 11081 - DNA, 15 bp, Homo sapiens
accagcctggccgac

SEQ ID NO: 11082 - DNA, 15 bp, Homo sapiens
gaccagcctggccga

SEQ ID NO: 11083 - DNA, 15 bp, Homo sapiens
agaccagcctggccg

SEQ ID NO: 11084 - DNA, 15 bp, Homo sapiens
cagaccagcctggcc

SEQ ID NO: 11085 - DNA, 15 bp, Homo sapiens
ccagaccagcctggc

SEQ ID NO: 11086 - DNA, 15 bp, Homo sapiens
tccagaccagcctgg

SEQ ID NO: 11087 - DNA, 15 bp, Homo sapiens
ttccagaccagcctg

SEQ ID NO: 11088 - DNA, 15 bp, Homo sapiens
gttccagaccagcct

SEQ ID NO: 11089 - DNA, 15 bp, Homo sapiens
agttccagaccagcc

SEQ ID NO: 11090 - DNA, 15 bp, Homo sapiens
gagttccagaccagc

SEQ ID NO: 11091 - DNA, 15 bp, Homo sapiens
ggagttccagaccag

SEQ ID NO: 11092 - DNA, 15 bp, Homo sapiens
aggagttccagacca

SEQ ID NO: 11093 - DNA, 15 bp, Homo sapiens
caggagttccagacc

SEQ ID NO: 11094 - DNA, 15 bp, Homo sapiens
tcaggagttccagac

SEQ ID NO: 11095 - DNA, 15 bp, Homo sapiens
gtcaggagttccaga

SEQ ID NO: 11096 - DNA, 15 bp, Homo sapiens
ggtcaggagttccag

SEQ ID NO: 11097 - DNA, 15 bp, Homo sapiens
aggtcaggagttcca

SEQ ID NO: 11098 - DNA, 15 bp, Homo sapiens
gaggtcaggagttcc

SEQ ID NO: 11099 - DNA, 15 bp, Homo sapiens
cgggcagatcacctg

SEQ ID NO: 11100 - DNA, 15 bp, Homo sapiens
gcgggcagatcacct

SEQ ID NO: 11101 - DNA, 15 bp, Homo sapiens
ggcgggcagatcacc

SEQ ID NO: 11102 - DNA, 15 bp, Homo sapiens
gaggcgggcagatca

SEQ ID NO: 11103 - DNA, 15 bp, Homo sapiens
tgaggcgggcagatc

SEQ ID NO: 11104 - DNA, 15 bp, Homo sapiens
ctgaggcgggcagat

SEQ ID NO: 11105 - DNA, 15 bp, Homo sapiens
gctgaggcgggcaga

SEQ ID NO: 11106 - DNA, 15 bp, Homo sapiens
ggctgaggcgggcag

SEQ ID NO: 11107 - DNA, 15 bp, Homo sapiens
aggctgaggcgggca

SEQ ID NO: 11108 - DNA, 15 bp, Homo sapiens
gaggctgaggcgggc

SEQ ID NO: 11109 - DNA, 15 bp, Homo sapiens
ggaggctgaggcggg

SEQ ID NO: 11110 - DNA, 15 bp, Homo sapiens
gggaggctgaggcgg

SEQ ID NO: 11111 - DNA, 15 bp, Homo sapiens
tgggaggctgaggcg

SEQ ID NO: 11112 - DNA, 15 bp, Homo sapiens
acactttgggaggct

SEQ ID NO: 11113 - DNA, 15 bp, Homo sapiens
aacactttgggaggc

SEQ ID NO: 11114 - DNA, 15 bp, Homo sapiens
caacactttgggagg

SEQ ID NO: 11115 - DNA, 15 bp, Homo sapiens
ccaacactttgggag

SEQ ID NO: 11116 - DNA, 15 bp, Homo sapiens
acacctgtaatccca

SEQ ID NO: 11117 - DNA, 15 bp, Homo sapiens
cacacctgtaatccc

SEQ ID NO: 11118 - DNA, 15 bp, Homo sapiens
tcacacctgtaatcc

SEQ ID NO: 11119 - DNA, 15 bp, Homo sapiens
acagtggctcacacc

SEQ ID NO: 11120 - DNA, 15 bp, Homo sapiens
cacagtggctcacac

SEQ ID NO: 11121 - DNA, 15 bp, Homo sapiens
gcacagtggctcaca

SEQ ID NO: 11122 - DNA, 15 bp, Homo sapiens
ggcacagtggctcac

SEQ ID NO: 11123 - DNA, 15 bp, Homo sapiens
gggcacagtggctca

SEQ ID NO: 11124 - DNA, 15 bp, Homo sapiens
tgggcacagtggctc

SEQ ID NO: 11125 - DNA, 15 bp, Homo sapiens
ctgggcacagtggct

SEQ ID NO: 11126 - DNA, 15 bp, Homo sapiens
gctgggcacagtggc

SEQ ID NO: 11127 - DNA, 15 bp, Homo sapiens
agctgggcacagtgg

SEQ ID NO: 11128 - DNA, 15 bp, Homo sapiens
cagctgggcacagtg

SEQ ID NO: 11129 - DNA, 15 bp, Homo sapiens
tcagctgggcacagt

SEQ ID NO: 11130 - DNA, 15 bp, Homo sapiens
ttcagctgggcacag

SEQ ID NO: 11131 - DNA, 15 bp, Homo sapiens
cttcagctgggcaca

SEQ ID NO: 11132 - DNA, 15 bp, Homo sapiens
acttcagctgggcac

SEQ ID NO: 11133 - DNA, 15 bp, Homo sapiens
tacttcagctgggca

SEQ ID NO: 11134 - DNA, 15 bp, Homo sapiens
atacttcagctgggc

SEQ ID NO: 11135 - DNA, 15 bp, Homo sapiens
tatacttcagctggg

SEQ ID NO: 11136 - DNA, 15 bp, Homo sapiens
ctatacttcagctgg

SEQ ID NO: 11137 - DNA, 15 bp, Homo sapiens
actatacttcagctg

SEQ ID NO: 11138 - DNA, 15 bp, Homo sapiens
aactatacttcagct

SEQ ID NO: 11139 - DNA, 15 bp, Homo sapiens
aaactatacttcagc

SEQ ID NO: 11140 - DNA, 15 bp, Homo sapiens
aaaactatacttcag

SEQ ID NO: 11141 - DNA, 15 bp, Homo sapiens
caaaactatacttca

SEQ ID NO: 11142 - DNA, 15 bp, Homo sapiens
tcaaaactatacttc

SEQ ID NO: 11143 - DNA, 15 bp, Homo sapiens
gtcaaaactatactt

SEQ ID NO: 11144 - DNA, 15 bp, Homo sapiens
agtcaaaactatact

SEQ ID NO: 11145 - DNA, 15 bp, Homo sapiens
aagtcaaaactatac

SEQ ID NO: 11146 - DNA, 15 bp, Homo sapiens
aaagtcaaaactata

SEQ ID NO: 11147 - DNA, 15 bp, Homo sapiens
gaaagtcaaaactat

SEQ ID NO: 11148 - DNA, 15 bp, Homo sapiens
tgaaagtcaaaacta

SEQ ID NO: 11149 - DNA, 15 bp, Homo sapiens
ttgaaagtcaaaact

SEQ ID NO: 11150 - DNA, 15 bp, Homo sapiens
cttgaaagtcaaaac

SEQ ID NO: 11151 - DNA, 15 bp, Homo sapiens
tcttgaaagtcaaaa

SEQ ID NO: 11152 - DNA, 15 bp, Homo sapiens
ttcttgaaagtcaaa

SEQ ID NO: 11153 - DNA, 15 bp, Homo sapiens
attcttgaaagtcaa

SEQ ID NO: 11154 - DNA, 15 bp, Homo sapiens
aattcttgaaagtca

SEQ ID NO: 11155 - DNA, 15 bp, Homo sapiens
gaattcttgaaagtc

SEQ ID NO: 11156 - DNA, 15 bp, Homo sapiens
agaattcttgaaagt

SEQ ID NO: 11157 - DNA, 15 bp, Homo sapiens
aagaattcttgaaag

SEQ ID NO: 11158 - DNA, 15 bp, Homo sapiens
taagaattcttgaaa

SEQ ID NO: 11159 - DNA, 15 bp, Homo sapiens
ataagaattcttgaa

SEQ ID NO: 11160 - DNA, 15 bp, Homo sapiens
cataagaattcttga

SEQ ID NO: 11161 - DNA, 15 bp, Homo sapiens
tcataagaattcttg

SEQ ID NO: 11162 - DNA, 15 bp, Homo sapiens
ttcataagaattctt

SEQ ID NO: 11163 - DNA, 15 bp, Homo sapiens
gttcataagaattct

SEQ ID NO: 11164 - DNA, 15 bp, Homo sapiens
tgttcataagaattc

SEQ ID NO: 11165 - DNA, 15 bp, Homo sapiens
ttgttcataagaatt

SEQ ID NO: 11166 - DNA, 15 bp, Homo sapiens
cttgttcataagaat

SEQ ID NO: 11167 - DNA, 15 bp, Homo sapiens
tcttgttcataagaa

SEQ ID NO: 11168 - DNA, 15 bp, Homo sapiens
gtcttgttcataaga

SEQ ID NO: 11169 - DNA, 15 bp, Homo sapiens
tgtcttgttcataag

SEQ ID NO: 11170 - DNA, 15 bp, Homo sapiens
atgtcttgttcataa

SEQ ID NO: 11171 - DNA, 15 bp, Homo sapiens
tatgtcttgttcata

SEQ ID NO: 11172 - DNA, 15 bp, Homo sapiens
ctatgtcttgttcat

SEQ ID NO: 11173 - DNA, 15 bp, Homo sapiens
gctatgtcttgttca

SEQ ID NO: 11174 - DNA, 15 bp, Homo sapiens
ggctatgtcttgttc

SEQ ID NO: 11175 - DNA, 15 bp, Homo sapiens
tggctatgtcttgtt

SEQ ID NO: 11176 - DNA, 15 bp, Homo sapiens
ctggctatgtcttgt

SEQ ID NO: 11177 - DNA, 15 bp, Homo sapiens
actggctatgtcttg

SEQ ID NO: 11178 - DNA, 15 bp, Homo sapiens
aactggctatgtctt

SEQ ID NO: 11179 - DNA, 15 bp, Homo sapiens
caactggctatgtct

SEQ ID NO: 11180 - DNA, 15 bp, Homo sapiens
acaactggctatgtc

SEQ ID NO: 11181 - DNA, 15 bp, Homo sapiens
aacaactggctatgt

SEQ ID NO: 11182 - DNA, 15 bp, Homo sapiens
aaacaactggctatg

SEQ ID NO: 11183 - DNA, 15 bp, Homo sapiens
taaacaactggctat

SEQ ID NO: 11184 - DNA, 15 bp, Homo sapiens
ataaacaactggcta

SEQ ID NO: 11185 - DNA, 15 bp, Homo sapiens
tataaacaactggct

SEQ ID NO: 11186 - DNA, 15 bp, Homo sapiens
atataaacaactggc

SEQ ID NO: 11187 - DNA, 15 bp, Homo sapiens
tatataaacaactgg

SEQ ID NO: 11188 - DNA, 15 bp, Homo sapiens
ttatataaacaactg

SEQ ID NO: 11189 - DNA, 15 bp, Homo sapiens
attatataaacaact

SEQ ID NO: 11190 - DNA, 15 bp, Homo sapiens
aattatataaacaac

SEQ ID NO: 11191 - DNA, 15 bp, Homo sapiens
caattatataaacaa

SEQ ID NO: 11192 - DNA, 15 bp, Homo sapiens
gcaattatataaaca

SEQ ID NO: 11193 - DNA, 15 bp, Homo sapiens
tgcaattatataaac

SEQ ID NO: 11194 - DNA, 15 bp, Homo sapiens
atgcaattatataaa

SEQ ID NO: 11195 - DNA, 15 bp, Homo sapiens
aatgcaattatataa

SEQ ID NO: 11196 - DNA, 15 bp, Homo sapiens
aaatgcaattatata

SEQ ID NO: 11197 - DNA, 15 bp, Homo sapiens
aaaatgcaattatat

SEQ ID NO: 11198 - DNA, 15 bp, Homo sapiens
gaaaatgcaattata

SEQ ID NO: 11199 - DNA, 15 bp, Homo sapiens
agaaaatgcaattat

SEQ ID NO: 11200 - DNA, 15 bp, Homo sapiens
tagaaaatgcaatta

SEQ ID NO: 11201 - DNA, 15 bp, Homo sapiens
gtagaaaatgcaatt

SEQ ID NO: 11202 - DNA, 15 bp, Homo sapiens
ggtagaaaatgcaat

SEQ ID NO: 11203 - DNA, 15 bp, Homo sapiens
cggtagaaaatgcaa

SEQ ID NO: 11204 - DNA, 15 bp, Homo sapiens
acggtagaaaatgca

SEQ ID NO: 11205 - DNA, 15 bp, Homo sapiens
aacggtagaaaatgc

SEQ ID NO: 11206 - DNA, 15 bp, Homo sapiens
aaacggtagaaaatg

SEQ ID NO: 11207 - DNA, 15 bp, Homo sapiens
taaacggtagaaaat

SEQ ID NO: 11208 - DNA, 15 bp, Homo sapiens
ataaacggtagaaaa

SEQ ID NO: 11209 - DNA, 15 bp, Homo sapiens
aataaacggtagaaa

SEQ ID NO: 11210 - DNA, 15 bp, Homo sapiens
aaataaacggtagaa

SEQ ID NO: 11211 - DNA, 15 bp, Homo sapiens
gaaataaacggtaga

SEQ ID NO: 11212 - DNA, 15 bp, Homo sapiens
agaaataaacggtag

SEQ ID NO: 11213 - DNA, 15 bp, Homo sapiens
tagaaataaacggta

SEQ ID NO: 11214 - DNA, 15 bp, Homo sapiens
ctagaaataaacggt

SEQ ID NO: 11215 - DNA, 15 bp, Homo sapiens
tctagaaataaacgg

SEQ ID NO: 11216 - DNA, 15 bp, Homo sapiens
ctctagaaataaacg

SEQ ID NO: 11217 - DNA, 15 bp, Homo sapiens
tctctagaaataaac

SEQ ID NO: 11218 - DNA, 15 bp, Homo sapiens
ttctctagaaataaa

SEQ ID NO: 11219 - DNA, 15 bp, Homo sapiens
tttctctagaaataa

SEQ ID NO: 11220 - DNA, 15 bp, Homo sapiens
ctttctctagaaata

SEQ ID NO: 11221 - DNA, 15 bp, Homo sapiens
tctttctctagaaat

SEQ ID NO: 11222 - DNA, 15 bp, Homo sapiens
ttctttctctagaaa

SEQ ID NO: 11223 - DNA, 15 bp, Homo sapiens
tttctttctctagaa

SEQ ID NO: 11224 - DNA, 15 bp, Homo sapiens
ttttctttctctaga

SEQ ID NO: 11225 - DNA, 15 bp, Homo sapiens
attttctttctctag

SEQ ID NO: 11226 - DNA, 15 bp, Homo sapiens
tattttctttctcta

SEQ ID NO: 11227 - DNA, 15 bp, Homo sapiens
ctattttctttctct

SEQ ID NO: 11228 - DNA, 15 bp, Homo sapiens
tctattttctttctc

SEQ ID NO: 11229 - DNA, 15 bp, Homo sapiens
atctattttctttct

SEQ ID NO: 11230 - DNA, 15 bp, Homo sapiens
aatctattttctttc

SEQ ID NO: 11231 - DNA, 15 bp, Homo sapiens
aaatctattttcttt

SEQ ID NO: 11232 - DNA, 15 bp, Homo sapiens
aaaatctattttctt

SEQ ID NO: 11233 - DNA, 15 bp, Homo sapiens
caaaatctattttct

SEQ ID NO: 11234 - DNA, 15 bp, Homo sapiens
acaaaatctattttc

SEQ ID NO: 11235 - DNA, 15 bp, Homo sapiens
gacaaaatctatttt

SEQ ID NO: 11236 - DNA, 15 bp, Homo sapiens
agacaaaatctattt

SEQ ID NO: 11237 - DNA, 15 bp, Homo sapiens
tagacaaaatctatt

SEQ ID NO: 11238 - DNA, 15 bp, Homo sapiens
atagacaaaatctat

SEQ ID NO: 11239 - DNA, 15 bp, Homo sapiens
gatagacaaaatcta

SEQ ID NO: 11240 - DNA, 15 bp, Homo sapiens
tgatagacaaaatct

SEQ ID NO: 11241 - DNA, 15 bp, Homo sapiens
atgatagacaaaatc

SEQ ID NO: 11242 - DNA, 15 bp, Homo sapiens
tatgatagacaaaat

SEQ ID NO: 11243 - DNA, 15 bp, Homo sapiens
ttatgatagacaaaa

SEQ ID NO: 11244 - DNA, 15 bp, Homo sapiens
attatgatagacaaa

SEQ ID NO: 11245 - DNA, 15 bp, Homo sapiens
gattatgatagacaa

SEQ ID NO: 11246 - DNA, 15 bp, Homo sapiens
ggattatgatagaca

SEQ ID NO: 11247 - DNA, 15 bp, Homo sapiens
gggattatgatagac

SEQ ID NO: 11248 - DNA, 15 bp, Homo sapiens
agggattatgataga

SEQ ID NO: 11249 - DNA, 15 bp, Homo sapiens
aagggattatgatag

SEQ ID NO: 11250 - DNA, 15 bp, Homo sapiens
aaagggattatgata

SEQ ID NO: 11251 - DNA, 15 bp, Homo sapiens
taaagggattatgat

SEQ ID NO: 11252 - DNA, 15 bp, Homo sapiens
ctaaagggattatga

SEQ ID NO: 11253 - DNA, 15 bp, Homo sapiens
actaaagggattatg

SEQ ID NO: 11254 - DNA, 15 bp, Homo sapiens
cactaaagggattat

SEQ ID NO: 11255 - DNA, 15 bp, Homo sapiens
gcactaaagggatta

SEQ ID NO: 11256 - DNA, 15 bp, Homo sapiens
agcactaaagggatt

SEQ ID NO: 11257 - DNA, 15 bp, Homo sapiens
tagcactaaagggat

SEQ ID NO: 11258 - DNA, 15 bp, Homo sapiens
ctagcactaaaggga

SEQ ID NO: 11259 - DNA, 15 bp, Homo sapiens
gctagcactaaaggg

SEQ ID NO: 11260 - DNA, 15 bp, Homo sapiens
ggctagcactaaagg

SEQ ID NO: 11261 - DNA, 15 bp, Homo sapiens
tggctagcactaaag

SEQ ID NO: 11262 - DNA, 15 bp, Homo sapiens
gtggctagcactaaa

SEQ ID NO: 11263 - DNA, 15 bp, Homo sapiens
agtggctagcactaa

SEQ ID NO: 11264 - DNA, 15 bp, Homo sapiens
aagtggctagcacta

SEQ ID NO: 11265 - DNA, 15 bp, Homo sapiens
aaagtggctagcact

SEQ ID NO: 11266 - DNA, 15 bp, Homo sapiens
aaaagtggctagcac

SEQ ID NO: 11267 - DNA, 15 bp, Homo sapiens
aaaaagtggctagca

SEQ ID NO: 11268 - DNA, 15 bp, Homo sapiens
aaaaaagtggctagc

SEQ ID NO: 11269 - DNA, 15 bp, Homo sapiens
aaaaaaagtggctag

SEQ ID NO: 11270 - DNA, 15 bp, Homo sapiens
aaaaaaaagtggcta

SEQ ID NO: 11271 - DNA, 15 bp, Homo sapiens
aaaaaaaaagtggct

SEQ ID NO: 11272 - DNA, 15 bp, Homo sapiens
aaaaaaaaaagtggc

SEQ ID NO: 11273 - DNA, 15 bp, Homo sapiens
aaaaaaaaaaagtgg

SEQ ID NO: 11274 - DNA, 15 bp, Homo sapiens
aaaaaaaaaaaagtg

SEQ ID NO: 11275 - DNA, 15 bp, Homo sapiens
actcaaaaaaaaaaa

SEQ ID NO: 11276 - DNA, 15 bp, Homo sapiens
aactcaaaaaaaaaa

SEQ ID NO: 11277 - DNA, 15 bp, Homo sapiens
aaactcaaaaaaaaa

SEQ ID NO: 11278 - DNA, 15 bp, Homo sapiens
aaaactcaaaaaaaa

SEQ ID NO: 11279 - DNA, 15 bp, Homo sapiens
gaaaactcaaaaaaa

SEQ ID NO: 11280 - DNA, 15 bp, Homo sapiens
cgaaaactcaaaaaa

SEQ ID NO: 11281 - DNA, 15 bp, Homo sapiens
gcgaaaactcaaaaa

SEQ ID NO: 11282 - DNA, 15 bp, Homo sapiens
agcgaaaactcaaaa

SEQ ID NO: 11283 - DNA, 15 bp, Homo sapiens
gagcgaaaactcaaa

SEQ ID NO: 11284 - DNA, 15 bp, Homo sapiens
agagcgaaaactcaa

SEQ ID NO: 11285 - DNA, 15 bp, Homo sapiens
aagagcgaaaactca

SEQ ID NO: 11286 - DNA, 15 bp, Homo sapiens
caagagcgaaaactc

SEQ ID NO: 11287 - DNA, 15 bp, Homo sapiens
gcaagagcgaaaact

SEQ ID NO: 11288 - DNA, 15 bp, Homo sapiens
agcaagagcgaaaac

SEQ ID NO: 11289 - DNA, 15 bp, Homo sapiens
cagcaagagcgaaaa

SEQ ID NO: 11290 - DNA, 15 bp, Homo sapiens
gcagcaagagcgaaa

SEQ ID NO: 11291 - DNA, 15 bp, Homo sapiens
ggcagcaagagcgaa

SEQ ID NO: 11292 - DNA, 15 bp, Homo sapiens
gggcagcaagagcga

SEQ ID NO: 11293 - DNA, 15 bp, Homo sapiens
tgggcagcaagagcg

SEQ ID NO: 11294 - DNA, 15 bp, Homo sapiens
ctgggcagcaagagc

SEQ ID NO: 11295 - DNA, 15 bp, Homo sapiens
cctgggcagcaagag

SEQ ID NO: 11296 - DNA, 15 bp, Homo sapiens
gcctgggcagcaaga

SEQ ID NO: 11297 - DNA, 15 bp, Homo sapiens
agcctgggcagcaag

SEQ ID NO: 11298 - DNA, 15 bp, Homo sapiens
cagcctgggcagcaa

SEQ ID NO: 11299 - DNA, 15 bp, Homo sapiens
ccagcctgggcagca

SEQ ID NO: 11300 - DNA, 15 bp, Homo sapiens
tccagcctgggcagc

SEQ ID NO: 11301 - DNA, 15 bp, Homo sapiens
ctccagcctgggcag

SEQ ID NO: 11302 - DNA, 15 bp, Homo sapiens
tgccattgcactcca

SEQ ID NO: 11303 - DNA, 15 bp, Homo sapiens
atgccattgcactcc

SEQ ID NO: 11304 - DNA, 15 bp, Homo sapiens
catgccattgcactc

SEQ ID NO: 11305 - DNA, 15 bp, Homo sapiens
gcatgccattgcact

SEQ ID NO: 11306 - DNA, 15 bp, Homo sapiens
tgcatgccattgcac

SEQ ID NO: 11307 - DNA, 15 bp, Homo sapiens
ctgcatgccattgca

SEQ ID NO: 11308 - DNA, 15 bp, Homo sapiens
actgcatgccattgc

SEQ ID NO: 11309 - DNA, 15 bp, Homo sapiens
tactgcatgccattg

SEQ ID NO: 11310 - DNA, 15 bp, Homo sapiens
gtactgcatgccatt

SEQ ID NO: 11311 - DNA, 15 bp, Homo sapiens
tgtactgcatgccat

SEQ ID NO: 11312 - DNA, 15 bp, Homo sapiens
gtgtactgcatgcca

SEQ ID NO: 11313 - DNA, 15 bp, Homo sapiens
agtgtactgcatgcc

SEQ ID NO: 11314 - DNA, 15 bp, Homo sapiens
gagtgtactgcatgc

SEQ ID NO: 11315 - DNA, 15 bp, Homo sapiens
tgagtgtactgcatg

SEQ ID NO: 11316 - DNA, 15 bp, Homo sapiens
gtgagtgtactgcat

SEQ ID NO: 11317 - DNA, 15 bp, Homo sapiens
cgtgagtgtactgca

SEQ ID NO: 11318 - DNA, 15 bp, Homo sapiens
ccgtgagtgtactgc

SEQ ID NO: 11319 - DNA, 15 bp, Homo sapiens
gccgtgagtgtactg

SEQ ID NO: 11320 - DNA, 15 bp, Homo sapiens
agccgtgagtgtact

SEQ ID NO: 11321 - DNA, 15 bp, Homo sapiens
gagccgtgagtgtac

SEQ ID NO: 11322 - DNA, 15 bp, Homo sapiens
tgagccgtgagtgta

SEQ ID NO: 11323 - DNA, 15 bp, Homo sapiens
gtgagccgtgagtgt

SEQ ID NO: 11324 - DNA, 15 bp, Homo sapiens
agtgagccgtgagtg

SEQ ID NO: 11325 - DNA, 15 bp, Homo sapiens
cagtgagccgtgagt

SEQ ID NO: 11326 - DNA, 15 bp, Homo sapiens
gcagtgagccgtgag

SEQ ID NO: 11327 - DNA, 15 bp, Homo sapiens
tgcagtgagccgtga

SEQ ID NO: 11328 - DNA, 15 bp, Homo sapiens
ttgcagtgagccgtg

SEQ ID NO: 11329 - DNA, 15 bp, Homo sapiens
gttgcagtgagccgt

SEQ ID NO: 11330 - DNA, 15 bp, Homo sapiens
ggggaggcaaaggtt

SEQ ID NO: 11331 - DNA, 15 bp, Homo sapiens
tggggaggcaaaggt

SEQ ID NO: 11332 - DNA, 15 bp, Homo sapiens
ctggggaggcaaagg

SEQ ID NO: 11333 - DNA, 15 bp, Homo sapiens
cctggggaggcaaag

SEQ ID NO: 11334 - DNA, 15 bp, Homo sapiens
acctggggaggcaaa

SEQ ID NO: 11335 - DNA, 15 bp, Homo sapiens
aacctggggaggcaa

SEQ ID NO: 11336 - DNA, 15 bp, Homo sapiens
gaacctggggaggca

SEQ ID NO: 11337 - DNA, 15 bp, Homo sapiens
tgaacctggggaggc

SEQ ID NO: 11338 - DNA, 15 bp, Homo sapiens
ttgaacctggggagg

SEQ ID NO: 11339 - DNA, 15 bp, Homo sapiens
cttgaacctggggag

SEQ ID NO: 11340 - DNA, 15 bp, Homo sapiens
acttgaacctgggga

SEQ ID NO: 11341 - DNA, 15 bp, Homo sapiens
cacttgaacctgggg

SEQ ID NO: 11342 - DNA, 15 bp, Homo sapiens
tcacttgaacctggg

SEQ ID NO: 11343 - DNA, 15 bp, Homo sapiens
atcacttgaacctgg

SEQ ID NO: 11344 - DNA, 15 bp, Homo sapiens
aatcacttgaacctg

SEQ ID NO: 11345 - DNA, 15 bp, Homo sapiens
gaatcacttgaacct

SEQ ID NO: 11346 - DNA, 15 bp, Homo sapiens
agagaatcacttgaa

SEQ ID NO: 11347 - DNA, 15 bp, Homo sapiens
aagagaatcacttga

SEQ ID NO: 11348 - DNA, 15 bp, Homo sapiens
aggaggctgaggcaa

SEQ ID NO: 11349 - DNA, 15 bp, Homo sapiens
taggtgcctgtaatc

SEQ ID NO: 11350 - DNA, 15 bp, Homo sapiens
gtaggtgcctgtaat

SEQ ID NO: 11351 - DNA, 15 bp, Homo sapiens
ggtaggtgcctgtaa

SEQ ID NO: 11352 - DNA, 15 bp, Homo sapiens
tggtaggtgcctgta

SEQ ID NO: 11353 - DNA, 15 bp, Homo sapiens
gtggtaggtgcctgt

SEQ ID NO: 11354 - DNA, 15 bp, Homo sapiens
ggtggtaggtgcctg

SEQ ID NO: 11355 - DNA, 15 bp, Homo sapiens
tggtggtaggtgcct

SEQ ID NO: 11356 - DNA, 15 bp, Homo sapiens
atggtggtaggtgcc

SEQ ID NO: 11357 - DNA, 15 bp, Homo sapiens
catggtggtaggtgc

SEQ ID NO: 11358 - DNA, 15 bp, Homo sapiens
acatggtggtaggtg

SEQ ID NO: 11359 - DNA, 15 bp, Homo sapiens
gacatggtggtaggt

SEQ ID NO: 11360 - DNA, 15 bp, Homo sapiens
ggacatggtggtagg

SEQ ID NO: 11361 - DNA, 15 bp, Homo sapiens
tggacatggtggtag

SEQ ID NO: 11362 - DNA, 15 bp, Homo sapiens
ctggacatggtggta

SEQ ID NO: 11363 - DNA, 15 bp, Homo sapiens
gctggacatggtggt

SEQ ID NO: 11364 - DNA, 15 bp, Homo sapiens
agctggacatggtgg

SEQ ID NO: 11365 - DNA, 15 bp, Homo sapiens
tagctggacatggtg

SEQ ID NO: 11366 - DNA, 15 bp, Homo sapiens
ttagctggacatggt

SEQ ID NO: 11367 - DNA, 15 bp, Homo sapiens
attagctggacatgg

SEQ ID NO: 11368 - DNA, 15 bp, Homo sapiens
aattagctggacatg

SEQ ID NO: 11369 - DNA, 15 bp, Homo sapiens
aaattagctggacat

SEQ ID NO: 11370 - DNA, 15 bp, Homo sapiens
aaaattagctggaca

SEQ ID NO: 11371 - DNA, 15 bp, Homo sapiens
aaaaattagctggac

SEQ ID NO: 11372 - DNA, 15 bp, Homo sapiens
aaaaaattagctgga

SEQ ID NO: 11373 - DNA, 15 bp, Homo sapiens
caaaaaattagctgg

SEQ ID NO: 11374 - DNA, 15 bp, Homo sapiens
acaaaaaattagctg

SEQ ID NO: 11375 - DNA, 15 bp, Homo sapiens
tacaaaaaattagct

SEQ ID NO: 11376 - DNA, 15 bp, Homo sapiens
cgaaaccccatctct

SEQ ID NO: 11377 - DNA, 15 bp, Homo sapiens
gcgaaaccccatctc

SEQ ID NO: 11378 - DNA, 15 bp, Homo sapiens
ggcgaaaccccatct

SEQ ID NO: 11379 - DNA, 15 bp, Homo sapiens
tggcgaaaccccatc

SEQ ID NO: 11380 - DNA, 15 bp, Homo sapiens
atggcgaaaccccat

SEQ ID NO: 11381 - DNA, 15 bp, Homo sapiens
catggcgaaacccca

SEQ ID NO: 11382 - DNA, 15 bp, Homo sapiens
aacatggcgaaaccc

SEQ ID NO: 11383 - DNA, 15 bp, Homo sapiens
caacatggcgaaacc

SEQ ID NO: 11384 - DNA, 15 bp, Homo sapiens
ccaacatggcgaaac

SEQ ID NO: 11385 - DNA, 15 bp, Homo sapiens
cccaacatggcgaaa

SEQ ID NO: 11386 - DNA, 15 bp, Homo sapiens
gcccaacatggcgaa

SEQ ID NO: 11387 - DNA, 15 bp, Homo sapiens
tgcccaacatggcga

SEQ ID NO: 11388 - DNA, 15 bp, Homo sapiens
ctgcccaacatggcg

SEQ ID NO: 11389 - DNA, 15 bp, Homo sapiens
cctgcccaacatggc

SEQ ID NO: 11390 - DNA, 15 bp, Homo sapiens
acctgcccaacatgg

SEQ ID NO: 11391 - DNA, 15 bp, Homo sapiens
aacctgcccaacatg

SEQ ID NO: 11392 - DNA, 15 bp, Homo sapiens
caacctgcccaacat

SEQ ID NO: 11393 - DNA, 15 bp, Homo sapiens
ccaacctgcccaaca

SEQ ID NO: 11394 - DNA, 15 bp, Homo sapiens
accaacctgcccaac

SEQ ID NO: 11395 - DNA, 15 bp, Homo sapiens
gaccaacctgcccaa

SEQ ID NO: 11396 - DNA, 15 bp, Homo sapiens
agaccaacctgccca

SEQ ID NO: 11397 - DNA, 15 bp, Homo sapiens
cagaccaacctgccc

SEQ ID NO: 11398 - DNA, 15 bp, Homo sapiens
ccagaccaacctgcc

SEQ ID NO: 11399 - DNA, 15 bp, Homo sapiens
tccagaccaacctgc

SEQ ID NO: 11400 - DNA, 15 bp, Homo sapiens
ttccagaccaacctg

SEQ ID NO: 11401 - DNA, 15 bp, Homo sapiens
gttccagaccaacct

SEQ ID NO: 11402 - DNA, 15 bp, Homo sapiens
agttccagaccaacc

SEQ ID NO: 11403 - DNA, 15 bp, Homo sapiens
gagttccagaccaac

SEQ ID NO: 11404 - DNA, 15 bp, Homo sapiens
agagttccagaccaa

SEQ ID NO: 11405 - DNA, 15 bp, Homo sapiens
aagagttccagacca

SEQ ID NO: 11406 - DNA, 15 bp, Homo sapiens
caagagttccagacc

SEQ ID NO: 11407 - DNA, 15 bp, Homo sapiens
tcaagagttccagac

SEQ ID NO: 11408 - DNA, 15 bp, Homo sapiens
gtcaagagttccaga

SEQ ID NO: 11409 - DNA, 15 bp, Homo sapiens
ggtcaagagttccag

SEQ ID NO: 11410 - DNA, 15 bp, Homo sapiens
aggtcaagagttcca

SEQ ID NO: 11411 - DNA, 15 bp, Homo sapiens
gaggtcaagagttcc

SEQ ID NO: 11412 - DNA, 15 bp, Homo sapiens
ctgaggtcaagagtt

SEQ ID NO: 11413 - DNA, 15 bp, Homo sapiens
cctgaggtcaagagt

SEQ ID NO: 11414 - DNA, 15 bp, Homo sapiens
acctgaggtcaagag

SEQ ID NO: 11415 - DNA, 15 bp, Homo sapiens
cacctgaggtcaaga

SEQ ID NO: 11416 - DNA, 15 bp, Homo sapiens
tcacctgaggtcaag

SEQ ID NO: 11417 - DNA, 15 bp, Homo sapiens
atcacctgaggtcaa

SEQ ID NO: 11418 - DNA, 15 bp, Homo sapiens
cgatcacctgaggtc

SEQ ID NO: 11419 - DNA, 15 bp, Homo sapiens
gcgatcacctgaggt

SEQ ID NO: 11420 - DNA, 15 bp, Homo sapiens
ggcgatcacctgagg

SEQ ID NO: 11421 - DNA, 15 bp, Homo sapiens
aggcgatcacctgag

SEQ ID NO: 11422 - DNA, 15 bp, Homo sapiens
caggcgatcacctga

SEQ ID NO: 11423 - DNA, 15 bp, Homo sapiens
gcaggcgatcacctg

SEQ ID NO: 11424 - DNA, 15 bp, Homo sapiens
ggcaggcgatcacct

SEQ ID NO: 11425 - DNA, 15 bp, Homo sapiens
aggcaggcgatcacc

SEQ ID NO: 11426 - DNA, 15 bp, Homo sapiens
aaggcaggcgatcac

SEQ ID NO: 11427 - DNA, 15 bp, Homo sapiens
caaggcaggcgatca

SEQ ID NO: 11428 - DNA, 15 bp, Homo sapiens
ccaaggcaggcgatc

SEQ ID NO: 11429 - DNA, 15 bp, Homo sapiens
gccaaggcaggcgat

SEQ ID NO: 11430 - DNA, 15 bp, Homo sapiens
ggccaaggcaggcga

SEQ ID NO: 11431 - DNA, 15 bp, Homo sapiens
aggccaaggcaggcg

SEQ ID NO: 11432 - DNA, 15 bp, Homo sapiens
ggcctgtaatcccag

SEQ ID NO: 11433 - DNA, 15 bp, Homo sapiens
aggcctgtaatccca

SEQ ID NO: 11434 - DNA, 15 bp, Homo sapiens
caggcctgtaatccc

SEQ ID NO: 11435 - DNA, 15 bp, Homo sapiens
tcaggcctgtaatcc

SEQ ID NO: 11436 - DNA, 15 bp, Homo sapiens
ctcaggcctgtaatc

SEQ ID NO: 11437 - DNA, 15 bp, Homo sapiens
gctcaggcctgtaat

SEQ ID NO: 11438 - DNA, 15 bp, Homo sapiens
ggctcaggcctgtaa

SEQ ID NO: 11439 - DNA, 15 bp, Homo sapiens
tggctcaggcctgta

SEQ ID NO: 11440 - DNA, 15 bp, Homo sapiens
gtggctcaggcctgt

SEQ ID NO: 11441 - DNA, 15 bp, Homo sapiens
ggtggctcaggcctg

SEQ ID NO: 11442 - DNA, 15 bp, Homo sapiens
tggtggctcaggcct

SEQ ID NO: 11443 - DNA, 15 bp, Homo sapiens
atggtggctcaggcc

SEQ ID NO: 11444 - DNA, 15 bp, Homo sapiens
catggtggctcaggc

SEQ ID NO: 11445 - DNA, 15 bp, Homo sapiens
gcatggtggctcagg

SEQ ID NO: 11446 - DNA, 15 bp, Homo sapiens
agcatggtggctcag

SEQ ID NO: 11447 - DNA, 15 bp, Homo sapiens
gagcatggtggctca

SEQ ID NO: 11448 - DNA, 15 bp, Homo sapiens
cgagcatggtggctc

SEQ ID NO: 11449 - DNA, 15 bp, Homo sapiens
ccgagcatggtggct

SEQ ID NO: 11450 - DNA, 15 bp, Homo sapiens
gccgagcatggtggc

SEQ ID NO: 11451 - DNA, 15 bp, Homo sapiens
ggccgagcatggtgg

SEQ ID NO: 11452 - DNA, 15 bp, Homo sapiens
tggccgagcatggtg

SEQ ID NO: 11453 - DNA, 15 bp, Homo sapiens
ctggccgagcatggt

SEQ ID NO: 11454 - DNA, 15 bp, Homo sapiens
actggccgagcatgg

SEQ ID NO: 11455 - DNA, 15 bp, Homo sapiens
cactggccgagcatg

SEQ ID NO: 11456 - DNA, 15 bp, Homo sapiens
gcactggccgagcat

SEQ ID NO: 11457 - DNA, 15 bp, Homo sapiens
agcactggccgagca

SEQ ID NO: 11458 - DNA, 15 bp, Homo sapiens
tagcactggccgagc

SEQ ID NO: 11459 - DNA, 15 bp, Homo sapiens
ctagcactggccgag

SEQ ID NO: 11460 - DNA, 15 bp, Homo sapiens
gctagcactggccga

SEQ ID NO: 11461 - DNA, 15 bp, Homo sapiens
ggctagcactggccg

SEQ ID NO: 11462 - DNA, 15 bp, Homo sapiens
tggctagcactggcc

SEQ ID NO: 11463 - DNA, 15 bp, Homo sapiens
gtggctagcactggc

SEQ ID NO: 11464 - DNA, 15 bp, Homo sapiens
agtggctagcactgg

SEQ ID NO: 11465 - DNA, 15 bp, Homo sapiens
aagtggctagcactg

SEQ ID NO: 11466 - DNA, 15 bp, Homo sapiens
taaaaagtggctagc

SEQ ID NO: 11467 - DNA, 15 bp, Homo sapiens
ttaaaaagtggctag

SEQ ID NO: 11468 - DNA, 15 bp, Homo sapiens
tttaaaaagtggcta

SEQ ID NO: 11469 - DNA, 15 bp, Homo sapiens
ttttaaaaagtggct

SEQ ID NO: 11470 - DNA, 15 bp, Homo sapiens
tttttaaaaagtggc

SEQ ID NO: 11471 - DNA, 15 bp, Homo sapiens
ttttttaaaaagtgg

SEQ ID NO: 11472 - DNA, 15 bp, Homo sapiens
cttttttaaaaagtg

SEQ ID NO: 11473 - DNA, 15 bp, Homo sapiens
acttttttaaaaagt

SEQ ID NO: 11474 - DNA, 15 bp, Homo sapiens
cacttttttaaaaag

SEQ ID NO: 11475 - DNA, 15 bp, Homo sapiens
tcacttttttaaaaa

SEQ ID NO: 11476 - DNA, 15 bp, Homo sapiens
gtcacttttttaaaa

SEQ ID NO: 11477 - DNA, 15 bp, Homo sapiens
tgtcacttttttaaa

SEQ ID NO: 11478 - DNA, 15 bp, Homo sapiens
atgtcacttttttaa

SEQ ID NO: 11479 - DNA, 15 bp, Homo sapiens
aatgtcactttttta

SEQ ID NO: 11480 - DNA, 15 bp, Homo sapiens
taatgtcactttttt

SEQ ID NO: 11481 - DNA, 15 bp, Homo sapiens
ttaatgtcacttttt

SEQ ID NO: 11482 - DNA, 15 bp, Homo sapiens
cttaatgtcactttt

SEQ ID NO: 11483 - DNA, 15 bp, Homo sapiens
gcttaatgtcacttt

SEQ ID NO: 11484 - DNA, 15 bp, Homo sapiens
ggcttaatgtcactt

SEQ ID NO: 11485 - DNA, 15 bp, Homo sapiens
aggcttaatgtcact

SEQ ID NO: 11486 - DNA, 15 bp, Homo sapiens
taggcttaatgtcac

SEQ ID NO: 11487 - DNA, 15 bp, Homo sapiens
ttaggcttaatgtca

SEQ ID NO: 11488 - DNA, 15 bp, Homo sapiens
tttaggcttaatgtc

SEQ ID NO: 11489 - DNA, 15 bp, Homo sapiens
ttttaggcttaatgt

SEQ ID NO: 11490 - DNA, 15 bp, Homo sapiens
tttttaggcttaatg

SEQ ID NO: 11491 - DNA, 15 bp, Homo sapiens
ctttttaggcttaat

SEQ ID NO: 11492 - DNA, 15 bp, Homo sapiens
tctttttaggcttaa

SEQ ID NO: 11493 - DNA, 15 bp, Homo sapiens
gtctttttaggctta

SEQ ID NO: 11494 - DNA, 15 bp, Homo sapiens
tgtctttttaggctt

SEQ ID NO: 11495 - DNA, 15 bp, Homo sapiens
gtgtctttttaggct

SEQ ID NO: 11496 - DNA, 15 bp, Homo sapiens
tgtgtctttttaggc

SEQ ID NO: 11497 - DNA, 15 bp, Homo sapiens
atgtgtctttttagg

SEQ ID NO: 11498 - DNA, 15 bp, Homo sapiens
aatgtgtctttttag

SEQ ID NO: 11499 - DNA, 15 bp, Homo sapiens
gaatgtgtcttttta

SEQ ID NO: 11500 - DNA, 15 bp, Homo sapiens
agaatgtgtcttttt

SEQ ID NO: 11501 - DNA, 15 bp, Homo sapiens
tagaatgtgtctttt

SEQ ID NO: 11502 - DNA, 15 bp, Homo sapiens
ttagaatgtgtcttt

SEQ ID NO: 11503 - DNA, 15 bp, Homo sapiens
gttagaatgtgtctt

SEQ ID NO: 11504 - DNA, 15 bp, Homo sapiens
cgttagaatgtgtct

SEQ ID NO: 11505 - DNA, 15 bp, Homo sapiens
acgttagaatgtgtc

SEQ ID NO: 11506 - DNA, 15 bp, Homo sapiens
cacgttagaatgtgt

SEQ ID NO: 11507 - DNA, 15 bp, Homo sapiens
gcacgttagaatgtg

SEQ ID NO: 11508 - DNA, 15 bp, Homo sapiens
ggcacgttagaatgt

SEQ ID NO: 11509 - DNA, 15 bp, Homo sapiens
tggcacgttagaatg

SEQ ID NO: 11510 - DNA, 15 bp, Homo sapiens
atggcacgttagaat

SEQ ID NO: 11511 - DNA, 15 bp, Homo sapiens
aatggcacgttagaa

SEQ ID NO: 11512 - DNA, 15 bp, Homo sapiens
aaatggcacgttaga

SEQ ID NO: 11513 - DNA, 15 bp, Homo sapiens
gaaatggcacgttag

SEQ ID NO: 11514 - DNA, 15 bp, Homo sapiens
agaaatggcacgtta

SEQ ID NO: 11515 - DNA, 15 bp, Homo sapiens
gagaaatggcacgtt

SEQ ID NO: 11516 - DNA, 15 bp, Homo sapiens
agagaaatggcacgt

SEQ ID NO: 11517 - DNA, 15 bp, Homo sapiens
aagagaaatggcacg

SEQ ID NO: 11518 - DNA, 15 bp, Homo sapiens
gaagagaaatggcac

SEQ ID NO: 11519 - DNA, 15 bp, Homo sapiens
agaagagaaatggca

SEQ ID NO: 11520 - DNA, 15 bp, Homo sapiens
tagaagagaaatggc

SEQ ID NO: 11521 - DNA, 15 bp, Homo sapiens
ctagaagagaaatgg

SEQ ID NO: 11522 - DNA, 15 bp, Homo sapiens
cctagaagagaaatg

SEQ ID NO: 11523 - DNA, 15 bp, Homo sapiens
acctagaagagaaat

SEQ ID NO: 11524 - DNA, 15 bp, Homo sapiens
aacctagaagagaaa

SEQ ID NO: 11525 - DNA, 15 bp, Homo sapiens
aaacctagaagagaa

SEQ ID NO: 11526 - DNA, 15 bp, Homo sapiens
aaaacctagaagaga

SEQ ID NO: 11527 - DNA, 15 bp, Homo sapiens
caaaacctagaagag

SEQ ID NO: 11528 - DNA, 15 bp, Homo sapiens
ccaaaacctagaaga

SEQ ID NO: 11529 - DNA, 15 bp, Homo sapiens
gccaaaacctagaag

SEQ ID NO: 11530 - DNA, 15 bp, Homo sapiens
agccaaaacctagaa

SEQ ID NO: 11531 - DNA, 15 bp, Homo sapiens
aagccaaaacctaga

SEQ ID NO: 11532 - DNA, 15 bp, Homo sapiens
caagccaaaacctag

SEQ ID NO: 11533 - DNA, 15 bp, Homo sapiens
ccaagccaaaaccta

SEQ ID NO: 11534 - DNA, 15 bp, Homo sapiens
accaagccaaaacct

SEQ ID NO: 11535 - DNA, 15 bp, Homo sapiens
aaccaagccaaaacc

SEQ ID NO: 11536 - DNA, 15 bp, Homo sapiens
aaaccaagccaaaac

SEQ ID NO: 11537 - DNA, 15 bp, Homo sapiens
caaaccaagccaaaa

SEQ ID NO: 11538 - DNA, 15 bp, Homo sapiens
tcaaaccaagccaaa

SEQ ID NO: 11539 - DNA, 15 bp, Homo sapiens
ttcaaaccaagccaa

SEQ ID NO: 11540 - DNA, 15 bp, Homo sapiens
cttcaaaccaagcca

SEQ ID NO: 11541 - DNA, 15 bp, Homo sapiens
tcttcaaaccaagcc

SEQ ID NO: 11542 - DNA, 15 bp, Homo sapiens
ttcttcaaaccaagc

SEQ ID NO: 11543 - DNA, 15 bp, Homo sapiens
cttcttcaaaccaag

SEQ ID NO: 11544 - DNA, 15 bp, Homo sapiens
ccttcttcaaaccaa

SEQ ID NO: 11545 - DNA, 15 bp, Homo sapiens
accttcttcaaacca

SEQ ID NO: 11546 - DNA, 15 bp, Homo sapiens
caccttcttcaaacc

SEQ ID NO: 11547 - DNA, 15 bp, Homo sapiens
tcaccttcttcaaac

SEQ ID NO: 11548 - DNA, 15 bp, Homo sapiens
ttcaccttcttcaaa

SEQ ID NO: 11549 - DNA, 15 bp, Homo sapiens
cttcaccttcttcaa

SEQ ID NO: 11550 - DNA, 15 bp, Homo sapiens
tcttcaccttcttca

SEQ ID NO: 11551 - DNA, 15 bp, Homo sapiens
ttcttcaccttcttc

SEQ ID NO: 11552 - DNA, 15 bp, Homo sapiens
tttcttcaccttctt

SEQ ID NO: 11553 - DNA, 15 bp, Homo sapiens
gtttcttcaccttct

SEQ ID NO: 11554 - DNA, 15 bp, Homo sapiens
tgtttcttcaccttc

SEQ ID NO: 11555 - DNA, 15 bp, Homo sapiens
ttgtttcttcacctt

SEQ ID NO: 11556 - DNA, 15 bp, Homo sapiens
attgtttcttcacct

SEQ ID NO: 11557 - DNA, 15 bp, Homo sapiens
aattgtttcttcacc

SEQ ID NO: 11558 - DNA, 15 bp, Homo sapiens
taattgtttcttcac

SEQ ID NO: 11559 - DNA, 15 bp, Homo sapiens
gtaattgtttcttca

SEQ ID NO: 11560 - DNA, 15 bp, Homo sapiens
tgtaattgtttcttc

SEQ ID NO: 11561 - DNA, 15 bp, Homo sapiens
ctgtaattgtttctt

SEQ ID NO: 11562 - DNA, 15 bp, Homo sapiens
gctgtaattgtttct

SEQ ID NO: 11563 - DNA, 15 bp, Homo sapiens
ggctgtaattgtttc

SEQ ID NO: 11564 - DNA, 15 bp, Homo sapiens
aggctgtaattgttt

SEQ ID NO: 11565 - DNA, 15 bp, Homo sapiens
aaggctgtaattgtt

SEQ ID NO: 11566 - DNA, 15 bp, Homo sapiens
aaaggctgtaattgt

SEQ ID NO: 11567 - DNA, 15 bp, Homo sapiens
caaaggctgtaattg

SEQ ID NO: 11568 - DNA, 15 bp, Homo sapiens
acaaaggctgtaatt

SEQ ID NO: 11569 - DNA, 15 bp, Homo sapiens
tacaaaggctgtaat

SEQ ID NO: 11570 - DNA, 15 bp, Homo sapiens
ctacaaaggctgtaa

SEQ ID NO: 11571 - DNA, 15 bp, Homo sapiens
tctacaaaggctgta

SEQ ID NO: 11572 - DNA, 15 bp, Homo sapiens
ttctacaaaggctgt

SEQ ID NO: 11573 - DNA, 15 bp, Homo sapiens
gttctacaaaggctg

SEQ ID NO: 11574 - DNA, 15 bp, Homo sapiens
ggttctacaaaggct

SEQ ID NO: 11575 - DNA, 15 bp, Homo sapiens
aggttctacaaaggc

SEQ ID NO: 11576 - DNA, 15 bp, Homo sapiens
aaggttctacaaagg

SEQ ID NO: 11577 - DNA, 15 bp, Homo sapiens
aaaggttctacaaag

SEQ ID NO: 11578 - DNA, 15 bp, Homo sapiens
aaaaggttctacaaa

SEQ ID NO: 11579 - DNA, 15 bp, Homo sapiens
caaaaggttctacaa

SEQ ID NO: 11580 - DNA, 15 bp, Homo sapiens
acaaaaggttctaca

SEQ ID NO: 11581 - DNA, 15 bp, Homo sapiens
tacaaaaggttctac

SEQ ID NO: 11582 - DNA, 15 bp, Homo sapiens
ttacaaaaggttcta

SEQ ID NO: 11583 - DNA, 15 bp, Homo sapiens
attacaaaaggttct

SEQ ID NO: 11584 - DNA, 15 bp, Homo sapiens
aattacaaaaggttc

SEQ ID NO: 11585 - DNA, 15 bp, Homo sapiens
aaattacaaaaggtt

SEQ ID NO: 11586 - DNA, 15 bp, Homo sapiens
aaaattacaaaaggt

SEQ ID NO: 11587 - DNA, 15 bp, Homo sapiens
taaaattacaaaagg

SEQ ID NO: 11588 - DNA, 15 bp, Homo sapiens
gtaaaattacaaaag

SEQ ID NO: 11589 - DNA, 15 bp, Homo sapiens
agtaaaattacaaaa

SEQ ID NO: 11590 - DNA, 15 bp, Homo sapiens
gagtaaaattacaaa

SEQ ID NO: 11591 - DNA, 15 bp, Homo sapiens
tgagtaaaattacaa

SEQ ID NO: 11592 - DNA, 15 bp, Homo sapiens
atgagtaaaattaca

SEQ ID NO: 11593 - DNA, 15 bp, Homo sapiens
tatgagtaaaattac

SEQ ID NO: 11594 - DNA, 15 bp, Homo sapiens
atatgagtaaaatta

SEQ ID NO: 11595 - DNA, 15 bp, Homo sapiens
aatatgagtaaaatt

SEQ ID NO: 11596 - DNA, 15 bp, Homo sapiens
taatatgagtaaaat

SEQ ID NO: 11597 - DNA, 15 bp, Homo sapiens
ctaatatgagtaaaa

SEQ ID NO: 11598 - DNA, 15 bp, Homo sapiens
actaatatgagtaaa

SEQ ID NO: 11599 - DNA, 15 bp, Homo sapiens
tactaatatgagtaa

SEQ ID NO: 11600 - DNA, 15 bp, Homo sapiens
ctactaatatgagta

SEQ ID NO: 11601 - DNA, 15 bp, Homo sapiens
gctactaatatgagt

SEQ ID NO: 11602 - DNA, 15 bp, Homo sapiens
ggctactaatatgag

SEQ ID NO: 11603 - DNA, 15 bp, Homo sapiens
tggctactaatatga

SEQ ID NO: 11604 - DNA, 15 bp, Homo sapiens
ttggctactaatatg

SEQ ID NO: 11605 - DNA, 15 bp, Homo sapiens
attggctactaatat

SEQ ID NO: 11606 - DNA, 15 bp, Homo sapiens
cattggctactaata

SEQ ID NO: 11607 - DNA, 15 bp, Homo sapiens
gcattggctactaat

SEQ ID NO: 11608 - DNA, 15 bp, Homo sapiens
tgcattggctactaa

SEQ ID NO: 11609 - DNA, 15 bp, Homo sapiens
ttgcattggctacta

SEQ ID NO: 11610 - DNA, 15 bp, Homo sapiens
attgcattggctact

SEQ ID NO: 11611 - DNA, 15 bp, Homo sapiens
aattgcattggctac

SEQ ID NO: 11612 - DNA, 15 bp, Homo sapiens
caattgcattggcta

SEQ ID NO: 11613 - DNA, 15 bp, Homo sapiens
acaattgcattggct

SEQ ID NO: 11614 - DNA, 15 bp, Homo sapiens
cacaattgcattggc

SEQ ID NO: 11615 - DNA, 15 bp, Homo sapiens
ccacaattgcattgg

SEQ ID NO: 11616 - DNA, 15 bp, Homo sapiens
cccacaattgcattg

SEQ ID NO: 11617 - DNA, 15 bp, Homo sapiens
acccacaattgcatt

SEQ ID NO: 11618 - DNA, 15 bp, Homo sapiens
cacccacaattgcat

SEQ ID NO: 11619 - DNA, 15 bp, Homo sapiens
acacccacaattgca

SEQ ID NO: 11620 - DNA, 15 bp, Homo sapiens
tacacccacaattgc

SEQ ID NO: 11621 - DNA, 15 bp, Homo sapiens
atacacccacaattg

SEQ ID NO: 11622 - DNA, 15 bp, Homo sapiens
catacacccacaatt

SEQ ID NO: 11623 - DNA, 15 bp, Homo sapiens
ccatacacccacaat

SEQ ID NO: 11624 - DNA, 15 bp, Homo sapiens
gccatacacccacaa

SEQ ID NO: 11625 - DNA, 15 bp, Homo sapiens
tgccatacacccaca

SEQ ID NO: 11626 - DNA, 15 bp, Homo sapiens
ctgccatacacccac

SEQ ID NO: 11627 - DNA, 15 bp, Homo sapiens
cctgccatacaccca

SEQ ID NO: 11628 - DNA, 15 bp, Homo sapiens
acctgccatacaccc

SEQ ID NO: 11629 - DNA, 15 bp, Homo sapiens
tacctgccatacacc

SEQ ID NO: 11630 - DNA, 15 bp, Homo sapiens
ttacctgccatacac

SEQ ID NO: 11631 - DNA, 15 bp, Homo sapiens
cttacctgccataca

SEQ ID NO: 11632 - DNA, 15 bp, Homo sapiens
gcttacctgccatac

SEQ ID NO: 11633 - DNA, 15 bp, Homo sapiens
tgcttacctgccata

SEQ ID NO: 11634 - DNA, 15 bp, Homo sapiens
ttgcttacctgccat

SEQ ID NO: 11635 - DNA, 15 bp, Homo sapiens
tttgcttacctgcca

SEQ ID NO: 11636 - DNA, 15 bp, Homo sapiens
ttttgcttacctgcc

SEQ ID NO: 11637 - DNA, 15 bp, Homo sapiens
tttttgcttacctgc

SEQ ID NO: 11638 - DNA, 15 bp, Homo sapiens
atttttgcttacctg

SEQ ID NO: 11639 - DNA, 15 bp, Homo sapiens
aatttttgcttacct

SEQ ID NO: 11640 - DNA, 15 bp, Homo sapiens
gaatttttgcttacc

SEQ ID NO: 11641 - DNA, 15 bp, Homo sapiens
ggaatttttgcttac

SEQ ID NO: 11642 - DNA, 15 bp, Homo sapiens
aggaatttttgctta

SEQ ID NO: 11643 - DNA, 15 bp, Homo sapiens
caggaatttttgctt

SEQ ID NO: 11644 - DNA, 15 bp, Homo sapiens
acaggaatttttgct

SEQ ID NO: 11645 - DNA, 15 bp, Homo sapiens
tacaggaatttttgc

SEQ ID NO: 11646 - DNA, 15 bp, Homo sapiens
gtacaggaatttttg

SEQ ID NO: 11647 - DNA, 15 bp, Homo sapiens
agtacaggaattttt

SEQ ID NO: 11648 - DNA, 15 bp, Homo sapiens
cagtacaggaatttt

SEQ ID NO: 11649 - DNA, 15 bp, Homo sapiens
gcagtacaggaattt

SEQ ID NO: 11650 - DNA, 15 bp, Homo sapiens
tgcagtacaggaatt

SEQ ID NO: 11651 - DNA, 15 bp, Homo sapiens
ttgcagtacaggaat

SEQ ID NO: 11652 - DNA, 15 bp, Homo sapiens
tttgcagtacaggaa

SEQ ID NO: 11653 - DNA, 15 bp, Homo sapiens
ttttgcagtacagga

SEQ ID NO: 11654 - DNA, 15 bp, Homo sapiens
attttgcagtacagg

SEQ ID NO: 11655 - DNA, 15 bp, Homo sapiens
aattttgcagtacag

SEQ ID NO: 11656 - DNA, 15 bp, Homo sapiens
aaattttgcagtaca

SEQ ID NO: 11657 - DNA, 15 bp, Homo sapiens
gaaattttgcagtac

SEQ ID NO: 11658 - DNA, 15 bp, Homo sapiens
tgaaattttgcagta

SEQ ID NO: 11659 - DNA, 15 bp, Homo sapiens
ttgaaattttgcagt

SEQ ID NO: 11660 - DNA, 15 bp, Homo sapiens
attgaaattttgcag

SEQ ID NO: 11661 - DNA, 15 bp, Homo sapiens
tattgaaattttgca

SEQ ID NO: 11662 - DNA, 15 bp, Homo sapiens
ttattgaaattttgc

SEQ ID NO: 11663 - DNA, 15 bp, Homo sapiens
cttattgaaattttg

SEQ ID NO: 11664 - DNA, 15 bp, Homo sapiens
acttattgaaatttt

SEQ ID NO: 11665 - DNA, 15 bp, Homo sapiens
aacttattgaaattt

SEQ ID NO: 11666 - DNA, 15 bp, Homo sapiens
taacttattgaaatt

SEQ ID NO: 11667 - DNA, 15 bp, Homo sapiens
ataacttattgaaat

SEQ ID NO: 11668 - DNA, 15 bp, Homo sapiens
cataacttattgaaa

SEQ ID NO: 11669 - DNA, 15 bp, Homo sapiens
acataacttattgaa

SEQ ID NO: 11670 - DNA, 15 bp, Homo sapiens
tacataacttattga

SEQ ID NO: 11671 - DNA, 15 bp, Homo sapiens
ttacataacttattg

SEQ ID NO: 11672 - DNA, 15 bp, Homo sapiens
cttacataacttatt

SEQ ID NO: 11673 - DNA, 15 bp, Homo sapiens
acttacataacttat

SEQ ID NO: 11674 - DNA, 15 bp, Homo sapiens
cacttacataactta

SEQ ID NO: 11675 - DNA, 15 bp, Homo sapiens
tcacttacataactt

SEQ ID NO: 11676 - DNA, 15 bp, Homo sapiens
atcacttacataact

SEQ ID NO: 11677 - DNA, 15 bp, Homo sapiens
aatcacttacataac

SEQ ID NO: 11678 - DNA, 15 bp, Homo sapiens
taatcacttacataa

SEQ ID NO: 11679 - DNA, 15 bp, Homo sapiens
ctaatcacttacata

SEQ ID NO: 11680 - DNA, 15 bp, Homo sapiens
cctaatcacttacat

SEQ ID NO: 11681 - DNA, 15 bp, Homo sapiens
ccctaatcacttaca

SEQ ID NO: 11682 - DNA, 15 bp, Homo sapiens
gccctaatcacttac

SEQ ID NO: 11683 - DNA, 15 bp, Homo sapiens
agccctaatcactta

SEQ ID NO: 11684 - DNA, 15 bp, Homo sapiens
cagccctaatcactt

SEQ ID NO: 11685 - DNA, 15 bp, Homo sapiens
acagccctaatcact

SEQ ID NO: 11686 - DNA, 15 bp, Homo sapiens
tacagccctaatcac

SEQ ID NO: 11687 - DNA, 15 bp, Homo sapiens
atacagccctaatca

SEQ ID NO: 11688 - DNA, 15 bp, Homo sapiens
aatacagccctaatc

SEQ ID NO: 11689 - DNA, 15 bp, Homo sapiens
taatacagccctaat

SEQ ID NO: 11690 - DNA, 15 bp, Homo sapiens
ttaatacagccctaa

SEQ ID NO: 11691 - DNA, 15 bp, Homo sapiens
attaatacagcccta

SEQ ID NO: 11692 - DNA, 15 bp, Homo sapiens
gattaatacagccct

SEQ ID NO: 11693 - DNA, 15 bp, Homo sapiens
agattaatacagccc

SEQ ID NO: 11694 - DNA, 15 bp, Homo sapiens
aagattaatacagcc

SEQ ID NO: 11695 - DNA, 15 bp, Homo sapiens
aaagattaatacagc

SEQ ID NO: 11696 - DNA, 15 bp, Homo sapiens
gaaagattaatacag

SEQ ID NO: 11697 - DNA, 15 bp, Homo sapiens
agaaagattaataca

SEQ ID NO: 11698 - DNA, 15 bp, Homo sapiens
cagaaagattaatac

SEQ ID NO: 11699 - DNA, 15 bp, Homo sapiens
acagaaagattaata

SEQ ID NO: 11700 - DNA, 15 bp, Homo sapiens
aacagaaagattaat

SEQ ID NO: 11701 - DNA, 15 bp, Homo sapiens
taacagaaagattaa

SEQ ID NO: 11702 - DNA, 15 bp, Homo sapiens
ataacagaaagatta

SEQ ID NO: 11703 - DNA, 15 bp, Homo sapiens
gataacagaaagatt

SEQ ID NO: 11704 - DNA, 15 bp, Homo sapiens
agataacagaaagat

SEQ ID NO: 11705 - DNA, 15 bp, Homo sapiens
cagataacagaaaga

SEQ ID NO: 11706 - DNA, 15 bp, Homo sapiens
acagataacagaaag

SEQ ID NO: 11707 - DNA, 15 bp, Homo sapiens
aacagataacagaaa

SEQ ID NO: 11708 - DNA, 15 bp, Homo sapiens
aaacagataacagaa

SEQ ID NO: 11709 - DNA, 15 bp, Homo sapiens
aaaacagataacaga

SEQ ID NO: 11710 - DNA, 15 bp, Homo sapiens
aaaaacagataacag

SEQ ID NO: 11711 - DNA, 15 bp, Homo sapiens
gaaaaacagataaca

SEQ ID NO: 11712 - DNA, 15 bp, Homo sapiens
ggaaaaacagataac

SEQ ID NO: 11713 - DNA, 15 bp, Homo sapiens
aggaaaaacagataa

SEQ ID NO: 11714 - DNA, 15 bp, Homo sapiens
caggaaaaacagata

SEQ ID NO: 11715 - DNA, 15 bp, Homo sapiens
tcaggaaaaacagat

SEQ ID NO: 11716 - DNA, 15 bp, Homo sapiens
atcaggaaaaacaga

SEQ ID NO: 11717 - DNA, 15 bp, Homo sapiens
catcaggaaaaacag

SEQ ID NO: 11718 - DNA, 15 bp, Homo sapiens
acatcaggaaaaaca

SEQ ID NO: 11719 - DNA, 15 bp, Homo sapiens
cacatcaggaaaaac

SEQ ID NO: 11720 - DNA, 15 bp, Homo sapiens
acacatcaggaaaaa

SEQ ID NO: 11721 - DNA, 15 bp, Homo sapiens
aacacatcaggaaaa

SEQ ID NO: 11722 - DNA, 15 bp, Homo sapiens
caacacatcaggaaa

SEQ ID NO: 11723 - DNA, 15 bp, Homo sapiens
tcaacacatcaggaa

SEQ ID NO: 11724 - DNA, 15 bp, Homo sapiens
ctcaacacatcagga

SEQ ID NO: 11725 - DNA, 15 bp, Homo sapiens
actcaacacatcagg

SEQ ID NO: 11726 - DNA, 15 bp, Homo sapiens
tactcaacacatcag

SEQ ID NO: 11727 - DNA, 15 bp, Homo sapiens
ttactcaacacatca

SEQ ID NO: 11728 - DNA, 15 bp, Homo sapiens
tttactcaacacatc

SEQ ID NO: 11729 - DNA, 15 bp, Homo sapiens
ttttactcaacacat

SEQ ID NO: 11730 - DNA, 15 bp, Homo sapiens
tttttactcaacaca

SEQ ID NO: 11731 - DNA, 15 bp, Homo sapiens
atttttactcaacac

SEQ ID NO: 11732 - DNA, 15 bp, Homo sapiens
tatttttactcaaca

SEQ ID NO: 11733 - DNA, 15 bp, Homo sapiens
atatttttactcaac

SEQ ID NO: 11734 - DNA, 15 bp, Homo sapiens
catatttttactcaa

SEQ ID NO: 11735 - DNA, 15 bp, Homo sapiens
acatatttttactca

SEQ ID NO: 11736 - DNA, 15 bp, Homo sapiens
aacatatttttactc

SEQ ID NO: 11737 - DNA, 15 bp, Homo sapiens
aaacatatttttact

SEQ ID NO: 11738 - DNA, 15 bp, Homo sapiens
caaacatatttttac

SEQ ID NO: 11739 - DNA, 15 bp, Homo sapiens
gcaaacatattttta

SEQ ID NO: 11740 - DNA, 15 bp, Homo sapiens
cgcaaacatattttt

SEQ ID NO: 11741 - DNA, 15 bp, Homo sapiens
ccgcaaacatatttt

SEQ ID NO: 11742 - DNA, 15 bp, Homo sapiens
cccgcaaacatattt

SEQ ID NO: 11743 - DNA, 15 bp, Homo sapiens
tcccgcaaacatatt

SEQ ID NO: 11744 - DNA, 15 bp, Homo sapiens
ttcccgcaaacatat

SEQ ID NO: 11745 - DNA, 15 bp, Homo sapiens
cttcccgcaaacata

SEQ ID NO: 11746 - DNA, 15 bp, Homo sapiens
acttcccgcaaacat

SEQ ID NO: 11747 - DNA, 15 bp, Homo sapiens
aacttcccgcaaaca

SEQ ID NO: 11748 - DNA, 15 bp, Homo sapiens
aaacttcccgcaaac

SEQ ID NO: 11749 - DNA, 15 bp, Homo sapiens
taaacttcccgcaaa

SEQ ID NO: 11750 - DNA, 15 bp, Homo sapiens
gtaaacttcccgcaa

SEQ ID NO: 11751 - DNA, 15 bp, Homo sapiens
tgtaaacttcccgca

SEQ ID NO: 11752 - DNA, 15 bp, Homo sapiens
atgtaaacttcccgc

SEQ ID NO: 11753 - DNA, 15 bp, Homo sapiens
catgtaaacttcccg

SEQ ID NO: 11754 - DNA, 15 bp, Homo sapiens
acatgtaaacttccc

SEQ ID NO: 11755 - DNA, 15 bp, Homo sapiens
tacatgtaaacttcc

SEQ ID NO: 11756 - DNA, 15 bp, Homo sapiens
atacatgtaaacttc

SEQ ID NO: 11757 - DNA, 15 bp, Homo sapiens
aatacatgtaaactt

SEQ ID NO: 11758 - DNA, 15 bp, Homo sapiens
aaatacatgtaaact

SEQ ID NO: 11759 - DNA, 15 bp, Homo sapiens
aaaatacatgtaaac

SEQ ID NO: 11760 - DNA, 15 bp, Homo sapiens
gaaaatacatgtaaa

SEQ ID NO: 11761 - DNA, 15 bp, Homo sapiens
ggaaaatacatgtaa

SEQ ID NO: 11762 - DNA, 15 bp, Homo sapiens
gggaaaatacatgta

SEQ ID NO: 11763 - DNA, 15 bp, Homo sapiens
agggaaaatacatgt

SEQ ID NO: 11764 - DNA, 15 bp, Homo sapiens
aagggaaaatacatg

SEQ ID NO: 11765 - DNA, 15 bp, Homo sapiens
aaagggaaaatacat

SEQ ID NO: 11766 - DNA, 15 bp, Homo sapiens
taaagggaaaataca

SEQ ID NO: 11767 - DNA, 15 bp, Homo sapiens
ataaagggaaaatac

SEQ ID NO: 11768 - DNA, 15 bp, Homo sapiens
aataaagggaaaata

SEQ ID NO: 11769 - DNA, 15 bp, Homo sapiens
gaataaagggaaaat

SEQ ID NO: 11770 - DNA, 15 bp, Homo sapiens
ggaataaagggaaaa

SEQ ID NO: 11771 - DNA, 15 bp, Homo sapiens
tggaataaagggaaa

SEQ ID NO: 11772 - DNA, 15 bp, Homo sapiens
atggaataaagggaa

SEQ ID NO: 11773 - DNA, 15 bp, Homo sapiens
tatggaataaaggga

SEQ ID NO: 11774 - DNA, 15 bp, Homo sapiens
ttatggaataaaggg

SEQ ID NO: 11775 - DNA, 15 bp, Homo sapiens
tttatggaataaagg

SEQ ID NO: 11776 - DNA, 15 bp, Homo sapiens
atttatggaataaag

SEQ ID NO: 11777 - DNA, 15 bp, Homo sapiens
aatttatggaataaa

SEQ ID NO: 11778 - DNA, 15 bp, Homo sapiens
taatttatggaataa

SEQ ID NO: 11779 - DNA, 15 bp, Homo sapiens
ttaatttatggaata

SEQ ID NO: 11780 - DNA, 15 bp, Homo sapiens
attaatttatggaat

SEQ ID NO: 11781 - DNA, 15 bp, Homo sapiens
aattaatttatggaa

SEQ ID NO: 11782 - DNA, 15 bp, Homo sapiens
caattaatttatgga

SEQ ID NO: 11783 - DNA, 15 bp, Homo sapiens
acaattaatttatgg

SEQ ID NO: 11784 - DNA, 15 bp, Homo sapiens
aacaattaatttatg

SEQ ID NO: 11785 - DNA, 15 bp, Homo sapiens
aaacaattaatttat

SEQ ID NO: 11786 - DNA, 15 bp, Homo sapiens
aaaacaattaattta

SEQ ID NO: 11787 - DNA, 15 bp, Homo sapiens
gaaaacaattaattt

SEQ ID NO: 11788 - DNA, 15 bp, Homo sapiens
agaaaacaattaatt

SEQ ID NO: 11789 - DNA, 15 bp, Homo sapiens
cagaaaacaattaat

SEQ ID NO: 11790 - DNA, 15 bp, Homo sapiens
tcagaaaacaattaa

SEQ ID NO: 11791 - DNA, 15 bp, Homo sapiens
gtcagaaaacaatta

SEQ ID NO: 11792 - DNA, 15 bp, Homo sapiens
tgtcagaaaacaatt

SEQ ID NO: 11793 - DNA, 15 bp, Homo sapiens
gtgtcagaaaacaat

SEQ ID NO: 11794 - DNA, 15 bp, Homo sapiens
tgtgtcagaaaacaa

SEQ ID NO: 11795 - DNA, 15 bp, Homo sapiens
ctgtgtcagaaaaca

SEQ ID NO: 11796 - DNA, 15 bp, Homo sapiens
actgtgtcagaaaac

SEQ ID NO: 11797 - DNA, 15 bp, Homo sapiens
gactgtgtcagaaaa

SEQ ID NO: 11798 - DNA, 15 bp, Homo sapiens
agactgtgtcagaaa

SEQ ID NO: 11799 - DNA, 15 bp, Homo sapiens
gagactgtgtcagaa

SEQ ID NO: 11800 - DNA, 15 bp, Homo sapiens
tgagactgtgtcaga

SEQ ID NO: 11801 - DNA, 15 bp, Homo sapiens
gtgagactgtgtcag

SEQ ID NO: 11802 - DNA, 15 bp, Homo sapiens
agtgagactgtgtca

SEQ ID NO: 11803 - DNA, 15 bp, Homo sapiens
gagtgagactgtgtc

SEQ ID NO: 11804 - DNA, 15 bp, Homo sapiens
agagtgagactgtgt

SEQ ID NO: 11805 - DNA, 15 bp, Homo sapiens
cagagtgagactgtg

SEQ ID NO: 11806 - DNA, 15 bp, Homo sapiens
acagagtgagactgt

SEQ ID NO: 11807 - DNA, 15 bp, Homo sapiens
aacagagtgagactg

SEQ ID NO: 11808 - DNA, 15 bp, Homo sapiens
caacagagtgagact

SEQ ID NO: 11809 - DNA, 15 bp, Homo sapiens
gcaacagagtgagac

SEQ ID NO: 11810 - DNA, 15 bp, Homo sapiens
ggcaacagagtgaga

SEQ ID NO: 11811 - DNA, 15 bp, Homo sapiens
gggcaacagagtgag

SEQ ID NO: 11812 - DNA, 15 bp, Homo sapiens
tgggcaacagagtga

SEQ ID NO: 11813 - DNA, 15 bp, Homo sapiens
ctgggcaacagagtg

SEQ ID NO: 11814 - DNA, 15 bp, Homo sapiens
acaccattgcactcc

SEQ ID NO: 11815 - DNA, 15 bp, Homo sapiens
aacaccattgcactc

SEQ ID NO: 11816 - DNA, 15 bp, Homo sapiens
caacaccattgcact

SEQ ID NO: 11817 - DNA, 15 bp, Homo sapiens
acaacaccattgcac

SEQ ID NO: 11818 - DNA, 15 bp, Homo sapiens
gacaacaccattgca

SEQ ID NO: 11819 - DNA, 15 bp, Homo sapiens
agacaacaccattgc

SEQ ID NO: 11820 - DNA, 15 bp, Homo sapiens
gagacaacaccattg

SEQ ID NO: 11821 - DNA, 15 bp, Homo sapiens
cgagacaacaccatt

SEQ ID NO: 11822 - DNA, 15 bp, Homo sapiens
ccgagacaacaccat

SEQ ID NO: 11823 - DNA, 15 bp, Homo sapiens
gccgagacaacacca

SEQ ID NO: 11824 - DNA, 15 bp, Homo sapiens
agccgagacaacacc

SEQ ID NO: 11825 - DNA, 15 bp, Homo sapiens
gagccgagacaacac

SEQ ID NO: 11826 - DNA, 15 bp, Homo sapiens
tgagccgagacaaca

SEQ ID NO: 11827 - DNA, 15 bp, Homo sapiens
gtgagccgagacaac

SEQ ID NO: 11828 - DNA, 15 bp, Homo sapiens
agtgagccgagacaa

SEQ ID NO: 11829 - DNA, 15 bp, Homo sapiens
cagtgagccgagaca

SEQ ID NO: 11830 - DNA, 15 bp, Homo sapiens
aagaggttgcagtga

SEQ ID NO: 11831 - DNA, 15 bp, Homo sapiens
gaagaggttgcagtg

SEQ ID NO: 11832 - DNA, 15 bp, Homo sapiens
ggaagaggttgcagt

SEQ ID NO: 11833 - DNA, 15 bp, Homo sapiens
aggaagaggttgcag

SEQ ID NO: 11834 - DNA, 15 bp, Homo sapiens
gaggaagaggttgca

SEQ ID NO: 11835 - DNA, 15 bp, Homo sapiens
ggaggaagaggttgc

SEQ ID NO: 11836 - DNA, 15 bp, Homo sapiens
gggaggaagaggttg

SEQ ID NO: 11837 - DNA, 15 bp, Homo sapiens
tgggaggaagaggtt

SEQ ID NO: 11838 - DNA, 15 bp, Homo sapiens
ctgggaggaagaggt

SEQ ID NO: 11839 - DNA, 15 bp, Homo sapiens
cctgggaggaagagg

SEQ ID NO: 11840 - DNA, 15 bp, Homo sapiens
acctgggaggaagag

SEQ ID NO: 11841 - DNA, 15 bp, Homo sapiens
aacctgggaggaaga

SEQ ID NO: 11842 - DNA, 15 bp, Homo sapiens
gaacctgggaggaag

SEQ ID NO: 11843 - DNA, 15 bp, Homo sapiens
tgaacctgggaggaa

SEQ ID NO: 11844 - DNA, 15 bp, Homo sapiens
ttgaacctgggagga

SEQ ID NO: 11845 - DNA, 15 bp, Homo sapiens
acttgaacctgggag

SEQ ID NO: 11846 - DNA, 15 bp, Homo sapiens
cacttgaacctggga

SEQ ID NO: 11847 - DNA, 15 bp, Homo sapiens
ccacttgaacctggg

SEQ ID NO: 11848 - DNA, 15 bp, Homo sapiens
accacttgaacctgg

SEQ ID NO: 11849 - DNA, 15 bp, Homo sapiens
aaccacttgaacctg

SEQ ID NO: 11850 - DNA, 15 bp, Homo sapiens
gaaccacttgaacct

SEQ ID NO: 11851 - DNA, 15 bp, Homo sapiens
agaaccacttgaacc

SEQ ID NO: 11852 - DNA, 15 bp, Homo sapiens
gagaaccacttgaac

SEQ ID NO: 11853 - DNA, 15 bp, Homo sapiens
cgagaaccacttgaa

SEQ ID NO: 11854 - DNA, 15 bp, Homo sapiens
acgagaaccacttga

SEQ ID NO: 11855 - DNA, 15 bp, Homo sapiens
cacgagaaccacttg

SEQ ID NO: 11856 - DNA, 15 bp, Homo sapiens
gcacgagaaccactt

SEQ ID NO: 11857 - DNA, 15 bp, Homo sapiens
ggcacgagaaccact

SEQ ID NO: 11858 - DNA, 15 bp, Homo sapiens
aggcacgagaaccac

SEQ ID NO: 11859 - DNA, 15 bp, Homo sapiens
gaggcacgagaacca

SEQ ID NO: 11860 - DNA, 15 bp, Homo sapiens
tgaggcacgagaacc

SEQ ID NO: 11861 - DNA, 15 bp, Homo sapiens
ctgaggcacgagaac

SEQ ID NO: 11862 - DNA, 15 bp, Homo sapiens
gctgaggcacgagaa

SEQ ID NO: 11863 - DNA, 15 bp, Homo sapiens
ggctgaggcacgaga

SEQ ID NO: 11864 - DNA, 15 bp, Homo sapiens
aggctgaggcacgag

SEQ ID NO: 11865 - DNA, 15 bp, Homo sapiens
gaggctgaggcacga

SEQ ID NO: 11866 - DNA, 15 bp, Homo sapiens
ggaggctgaggcacg

SEQ ID NO: 11867 - DNA, 15 bp, Homo sapiens
gggaggctgaggcac

SEQ ID NO: 11868 - DNA, 15 bp, Homo sapiens
cttgggaggctgagg

SEQ ID NO: 11869 - DNA, 15 bp, Homo sapiens
acttgggaggctgag

SEQ ID NO: 11870 - DNA, 15 bp, Homo sapiens
tacttgggaggctga

SEQ ID NO: 11871 - DNA, 15 bp, Homo sapiens
ctacttgggaggctg

SEQ ID NO: 11872 - DNA, 15 bp, Homo sapiens
gtagtcccagctact

SEQ ID NO: 11873 - DNA, 15 bp, Homo sapiens
tgtagtcccagctac

SEQ ID NO: 11874 - DNA, 15 bp, Homo sapiens
ctgtagtcccagcta

SEQ ID NO: 11875 - DNA, 15 bp, Homo sapiens
cctgtagtcccagct

SEQ ID NO: 11876 - DNA, 15 bp, Homo sapiens
gcctgtagtcccagc

SEQ ID NO: 11877 - DNA, 15 bp, Homo sapiens
tgcctgtagtcccag

SEQ ID NO: 11878 - DNA, 15 bp, Homo sapiens
gtgcctgtagtccca

SEQ ID NO: 11879 - DNA, 15 bp, Homo sapiens
cgtgcctgtagtccc

SEQ ID NO: 11880 - DNA, 15 bp, Homo sapiens
gcgtgcctgtagtcc

SEQ ID NO: 11881 - DNA, 15 bp, Homo sapiens
tgcgtgcctgtagtc

SEQ ID NO: 11882 - DNA, 15 bp, Homo sapiens
gtgcgtgcctgtagt

SEQ ID NO: 11883 - DNA, 15 bp, Homo sapiens
ggtgcgtgcctgtag

SEQ ID NO: 11884 - DNA, 15 bp, Homo sapiens
tggtgcgtgcctgta

SEQ ID NO: 11885 - DNA, 15 bp, Homo sapiens
gtggtgcgtgcctgt

SEQ ID NO: 11886 - DNA, 15 bp, Homo sapiens
ggtggtgcgtgcctg

SEQ ID NO: 11887 - DNA, 15 bp, Homo sapiens
tggtggtgcgtgcct

SEQ ID NO: 11888 - DNA, 15 bp, Homo sapiens
gtggtggtgcgtgcc

SEQ ID NO: 11889 - DNA, 15 bp, Homo sapiens
cgtggtggtgcgtgc

SEQ ID NO: 11890 - DNA, 15 bp, Homo sapiens
gcgtggtggtgcgtg

SEQ ID NO: 11891 - DNA, 15 bp, Homo sapiens
ggcgtggtggtgcgt

SEQ ID NO: 11892 - DNA, 15 bp, Homo sapiens
gggcgtggtggtgcg

SEQ ID NO: 11893 - DNA, 15 bp, Homo sapiens
tgggcgtggtggtgc

SEQ ID NO: 11894 - DNA, 15 bp, Homo sapiens
ctgggcgtggtggtg

SEQ ID NO: 11895 - DNA, 15 bp, Homo sapiens
gctgggcgtggtggt

SEQ ID NO: 11896 - DNA, 15 bp, Homo sapiens
gagctgggcgtggtg

SEQ ID NO: 11897 - DNA, 15 bp, Homo sapiens
tgagctgggcgtggt

SEQ ID NO: 11898 - DNA, 15 bp, Homo sapiens
atgagctgggcgtgg

SEQ ID NO: 11899 - DNA, 15 bp, Homo sapiens
aatgagctgggcgtg

SEQ ID NO: 11900 - DNA, 15 bp, Homo sapiens
aaatgagctgggcgt

SEQ ID NO: 11901 - DNA, 15 bp, Homo sapiens
aaaatgagctgggcg

SEQ ID NO: 11902 - DNA, 15 bp, Homo sapiens
aaaaatgagctgggc

SEQ ID NO: 11903 - DNA, 15 bp, Homo sapiens
caaaaatgagctggg

SEQ ID NO: 11904 - DNA, 15 bp, Homo sapiens
acaaaaatgagctgg

SEQ ID NO: 11905 - DNA, 15 bp, Homo sapiens
tacaaaaatgagctg

SEQ ID NO: 11906 - DNA, 15 bp, Homo sapiens
atacaaaaatgagct

SEQ ID NO: 11907 - DNA, 15 bp, Homo sapiens
aatacaaaaatgagc

SEQ ID NO: 11908 - DNA, 15 bp, Homo sapiens
aaatacaaaaatgag

SEQ ID NO: 11909 - DNA, 15 bp, Homo sapiens
aaaatacaaaaatga

SEQ ID NO: 11910 - DNA, 15 bp, Homo sapiens
aaaaatacaaaaatg

SEQ ID NO: 11911 - DNA, 15 bp, Homo sapiens
caaaaaatacaaaaa

SEQ ID NO: 11912 - DNA, 15 bp, Homo sapiens
ccaaaaaatacaaaa

SEQ ID NO: 11913 - DNA, 15 bp, Homo sapiens
accaaaaaatacaaa

SEQ ID NO: 11914 - DNA, 15 bp, Homo sapiens
taccaaaaaatacaa

SEQ ID NO: 11915 - DNA, 15 bp, Homo sapiens
ttaccaaaaaataca

SEQ ID NO: 11916 - DNA, 15 bp, Homo sapiens
cttaccaaaaaatac

SEQ ID NO: 11917 - DNA, 15 bp, Homo sapiens
tcttaccaaaaaata

SEQ ID NO: 11918 - DNA, 15 bp, Homo sapiens
ctcttaccaaaaaat

SEQ ID NO: 11919 - DNA, 15 bp, Homo sapiens
tctcttaccaaaaaa

SEQ ID NO: 11920 - DNA, 15 bp, Homo sapiens
gtctcttaccaaaaa

SEQ ID NO: 11921 - DNA, 15 bp, Homo sapiens
tgtctcttaccaaaa

SEQ ID NO: 11922 - DNA, 15 bp, Homo sapiens
ctgtctcttaccaaa

SEQ ID NO: 11923 - DNA, 15 bp, Homo sapiens
cctgtctcttaccaa

SEQ ID NO: 11924 - DNA, 15 bp, Homo sapiens
ccctgtctcttacca

SEQ ID NO: 11925 - DNA, 15 bp, Homo sapiens
accctgtctcttacc

SEQ ID NO: 11926 - DNA, 15 bp, Homo sapiens
aaccctgtctcttac

SEQ ID NO: 11927 - DNA, 15 bp, Homo sapiens
aaaccctgtctctta

SEQ ID NO: 11928 - DNA, 15 bp, Homo sapiens
gaaaccctgtctctt

SEQ ID NO: 11929 - DNA, 15 bp, Homo sapiens
tgaaaccctgtctct

SEQ ID NO: 11930 - DNA, 15 bp, Homo sapiens
gtgaaaccctgtctc

SEQ ID NO: 11931 - DNA, 15 bp, Homo sapiens
ggtgaaaccctgtct

SEQ ID NO: 11932 - DNA, 15 bp, Homo sapiens
tggtgaaaccctgtc

SEQ ID NO: 11933 - DNA, 15 bp, Homo sapiens
atggtgaaaccctgt

SEQ ID NO: 11934 - DNA, 15 bp, Homo sapiens
catggtgaaaccctg

SEQ ID NO: 11935 - DNA, 15 bp, Homo sapiens
acatggtgaaaccct

SEQ ID NO: 11936 - DNA, 15 bp, Homo sapiens
aagaccagcctggcc

SEQ ID NO: 11937 - DNA, 15 bp, Homo sapiens
caagaccagcctggc

SEQ ID NO: 11938 - DNA, 15 bp, Homo sapiens
tcaagaccagcctgg

SEQ ID NO: 11939 - DNA, 15 bp, Homo sapiens
ctcaagaccagcctg

SEQ ID NO: 11940 - DNA, 15 bp, Homo sapiens
gctcaagaccagcct

SEQ ID NO: 11941 - DNA, 15 bp, Homo sapiens
agctcaagaccagcc

SEQ ID NO: 11942 - DNA, 15 bp, Homo sapiens
gagctcaagaccagc

SEQ ID NO: 11943 - DNA, 15 bp, Homo sapiens
ggagctcaagaccag

SEQ ID NO: 11944 - DNA, 15 bp, Homo sapiens
aggagctcaagacca

SEQ ID NO: 11945 - DNA, 15 bp, Homo sapiens
caggagctcaagacc

SEQ ID NO: 11946 - DNA, 15 bp, Homo sapiens
tcaggagctcaagac

SEQ ID NO: 11947 - DNA, 15 bp, Homo sapiens
gtcaggagctcaaga

SEQ ID NO: 11948 - DNA, 15 bp, Homo sapiens
ggtcaggagctcaag

SEQ ID NO: 11949 - DNA, 15 bp, Homo sapiens
aggtcaggagctcaa

SEQ ID NO: 11950 - DNA, 15 bp, Homo sapiens
gaggtcaggagctca

SEQ ID NO: 11951 - DNA, 15 bp, Homo sapiens
tgaggtcaggagctc

SEQ ID NO: 11952 - DNA, 15 bp, Homo sapiens
ttgaggtcaggagct

SEQ ID NO: 11953 - DNA, 15 bp, Homo sapiens
cttgaggtcaggagc

SEQ ID NO: 11954 - DNA, 15 bp, Homo sapiens
acttgaggtcaggag

SEQ ID NO: 11955 - DNA, 15 bp, Homo sapiens
cacttgaggtcagga

SEQ ID NO: 11956 - DNA, 15 bp, Homo sapiens
tcacttgaggtcagg

SEQ ID NO: 11957 - DNA, 15 bp, Homo sapiens
atcacttgaggtcag

SEQ ID NO: 11958 - DNA, 15 bp, Homo sapiens
gatcacttgaggtca

SEQ ID NO: 11959 - DNA, 15 bp, Homo sapiens
ggatcacttgaggtc

SEQ ID NO: 11960 - DNA, 15 bp, Homo sapiens
cggatcacttgaggt

SEQ ID NO: 11961 - DNA, 15 bp, Homo sapiens
gcggatcacttgagg

SEQ ID NO: 11962 - DNA, 15 bp, Homo sapiens
ggcggatcacttgag

SEQ ID NO: 11963 - DNA, 15 bp, Homo sapiens
gggcggatcacttga

SEQ ID NO: 11964 - DNA, 15 bp, Homo sapiens
agggcggatcacttg

SEQ ID NO: 11965 - DNA, 15 bp, Homo sapiens
gagggcggatcactt

SEQ ID NO: 11966 - DNA, 15 bp, Homo sapiens
ggagggcggatcact

SEQ ID NO: 11967 - DNA, 15 bp, Homo sapiens
aggagggcggatcac

SEQ ID NO: 11968 - DNA, 15 bp, Homo sapiens
gaggagggcggatca

SEQ ID NO: 11969 - DNA, 15 bp, Homo sapiens
tgaggagggcggatc

SEQ ID NO: 11970 - DNA, 15 bp, Homo sapiens
ctgaggagggcggat

SEQ ID NO: 11971 - DNA, 15 bp, Homo sapiens
gctgaggagggcgga

SEQ ID NO: 11972 - DNA, 15 bp, Homo sapiens
ggctgaggagggcgg

SEQ ID NO: 11973 - DNA, 15 bp, Homo sapiens
aggctgaggagggcg

SEQ ID NO: 11974 - DNA, 15 bp, Homo sapiens
gaggctgaggagggc

SEQ ID NO: 11975 - DNA, 15 bp, Homo sapiens
ggaggctgaggaggg

SEQ ID NO: 11976 - DNA, 15 bp, Homo sapiens
gggaggctgaggagg

SEQ ID NO: 11977 - DNA, 15 bp, Homo sapiens
tgggaggctgaggag

SEQ ID NO: 11978 - DNA, 15 bp, Homo sapiens
ttgggaggctgagga

SEQ ID NO: 11979 - DNA, 15 bp, Homo sapiens
ggtggctcacgtctg

SEQ ID NO: 11980 - DNA, 15 bp, Homo sapiens
tggtggctcacgtct

SEQ ID NO: 11981 - DNA, 15 bp, Homo sapiens
atggtggctcacgtc

SEQ ID NO: 11982 - DNA, 15 bp, Homo sapiens
catggtggctcacgt

SEQ ID NO: 11983 - DNA, 15 bp, Homo sapiens
gcatggtggctcacg

SEQ ID NO: 11984 - DNA, 15 bp, Homo sapiens
ggcatggtggctcac

SEQ ID NO: 11985 - DNA, 15 bp, Homo sapiens
gggcatggtggctca

SEQ ID NO: 11986 - DNA, 15 bp, Homo sapiens
cgggcatggtggctc

SEQ ID NO: 11987 - DNA, 15 bp, Homo sapiens
ccgggcatggtggct

SEQ ID NO: 11988 - DNA, 15 bp, Homo sapiens
gccgggcatggtggc

SEQ ID NO: 11989 - DNA, 15 bp, Homo sapiens
ggccgggcatggtgg

SEQ ID NO: 11990 - DNA, 15 bp, Homo sapiens
aggccgggcatggtg

SEQ ID NO: 11991 - DNA, 15 bp, Homo sapiens
taggccgggcatggt

SEQ ID NO: 11992 - DNA, 15 bp, Homo sapiens
ataggccgggcatgg

SEQ ID NO: 11993 - DNA, 15 bp, Homo sapiens
aataggccgggcatg

SEQ ID NO: 11994 - DNA, 15 bp, Homo sapiens
taataggccgggcat

SEQ ID NO: 11995 - DNA, 15 bp, Homo sapiens
ttaataggccgggca

SEQ ID NO: 11996 - DNA, 15 bp, Homo sapiens
attaataggccgggc

SEQ ID NO: 11997 - DNA, 15 bp, Homo sapiens
aattaataggccggg

SEQ ID NO: 11998 - DNA, 15 bp, Homo sapiens
aaattaataggccgg

SEQ ID NO: 11999 - DNA, 15 bp, Homo sapiens
taaattaataggccg

SEQ ID NO: 12000 - DNA, 15 bp, Homo sapiens
ttaaattaataggcc

SEQ ID NO: 12001 - DNA, 15 bp, Homo sapiens
attaaattaataggc

SEQ ID NO: 12002 - DNA, 15 bp, Homo sapiens
aattaaattaatagg

SEQ ID NO: 12003 - DNA, 15 bp, Homo sapiens
taattaaattaatag

SEQ ID NO: 12004 - DNA, 15 bp, Homo sapiens
ttaattaaattaata

SEQ ID NO: 12005 - DNA, 15 bp, Homo sapiens
attaattaaattaat

SEQ ID NO: 12006 - DNA, 15 bp, Homo sapiens
aattaattaaattaa

SEQ ID NO: 12007 - DNA, 15 bp, Homo sapiens
caattaattaaatta

SEQ ID NO: 12008 - DNA, 15 bp, Homo sapiens
gcaattaattaaatt

SEQ ID NO: 12009 - DNA, 15 bp, Homo sapiens
tgcaattaattaaat

SEQ ID NO: 12010 - DNA, 15 bp, Homo sapiens
ttgcaattaattaaa

SEQ ID NO: 12011 - DNA, 15 bp, Homo sapiens
tttgcaattaattaa

SEQ ID NO: 12012 - DNA, 15 bp, Homo sapiens
atttgcaattaatta

SEQ ID NO: 12013 - DNA, 15 bp, Homo sapiens
aatttgcaattaatt

SEQ ID NO: 12014 - DNA, 15 bp, Homo sapiens
aaatttgcaattaat

SEQ ID NO: 12015 - DNA, 15 bp, Homo sapiens
aaaatttgcaattaa

SEQ ID NO: 12016 - DNA, 15 bp, Homo sapiens
aaaaatttgcaatta

SEQ ID NO: 12017 - DNA, 15 bp, Homo sapiens
caaaaatttgcaatt

SEQ ID NO: 12018 - DNA, 15 bp, Homo sapiens
tcaaaaatttgcaat

SEQ ID NO: 12019 - DNA, 15 bp, Homo sapiens
gtcaaaaatttgcaa

SEQ ID NO: 12020 - DNA, 15 bp, Homo sapiens
ggtcaaaaatttgca

SEQ ID NO: 12021 - DNA, 15 bp, Homo sapiens
aggtcaaaaatttgc

SEQ ID NO: 12022 - DNA, 15 bp, Homo sapiens
aaggtcaaaaatttg

SEQ ID NO: 12023 - DNA, 15 bp, Homo sapiens
taaggtcaaaaattt

SEQ ID NO: 12024 - DNA, 15 bp, Homo sapiens
ttaaggtcaaaaatt

SEQ ID NO: 12025 - DNA, 15 bp, Homo sapiens
attaaggtcaaaaat

SEQ ID NO: 12026 - DNA, 15 bp, Homo sapiens
cattaaggtcaaaaa

SEQ ID NO: 12027 - DNA, 15 bp, Homo sapiens
gcattaaggtcaaaa

SEQ ID NO: 12028 - DNA, 15 bp, Homo sapiens
tgcattaaggtcaaa

SEQ ID NO: 12029 - DNA, 15 bp, Homo sapiens
atgcattaaggtcaa

SEQ ID NO: 12030 - DNA, 15 bp, Homo sapiens
tatgcattaaggtca

SEQ ID NO: 12031 - DNA, 15 bp, Homo sapiens
atatgcattaaggtc

SEQ ID NO: 12032 - DNA, 15 bp, Homo sapiens
tatatgcattaaggt

SEQ ID NO: 12033 - DNA, 15 bp, Homo sapiens
ttatatgcattaagg

SEQ ID NO: 12034 - DNA, 15 bp, Homo sapiens
tttatatgcattaag

SEQ ID NO: 12035 - DNA, 15 bp, Homo sapiens
gtttatatgcattaa

SEQ ID NO: 12036 - DNA, 15 bp, Homo sapiens
agtttatatgcatta

SEQ ID NO: 12037 - DNA, 15 bp, Homo sapiens
aagtttatatgcatt

SEQ ID NO: 12038 - DNA, 15 bp, Homo sapiens
aaagtttatatgcat

SEQ ID NO: 12039 - DNA, 15 bp, Homo sapiens
caaagtttatatgca

SEQ ID NO: 12040 - DNA, 15 bp, Homo sapiens
gcaaagtttatatgc

SEQ ID NO: 12041 - DNA, 15 bp, Homo sapiens
tgcaaagtttatatg

SEQ ID NO: 12042 - DNA, 15 bp, Homo sapiens
ctgcaaagtttatat

SEQ ID NO: 12043 - DNA, 15 bp, Homo sapiens
actgcaaagtttata

SEQ ID NO: 12044 - DNA, 15 bp, Homo sapiens
aactgcaaagtttat

SEQ ID NO: 12045 - DNA, 15 bp, Homo sapiens
taactgcaaagttta

SEQ ID NO: 12046 - DNA, 15 bp, Homo sapiens
ttaactgcaaagttt

SEQ ID NO: 12047 - DNA, 15 bp, Homo sapiens
cttaactgcaaagtt

SEQ ID NO: 12048 - DNA, 15 bp, Homo sapiens
tcttaactgcaaagt

SEQ ID NO: 12049 - DNA, 15 bp, Homo sapiens
atcttaactgcaaag

SEQ ID NO: 12050 - DNA, 15 bp, Homo sapiens
aatcttaactgcaaa

SEQ ID NO: 12051 - DNA, 15 bp, Homo sapiens
caatcttaactgcaa

SEQ ID NO: 12052 - DNA, 15 bp, Homo sapiens
gcaatcttaactgca

SEQ ID NO: 12053 - DNA, 15 bp, Homo sapiens
agcaatcttaactgc

SEQ ID NO: 12054 - DNA, 15 bp, Homo sapiens
gagcaatcttaactg

SEQ ID NO: 12055 - DNA, 15 bp, Homo sapiens
tgagcaatcttaact

SEQ ID NO: 12056 - DNA, 15 bp, Homo sapiens
atgagcaatcttaac

SEQ ID NO: 12057 - DNA, 15 bp, Homo sapiens
aatgagcaatcttaa

SEQ ID NO: 12058 - DNA, 15 bp, Homo sapiens
gaatgagcaatctta

SEQ ID NO: 12059 - DNA, 15 bp, Homo sapiens
agaatgagcaatctt

SEQ ID NO: 12060 - DNA, 15 bp, Homo sapiens
aagaatgagcaatct

SEQ ID NO: 12061 - DNA, 15 bp, Homo sapiens
gaagaatgagcaatc

SEQ ID NO: 12062 - DNA, 15 bp, Homo sapiens
cgaagaatgagcaat

SEQ ID NO: 12063 - DNA, 15 bp, Homo sapiens
gcgaagaatgagcaa

SEQ ID NO: 12064 - DNA, 15 bp, Homo sapiens
ggcgaagaatgagca

SEQ ID NO: 12065 - DNA, 15 bp, Homo sapiens
tggcgaagaatgagc

SEQ ID NO: 12066 - DNA, 15 bp, Homo sapiens
ttggcgaagaatgag

SEQ ID NO: 12067 - DNA, 15 bp, Homo sapiens
cttggcgaagaatga

SEQ ID NO: 12068 - DNA, 15 bp, Homo sapiens
acttggcgaagaatg

SEQ ID NO: 12069 - DNA, 15 bp, Homo sapiens
cacttggcgaagaat

SEQ ID NO: 12070 - DNA, 15 bp, Homo sapiens
acacttggcgaagaa

SEQ ID NO: 12071 - DNA, 15 bp, Homo sapiens
cacacttggcgaaga

SEQ ID NO: 12072 - DNA, 15 bp, Homo sapiens
ccacacttggcgaag

SEQ ID NO: 12073 - DNA, 15 bp, Homo sapiens
accacacttggcgaa

SEQ ID NO: 12074 - DNA, 15 bp, Homo sapiens
caccacacttggcga

SEQ ID NO: 12075 - DNA, 15 bp, Homo sapiens
ccaccacacttggcg

SEQ ID NO: 12076 - DNA, 15 bp, Homo sapiens
gccaccacacttggc

SEQ ID NO: 12077 - DNA, 15 bp, Homo sapiens
tgccaccacacttgg

SEQ ID NO: 12078 - DNA, 15 bp, Homo sapiens
gtgccaccacacttg

SEQ ID NO: 12079 - DNA, 15 bp, Homo sapiens
ggtgccaccacactt

SEQ ID NO: 12080 - DNA, 15 bp, Homo sapiens
tggtgccaccacact

SEQ ID NO: 12081 - DNA, 15 bp, Homo sapiens
ctggtgccaccacac

SEQ ID NO: 12082 - DNA, 15 bp, Homo sapiens
gctggtgccaccaca

SEQ ID NO: 12083 - DNA, 15 bp, Homo sapiens
ggctggtgccaccac

SEQ ID NO: 12084 - DNA, 15 bp, Homo sapiens
aggctggtgccacca

SEQ ID NO: 12085 - DNA, 15 bp, Homo sapiens
caggctggtgccacc

SEQ ID NO: 12086 - DNA, 15 bp, Homo sapiens
acaggctggtgccac

SEQ ID NO: 12087 - DNA, 15 bp, Homo sapiens
tacaggctggtgcca

SEQ ID NO: 12088 - DNA, 15 bp, Homo sapiens
ctacaggctggtgcc

SEQ ID NO: 12089 - DNA, 15 bp, Homo sapiens
actacaggctggtgc

SEQ ID NO: 12090 - DNA, 15 bp, Homo sapiens
gactacaggctggtg

SEQ ID NO: 12091 - DNA, 15 bp, Homo sapiens
agactacaggctggt

SEQ ID NO: 12092 - DNA, 15 bp, Homo sapiens
gagactacaggctgg

SEQ ID NO: 12093 - DNA, 15 bp, Homo sapiens
tgagactacaggctg

SEQ ID NO: 12094 - DNA, 15 bp, Homo sapiens
ctgagactacaggct

SEQ ID NO: 12095 - DNA, 15 bp, Homo sapiens
gctgagactacaggc

SEQ ID NO: 12096 - DNA, 15 bp, Homo sapiens
agctgagactacagg

SEQ ID NO: 12097 - DNA, 15 bp, Homo sapiens
tagctgagactacag

SEQ ID NO: 12098 - DNA, 15 bp, Homo sapiens
gtagctgagactaca

SEQ ID NO: 12099 - DNA, 15 bp, Homo sapiens
agtagctgagactac

SEQ ID NO: 12100 - DNA, 15 bp, Homo sapiens
gagtagctgagacta

SEQ ID NO: 12101 - DNA, 15 bp, Homo sapiens
tgagtagctgagact

SEQ ID NO: 12102 - DNA, 15 bp, Homo sapiens
ctgagtagctgagac

SEQ ID NO: 12103 - DNA, 15 bp, Homo sapiens
cctgagtagctgaga

SEQ ID NO: 12104 - DNA, 15 bp, Homo sapiens
tcctgagtagctgag

SEQ ID NO: 12105 - DNA, 15 bp, Homo sapiens
ctcctgagtagctga

SEQ ID NO: 12106 - DNA, 15 bp, Homo sapiens
acctcagcctcctga

SEQ ID NO: 12107 - DNA, 15 bp, Homo sapiens
cacctcagcctcctg

SEQ ID NO: 12108 - DNA, 15 bp, Homo sapiens
ccacctcagcctcct

SEQ ID NO: 12109 - DNA, 15 bp, Homo sapiens
ccctcccacctcagc

SEQ ID NO: 12110 - DNA, 15 bp, Homo sapiens
accctcccacctcag

SEQ ID NO: 12111 - DNA, 15 bp, Homo sapiens
aaccctcccacctca

SEQ ID NO: 12112 - DNA, 15 bp, Homo sapiens
caaccctcccacctc

SEQ ID NO: 12113 - DNA, 15 bp, Homo sapiens
gcaaccctcccacct

SEQ ID NO: 12114 - DNA, 15 bp, Homo sapiens
agcaaccctcccacc

SEQ ID NO: 12115 - DNA, 15 bp, Homo sapiens
aagcaaccctcccac

SEQ ID NO: 12116 - DNA, 15 bp, Homo sapiens
caagcaaccctccca

SEQ ID NO: 12117 - DNA, 15 bp, Homo sapiens
tcaagcaaccctccc

SEQ ID NO: 12118 - DNA, 15 bp, Homo sapiens
ttcaagcaaccctcc

SEQ ID NO: 12119 - DNA, 15 bp, Homo sapiens
gttcaagcaaccctc

SEQ ID NO: 12120 - DNA, 15 bp, Homo sapiens
ggttcaagcaaccct

SEQ ID NO: 12121 - DNA, 15 bp, Homo sapiens
gggttcaagcaaccc

SEQ ID NO: 12122 - DNA, 15 bp, Homo sapiens
tgggttcaagcaacc

SEQ ID NO: 12123 - DNA, 15 bp, Homo sapiens
ctgggttcaagcaac

SEQ ID NO: 12124 - DNA, 15 bp, Homo sapiens
cctgggttcaagcaa

SEQ ID NO: 12125 - DNA, 15 bp, Homo sapiens
gacctcctgggttca

SEQ ID NO: 12126 - DNA, 15 bp, Homo sapiens
tgacctcctgggttc

SEQ ID NO: 12127 - DNA, 15 bp, Homo sapiens
ttgacctcctgggtt

SEQ ID NO: 12128 - DNA, 15 bp, Homo sapiens
cttgacctcctgggt

SEQ ID NO: 12129 - DNA, 15 bp, Homo sapiens
tcttgacctcctggg

SEQ ID NO: 12130 - DNA, 15 bp, Homo sapiens
gtcttgacctcctgg

SEQ ID NO: 12131 - DNA, 15 bp, Homo sapiens
agtcttgacctcctg

SEQ ID NO: 12132 - DNA, 15 bp, Homo sapiens
cagtcttgacctcct

SEQ ID NO: 12133 - DNA, 15 bp, Homo sapiens
acagtcttgacctcc

SEQ ID NO: 12134 - DNA, 15 bp, Homo sapiens
tacagtcttgacctc

SEQ ID NO: 12135 - DNA, 15 bp, Homo sapiens
ctacagtcttgacct

SEQ ID NO: 12136 - DNA, 15 bp, Homo sapiens
actacagtcttgacc

SEQ ID NO: 12137 - DNA, 15 bp, Homo sapiens
cactacagtcttgac

SEQ ID NO: 12138 - DNA, 15 bp, Homo sapiens
tcactacagtcttga

SEQ ID NO: 12139 - DNA, 15 bp, Homo sapiens
ctcactacagtcttg

SEQ ID NO: 12140 - DNA, 15 bp, Homo sapiens
gctcactacagtctt

SEQ ID NO: 12141 - DNA, 15 bp, Homo sapiens
ggctcactacagtct

SEQ ID NO: 12142 - DNA, 15 bp, Homo sapiens
tggctcactacagtc

SEQ ID NO: 12143 - DNA, 15 bp, Homo sapiens
atggctcactacagt

SEQ ID NO: 12144 - DNA, 15 bp, Homo sapiens
catggctcactacag

SEQ ID NO: 12145 - DNA, 15 bp, Homo sapiens
tcatggctcactaca

SEQ ID NO: 12146 - DNA, 15 bp, Homo sapiens
atcatggctcactac

SEQ ID NO: 12147 - DNA, 15 bp, Homo sapiens
gatcatggctcacta

SEQ ID NO: 12148 - DNA, 15 bp, Homo sapiens
cgatcatggctcact

SEQ ID NO: 12149 - DNA, 15 bp, Homo sapiens
acgatcatggctcac

SEQ ID NO: 12150 - DNA, 15 bp, Homo sapiens
tacgatcatggctca

SEQ ID NO: 12151 - DNA, 15 bp, Homo sapiens
ttacgatcatggctc

SEQ ID NO: 12152 - DNA, 15 bp, Homo sapiens
gttacgatcatggct

SEQ ID NO: 12153 - DNA, 15 bp, Homo sapiens
tgttacgatcatggc

SEQ ID NO: 12154 - DNA, 15 bp, Homo sapiens
gtgttacgatcatgg

SEQ ID NO: 12155 - DNA, 15 bp, Homo sapiens
agtgttacgatcatg

SEQ ID NO: 12156 - DNA, 15 bp, Homo sapiens
cagtgttacgatcat

SEQ ID NO: 12157 - DNA, 15 bp, Homo sapiens
gcagtgttacgatca

SEQ ID NO: 12158 - DNA, 15 bp, Homo sapiens
tgcagtgttacgatc

SEQ ID NO: 12159 - DNA, 15 bp, Homo sapiens
gtgcagtgttacgat

SEQ ID NO: 12160 - DNA, 15 bp, Homo sapiens
agtgcagtgttacga

SEQ ID NO: 12161 - DNA, 15 bp, Homo sapiens
gagtgcagtgttacg

SEQ ID NO: 12162 - DNA, 15 bp, Homo sapiens
ggagtgcagtgttac

SEQ ID NO: 12163 - DNA, 15 bp, Homo sapiens
tggagtgcagtgtta

SEQ ID NO: 12164 - DNA, 15 bp, Homo sapiens
ctggagtgcagtgtt

SEQ ID NO: 12165 - DNA, 15 bp, Homo sapiens
actggagtgcagtgt

SEQ ID NO: 12166 - DNA, 15 bp, Homo sapiens
gactggagtgcagtg

SEQ ID NO: 12167 - DNA, 15 bp, Homo sapiens
agactggagtgcagt

SEQ ID NO: 12168 - DNA, 15 bp, Homo sapiens
cagactggagtgcag

SEQ ID NO: 12169 - DNA, 15 bp, Homo sapiens
ccagactggagtgca

SEQ ID NO: 12170 - DNA, 15 bp, Homo sapiens
cccagactggagtgc

SEQ ID NO: 12171 - DNA, 15 bp, Homo sapiens
gcccagactggagtg

SEQ ID NO: 12172 - DNA, 15 bp, Homo sapiens
tgcccagactggagt

SEQ ID NO: 12173 - DNA, 15 bp, Homo sapiens
ttgcccagactggag

SEQ ID NO: 12174 - DNA, 15 bp, Homo sapiens
tttgcccagactgga

SEQ ID NO: 12175 - DNA, 15 bp, Homo sapiens
ctttgcccagactgg

SEQ ID NO: 12176 - DNA, 15 bp, Homo sapiens
cctttgcccagactg

SEQ ID NO: 12177 - DNA, 15 bp, Homo sapiens
tcctttgcccagact

SEQ ID NO: 12178 - DNA, 15 bp, Homo sapiens
ctcctttgcccagac

SEQ ID NO: 12179 - DNA, 15 bp, Homo sapiens
gctcctttgcccaga

SEQ ID NO: 12180 - DNA, 15 bp, Homo sapiens
tgctcctttgcccag

SEQ ID NO: 12181 - DNA, 15 bp, Homo sapiens
ttgctcctttgccca

SEQ ID NO: 12182 - DNA, 15 bp, Homo sapiens
gttgctcctttgccc

SEQ ID NO: 12183 - DNA, 15 bp, Homo sapiens
tgttgctcctttgcc

SEQ ID NO: 12184 - DNA, 15 bp, Homo sapiens
gtgttgctcctttgc

SEQ ID NO: 12185 - DNA, 15 bp, Homo sapiens
agtgttgctcctttg

SEQ ID NO: 12186 - DNA, 15 bp, Homo sapiens
cagtgttgctccttt

SEQ ID NO: 12187 - DNA, 15 bp, Homo sapiens
acagtgttgctcctt

SEQ ID NO: 12188 - DNA, 15 bp, Homo sapiens
gacagtgttgctcct

SEQ ID NO: 12189 - DNA, 15 bp, Homo sapiens
agacagtgttgctcc

SEQ ID NO: 12190 - DNA, 15 bp, Homo sapiens
gagacagtgttgctc

SEQ ID NO: 12191 - DNA, 15 bp, Homo sapiens
tgagacagtgttgct

SEQ ID NO: 12192 - DNA, 15 bp, Homo sapiens
ctgagacagtgttgc

SEQ ID NO: 12193 - DNA, 15 bp, Homo sapiens
tctgagacagtgttg

SEQ ID NO: 12194 - DNA, 15 bp, Homo sapiens
ttctgagacagtgtt

SEQ ID NO: 12195 - DNA, 15 bp, Homo sapiens
tttctgagacagtgt

SEQ ID NO: 12196 - DNA, 15 bp, Homo sapiens
ttttctgagacagtg

SEQ ID NO: 12197 - DNA, 15 bp, Homo sapiens
tttttctgagacagt

SEQ ID NO: 12198 - DNA, 15 bp, Homo sapiens
gtttttctgagacag

SEQ ID NO: 12199 - DNA, 15 bp, Homo sapiens
tgtttttctgagaca

SEQ ID NO: 12200 - DNA, 15 bp, Homo sapiens
atgtttttctgagac

SEQ ID NO: 12201 - DNA, 15 bp, Homo sapiens
aatgtttttctgaga

SEQ ID NO: 12202 - DNA, 15 bp, Homo sapiens
caatgtttttctgag

SEQ ID NO: 12203 - DNA, 15 bp, Homo sapiens
acaatgtttttctga

SEQ ID NO: 12204 - DNA, 15 bp, Homo sapiens
aacaatgtttttctg

SEQ ID NO: 12205 - DNA, 15 bp, Homo sapiens
gaacaatgtttttct

SEQ ID NO: 12206 - DNA, 15 bp, Homo sapiens
tgaacaatgtttttc

SEQ ID NO: 12207 - DNA, 15 bp, Homo sapiens
atgaacaatgttttt

SEQ ID NO: 12208 - DNA, 15 bp, Homo sapiens
aatgaacaatgtttt

SEQ ID NO: 12209 - DNA, 15 bp, Homo sapiens
gaatgaacaatgttt

SEQ ID NO: 12210 - DNA, 15 bp, Homo sapiens
agaatgaacaatgtt

SEQ ID NO: 12211 - DNA, 15 bp, Homo sapiens
aagaatgaacaatgt

SEQ ID NO: 12212 - DNA, 15 bp, Homo sapiens
aaagaatgaacaatg

SEQ ID NO: 12213 - DNA, 15 bp, Homo sapiens
taaagaatgaacaat

SEQ ID NO: 12214 - DNA, 15 bp, Homo sapiens
gtaaagaatgaacaa

SEQ ID NO: 12215 - DNA, 15 bp, Homo sapiens
cgtaaagaatgaaca

SEQ ID NO: 12216 - DNA, 15 bp, Homo sapiens
ccgtaaagaatgaac

SEQ ID NO: 12217 - DNA, 15 bp, Homo sapiens
accgtaaagaatgaa

SEQ ID NO: 12218 - DNA, 15 bp, Homo sapiens
taccgtaaagaatga

SEQ ID NO: 12219 - DNA, 15 bp, Homo sapiens
ctaccgtaaagaatg

SEQ ID NO: 12220 - DNA, 15 bp, Homo sapiens
gctaccgtaaagaat

SEQ ID NO: 12221 - DNA, 15 bp, Homo sapiens
tgctaccgtaaagaa

SEQ ID NO: 12222 - DNA, 15 bp, Homo sapiens
ttgctaccgtaaaga

SEQ ID NO: 12223 - DNA, 15 bp, Homo sapiens
cttgctaccgtaaag

SEQ ID NO: 12224 - DNA, 15 bp, Homo sapiens
ccttgctaccgtaaa

SEQ ID NO: 12225 - DNA, 15 bp, Homo sapiens
tccttgctaccgtaa

SEQ ID NO: 12226 - DNA, 15 bp, Homo sapiens
ttccttgctaccgta

SEQ ID NO: 12227 - DNA, 15 bp, Homo sapiens
attccttgctaccgt

SEQ ID NO: 12228 - DNA, 15 bp, Homo sapiens
aattccttgctaccg

SEQ ID NO: 12229 - DNA, 15 bp, Homo sapiens
taattccttgctacc

SEQ ID NO: 12230 - DNA, 15 bp, Homo sapiens
ttaattccttgctac

SEQ ID NO: 12231 - DNA, 15 bp, Homo sapiens
tttaattccttgcta

SEQ ID NO: 12232 - DNA, 15 bp, Homo sapiens
ttttaattccttgct

SEQ ID NO: 12233 - DNA, 15 bp, Homo sapiens
attttaattccttgc

SEQ ID NO: 12234 - DNA, 15 bp, Homo sapiens
cattttaattccttg

SEQ ID NO: 12235 - DNA, 15 bp, Homo sapiens
ccattttaattcctt

SEQ ID NO: 12236 - DNA, 15 bp, Homo sapiens
cccattttaattcct

SEQ ID NO: 12237 - DNA, 15 bp, Homo sapiens
acccattttaattcc

SEQ ID NO: 12238 - DNA, 15 bp, Homo sapiens
cacccattttaattc

SEQ ID NO: 12239 - DNA, 15 bp, Homo sapiens
tcacccattttaatt

SEQ ID NO: 12240 - DNA, 15 bp, Homo sapiens
ctcacccattttaat

SEQ ID NO: 12241 - DNA, 15 bp, Homo sapiens
tctcacccattttaa

SEQ ID NO: 12242 - DNA, 15 bp, Homo sapiens
ctctcacccatttta

SEQ ID NO: 12243 - DNA, 15 bp, Homo sapiens
tctctcacccatttt

SEQ ID NO: 12244 - DNA, 15 bp, Homo sapiens
ttctctcacccattt

SEQ ID NO: 12245 - DNA, 15 bp, Homo sapiens
cttctctcacccatt

SEQ ID NO: 12246 - DNA, 15 bp, Homo sapiens
gcttctctcacccat

SEQ ID NO: 12247 - DNA, 15 bp, Homo sapiens
agcttctctcaccca

SEQ ID NO: 12248 - DNA, 15 bp, Homo sapiens
cagcttctctcaccc

SEQ ID NO: 12249 - DNA, 15 bp, Homo sapiens
gcagcttctctcacc

SEQ ID NO: 12250 - DNA, 15 bp, Homo sapiens
agcagcttctctcac

SEQ ID NO: 12251 - DNA, 15 bp, Homo sapiens
aagcagcttctctca

SEQ ID NO: 12252 - DNA, 15 bp, Homo sapiens
taagcagcttctctc

SEQ ID NO: 12253 - DNA, 15 bp, Homo sapiens
ttaagcagcttctct

SEQ ID NO: 12254 - DNA, 15 bp, Homo sapiens
cttaagcagcttctc

SEQ ID NO: 12255 - DNA, 15 bp, Homo sapiens
ccttaagcagcttct

SEQ ID NO: 12256 - DNA, 15 bp, Homo sapiens
tccttaagcagcttc

SEQ ID NO: 12257 - DNA, 15 bp, Homo sapiens
ttccttaagcagctt

SEQ ID NO: 12258 - DNA, 15 bp, Homo sapiens
tttccttaagcagct

SEQ ID NO: 12259 - DNA, 15 bp, Homo sapiens
atttccttaagcagc

SEQ ID NO: 12260 - DNA, 15 bp, Homo sapiens
catttccttaagcag

SEQ ID NO: 12261 - DNA, 15 bp, Homo sapiens
tcatttccttaagca

SEQ ID NO: 12262 - DNA, 15 bp, Homo sapiens
ctcatttccttaagc

SEQ ID NO: 12263 - DNA, 15 bp, Homo sapiens
tctcatttccttaag

SEQ ID NO: 12264 - DNA, 15 bp, Homo sapiens
ttctcatttccttaa

SEQ ID NO: 12265 - DNA, 15 bp, Homo sapiens
attctcatttcctta

SEQ ID NO: 12266 - DNA, 15 bp, Homo sapiens
cattctcatttcctt

SEQ ID NO: 12267 - DNA, 15 bp, Homo sapiens
acattctcatttcct

SEQ ID NO: 12268 - DNA, 15 bp, Homo sapiens
cacattctcatttcc

SEQ ID NO: 12269 - DNA, 15 bp, Homo sapiens
tcacattctcatttc

SEQ ID NO: 12270 - DNA, 15 bp, Homo sapiens
ctcacattctcattt

SEQ ID NO: 12271 - DNA, 15 bp, Homo sapiens
tctcacattctcatt

SEQ ID NO: 12272 - DNA, 15 bp, Homo sapiens
ttctcacattctcat

SEQ ID NO: 12273 - DNA, 15 bp, Homo sapiens
gttctcacattctca

SEQ ID NO: 12274 - DNA, 15 bp, Homo sapiens
ggttctcacattctc

SEQ ID NO: 12275 - DNA, 15 bp, Homo sapiens
tggttctcacattct

SEQ ID NO: 12276 - DNA, 15 bp, Homo sapiens
atggttctcacattc

SEQ ID NO: 12277 - DNA, 15 bp, Homo sapiens
aatggttctcacatt

SEQ ID NO: 12278 - DNA, 15 bp, Homo sapiens
taatggttctcacat

SEQ ID NO: 12279 - DNA, 15 bp, Homo sapiens
ataatggttctcaca

SEQ ID NO: 12280 - DNA, 15 bp, Homo sapiens
gataatggttctcac

SEQ ID NO: 12281 - DNA, 15 bp, Homo sapiens
agataatggttctca

SEQ ID NO: 12282 - DNA, 15 bp, Homo sapiens
aagataatggttctc

SEQ ID NO: 12283 - DNA, 15 bp, Homo sapiens
aaagataatggttct

SEQ ID NO: 12284 - DNA, 15 bp, Homo sapiens
taaagataatggttc

SEQ ID NO: 12285 - DNA, 15 bp, Homo sapiens
ataaagataatggtt

SEQ ID NO: 12286 - DNA, 15 bp, Homo sapiens
cataaagataatggt

SEQ ID NO: 12287 - DNA, 15 bp, Homo sapiens
acataaagataatgg

SEQ ID NO: 12288 - DNA, 15 bp, Homo sapiens
gacataaagataatg

SEQ ID NO: 12289 - DNA, 15 bp, Homo sapiens
agacataaagataat

SEQ ID NO: 12290 - DNA, 15 bp, Homo sapiens
gagacataaagataa

SEQ ID NO: 12291 - DNA, 15 bp, Homo sapiens
ggagacataaagata

SEQ ID NO: 12292 - DNA, 15 bp, Homo sapiens
aggagacataaagat

SEQ ID NO: 12293 - DNA, 15 bp, Homo sapiens
taggagacataaaga

SEQ ID NO: 12294 - DNA, 15 bp, Homo sapiens
ctaggagacataaag

SEQ ID NO: 12295 - DNA, 15 bp, Homo sapiens
actaggagacataaa

SEQ ID NO: 12296 - DNA, 15 bp, Homo sapiens
aactaggagacataa

SEQ ID NO: 12297 - DNA, 15 bp, Homo sapiens
caactaggagacata

SEQ ID NO: 12298 - DNA, 15 bp, Homo sapiens
gcaactaggagacat

SEQ ID NO: 12299 - DNA, 15 bp, Homo sapiens
agcaactaggagaca

SEQ ID NO: 12300 - DNA, 15 bp, Homo sapiens
aagcaactaggagac

SEQ ID NO: 12301 - DNA, 15 bp, Homo sapiens
gaagcaactaggaga

SEQ ID NO: 12302 - DNA, 15 bp, Homo sapiens
ggaagcaactaggag

SEQ ID NO: 12303 - DNA, 15 bp, Homo sapiens
aggaagcaactagga

SEQ ID NO: 12304 - DNA, 15 bp, Homo sapiens
caggaagcaactagg

SEQ ID NO: 12305 - DNA, 15 bp, Homo sapiens
acaggaagcaactag

SEQ ID NO: 12306 - DNA, 15 bp, Homo sapiens
cacaggaagcaacta

SEQ ID NO: 12307 - DNA, 15 bp, Homo sapiens
tcacaggaagcaact

SEQ ID NO: 12308 - DNA, 15 bp, Homo sapiens
gtcacaggaagcaac

SEQ ID NO: 12309 - DNA, 15 bp, Homo sapiens
tgtcacaggaagcaa

SEQ ID NO: 12310 - DNA, 15 bp, Homo sapiens
ttgtcacaggaagca

SEQ ID NO: 12311 - DNA, 15 bp, Homo sapiens
tttgtcacaggaagc

SEQ ID NO: 12312 - DNA, 15 bp, Homo sapiens
gtttgtcacaggaag

SEQ ID NO: 12313 - DNA, 15 bp, Homo sapiens
agtttgtcacaggaa

SEQ ID NO: 12314 - DNA, 15 bp, Homo sapiens
aagtttgtcacagga

SEQ ID NO: 12315 - DNA, 15 bp, Homo sapiens
aaagtttgtcacagg

SEQ ID NO: 12316 - DNA, 15 bp, Homo sapiens
taaagtttgtcacag

SEQ ID NO: 12317 - DNA, 15 bp, Homo sapiens
ttaaagtttgtcaca

SEQ ID NO: 12318 - DNA, 15 bp, Homo sapiens
tttaaagtttgtcac

SEQ ID NO: 12319 - DNA, 15 bp, Homo sapiens
ttttaaagtttgtca

SEQ ID NO: 12320 - DNA, 15 bp, Homo sapiens
cttttaaagtttgtc

SEQ ID NO: 12321 - DNA, 15 bp, Homo sapiens
gcttttaaagtttgt

SEQ ID NO: 12322 - DNA, 15 bp, Homo sapiens
agcttttaaagtttg

SEQ ID NO: 12323 - DNA, 15 bp, Homo sapiens
tagcttttaaagttt

SEQ ID NO: 12324 - DNA, 15 bp, Homo sapiens
gtagcttttaaagtt

SEQ ID NO: 12325 - DNA, 15 bp, Homo sapiens
tgtagcttttaaagt

SEQ ID NO: 12326 - DNA, 15 bp, Homo sapiens
atgtagcttttaaag

SEQ ID NO: 12327 - DNA, 15 bp, Homo sapiens
catgtagcttttaaa

SEQ ID NO: 12328 - DNA, 15 bp, Homo sapiens
acatgtagcttttaa

SEQ ID NO: 12329 - DNA, 15 bp, Homo sapiens
gacatgtagctttta

SEQ ID NO: 12330 - DNA, 15 bp, Homo sapiens
tgacatgtagctttt

SEQ ID NO: 12331 - DNA, 15 bp, Homo sapiens
atgacatgtagcttt

SEQ ID NO: 12332 - DNA, 15 bp, Homo sapiens
aatgacatgtagctt

SEQ ID NO: 12333 - DNA, 15 bp, Homo sapiens
aaatgacatgtagct

SEQ ID NO: 12334 - DNA, 15 bp, Homo sapiens
aaaatgacatgtagc

SEQ ID NO: 12335 - DNA, 15 bp, Homo sapiens
aaaaatgacatgtag

SEQ ID NO: 12336 - DNA, 15 bp, Homo sapiens
taaaaatgacatgta

SEQ ID NO: 12337 - DNA, 15 bp, Homo sapiens
ataaaaatgacatgt

SEQ ID NO: 12338 - DNA, 15 bp, Homo sapiens
aataaaaatgacatg

SEQ ID NO: 12339 - DNA, 15 bp, Homo sapiens
gaataaaaatgacat

SEQ ID NO: 12340 - DNA, 15 bp, Homo sapiens
agaataaaaatgaca

SEQ ID NO: 12341 - DNA, 15 bp, Homo sapiens
gagaataaaaatgac

SEQ ID NO: 12342 - DNA, 15 bp, Homo sapiens
ggagaataaaaatga

SEQ ID NO: 12343 - DNA, 15 bp, Homo sapiens
aggagaataaaaatg

SEQ ID NO: 12344 - DNA, 15 bp, Homo sapiens
aaggagaataaaaat

SEQ ID NO: 12345 - DNA, 15 bp, Homo sapiens
caaggagaataaaaa

SEQ ID NO: 12346 - DNA, 15 bp, Homo sapiens
ccaaggagaataaaa

SEQ ID NO: 12347 - DNA, 15 bp, Homo sapiens
cccaaggagaataaa

SEQ ID NO: 12348 - DNA, 15 bp, Homo sapiens
acccaaggagaataa

SEQ ID NO: 12349 - DNA, 15 bp, Homo sapiens
aacccaaggagaata

SEQ ID NO: 12350 - DNA, 15 bp, Homo sapiens
aaacccaaggagaat

SEQ ID NO: 12351 - DNA, 15 bp, Homo sapiens
aaaacccaaggagaa

SEQ ID NO: 12352 - DNA, 15 bp, Homo sapiens
aaaaacccaaggaga

SEQ ID NO: 12353 - DNA, 15 bp, Homo sapiens
aaaaaacccaaggag

SEQ ID NO: 12354 - DNA, 15 bp, Homo sapiens
aaaaaaacccaagga

SEQ ID NO: 12355 - DNA, 15 bp, Homo sapiens
caaaaaaacccaagg

SEQ ID NO: 12356 - DNA, 15 bp, Homo sapiens
ccaaaaaaacccaag

SEQ ID NO: 12357 - DNA, 15 bp, Homo sapiens
accaaaaaaacccaa

SEQ ID NO: 12358 - DNA, 15 bp, Homo sapiens
taccaaaaaaaccca

SEQ ID NO: 12359 - DNA, 15 bp, Homo sapiens
ctaccaaaaaaaccc

SEQ ID NO: 12360 - DNA, 15 bp, Homo sapiens
cctaccaaaaaaacc

SEQ ID NO: 12361 - DNA, 15 bp, Homo sapiens
acctaccaaaaaaac

SEQ ID NO: 12362 - DNA, 15 bp, Homo sapiens
aacctaccaaaaaaa

SEQ ID NO: 12363 - DNA, 15 bp, Homo sapiens
aaacctaccaaaaaa

SEQ ID NO: 12364 - DNA, 15 bp, Homo sapiens
taaacctaccaaaaa

SEQ ID NO: 12365 - DNA, 15 bp, Homo sapiens
ctaaacctaccaaaa

SEQ ID NO: 12366 - DNA, 15 bp, Homo sapiens
gctaaacctaccaaa

SEQ ID NO: 12367 - DNA, 15 bp, Homo sapiens
agctaaacctaccaa

SEQ ID NO: 12368 - DNA, 15 bp, Homo sapiens
tagctaaacctacca

SEQ ID NO: 12369 - DNA, 15 bp, Homo sapiens
atagctaaacctacc

SEQ ID NO: 12370 - DNA, 15 bp, Homo sapiens
tatagctaaacctac

SEQ ID NO: 12371 - DNA, 15 bp, Homo sapiens
ttatagctaaaccta

SEQ ID NO: 12372 - DNA, 15 bp, Homo sapiens
tttatagctaaacct

SEQ ID NO: 12373 - DNA, 15 bp, Homo sapiens
ttttatagctaaacc

SEQ ID NO: 12374 - DNA, 15 bp, Homo sapiens
tttttatagctaaac

SEQ ID NO: 12375 - DNA, 15 bp, Homo sapiens
atttttatagctaaa

SEQ ID NO: 12376 - DNA, 15 bp, Homo sapiens
aatttttatagctaa

SEQ ID NO: 12377 - DNA, 15 bp, Homo sapiens
caatttttatagcta

SEQ ID NO: 12378 - DNA, 15 bp, Homo sapiens
acaatttttatagct

SEQ ID NO: 12379 - DNA, 15 bp, Homo sapiens
aacaatttttatagc

SEQ ID NO: 12380 - DNA, 15 bp, Homo sapiens
aaacaatttttatag

SEQ ID NO: 12381 - DNA, 15 bp, Homo sapiens
gaaacaatttttata

SEQ ID NO: 12382 - DNA, 15 bp, Homo sapiens
ggaaacaatttttat

SEQ ID NO: 12383 - DNA, 15 bp, Homo sapiens
gggaaacaattttta

SEQ ID NO: 12384 - DNA, 15 bp, Homo sapiens
ggggaaacaattttt

SEQ ID NO: 12385 - DNA, 15 bp, Homo sapiens
aggggaaacaatttt

SEQ ID NO: 12386 - DNA, 15 bp, Homo sapiens
aaggggaaacaattt

SEQ ID NO: 12387 - DNA, 15 bp, Homo sapiens
gaaggggaaacaatt

SEQ ID NO: 12388 - DNA, 15 bp, Homo sapiens
tgaaggggaaacaat

SEQ ID NO: 12389 - DNA, 15 bp, Homo sapiens
ctgaaggggaaacaa

SEQ ID NO: 12390 - DNA, 15 bp, Homo sapiens
actgaaggggaaaca

SEQ ID NO: 12391 - DNA, 15 bp, Homo sapiens
cactgaaggggaaac

SEQ ID NO: 12392 - DNA, 15 bp, Homo sapiens
gcactgaaggggaaa

SEQ ID NO: 12393 - DNA, 15 bp, Homo sapiens
agcactgaaggggaa

SEQ ID NO: 12394 - DNA, 15 bp, Homo sapiens
aagcactgaagggga

SEQ ID NO: 12395 - DNA, 15 bp, Homo sapiens
taagcactgaagggg

SEQ ID NO: 12396 - DNA, 15 bp, Homo sapiens
gtaagcactgaaggg

SEQ ID NO: 12397 - DNA, 15 bp, Homo sapiens
agtaagcactgaagg

SEQ ID NO: 12398 - DNA, 15 bp, Homo sapiens
tagtaagcactgaag

SEQ ID NO: 12399 - DNA, 15 bp, Homo sapiens
gtagtaagcactgaa

SEQ ID NO: 12400 - DNA, 15 bp, Homo sapiens
tgtagtaagcactga

SEQ ID NO: 12401 - DNA, 15 bp, Homo sapiens
ctgtagtaagcactg

SEQ ID NO: 12402 - DNA, 15 bp, Homo sapiens
tctgtagtaagcact

SEQ ID NO: 12403 - DNA, 15 bp, Homo sapiens
gtctgtagtaagcac

SEQ ID NO: 12404 - DNA, 15 bp, Homo sapiens
agtctgtagtaagca

SEQ ID NO: 12405 - DNA, 15 bp, Homo sapiens
gagtctgtagtaagc

SEQ ID NO: 12406 - DNA, 15 bp, Homo sapiens
agagtctgtagtaag

SEQ ID NO: 12407 - DNA, 15 bp, Homo sapiens
cagagtctgtagtaa

SEQ ID NO: 12408 - DNA, 15 bp, Homo sapiens
tcagagtctgtagta

SEQ ID NO: 12409 - DNA, 15 bp, Homo sapiens
ctcagagtctgtagt

SEQ ID NO: 12410 - DNA, 15 bp, Homo sapiens
tctcagagtctgtag

SEQ ID NO: 12411 - DNA, 15 bp, Homo sapiens
gtctcagagtctgta

SEQ ID NO: 12412 - DNA, 15 bp, Homo sapiens
agtctcagagtctgt

SEQ ID NO: 12413 - DNA, 15 bp, Homo sapiens
aagtctcagagtctg

SEQ ID NO: 12414 - DNA, 15 bp, Homo sapiens
taagtctcagagtct

SEQ ID NO: 12415 - DNA, 15 bp, Homo sapiens
ttaagtctcagagtc

SEQ ID NO: 12416 - DNA, 15 bp, Homo sapiens
tttaagtctcagagt

SEQ ID NO: 12417 - DNA, 15 bp, Homo sapiens
ttttaagtctcagag

SEQ ID NO: 12418 - DNA, 15 bp, Homo sapiens
attttaagtctcaga

SEQ ID NO: 12419 - DNA, 15 bp, Homo sapiens
aattttaagtctcag

SEQ ID NO: 12420 - DNA, 15 bp, Homo sapiens
gaattttaagtctca

SEQ ID NO: 12421 - DNA, 15 bp, Homo sapiens
tgaattttaagtctc

SEQ ID NO: 12422 - DNA, 15 bp, Homo sapiens
atgaattttaagtct

SEQ ID NO: 12423 - DNA, 15 bp, Homo sapiens
catgaattttaagtc

SEQ ID NO: 12424 - DNA, 15 bp, Homo sapiens
acatgaattttaagt

SEQ ID NO: 12425 - DNA, 15 bp, Homo sapiens
aacatgaattttaag

SEQ ID NO: 12426 - DNA, 15 bp, Homo sapiens
taacatgaattttaa

SEQ ID NO: 12427 - DNA, 15 bp, Homo sapiens
ttaacatgaatttta

SEQ ID NO: 12428 - DNA, 15 bp, Homo sapiens
cttaacatgaatttt

SEQ ID NO: 12429 - DNA, 15 bp, Homo sapiens
acttaacatgaattt

SEQ ID NO: 12430 - DNA, 15 bp, Homo sapiens
cacttaacatgaatt

SEQ ID NO: 12431 - DNA, 15 bp, Homo sapiens
acacttaacatgaat

SEQ ID NO: 12432 - DNA, 15 bp, Homo sapiens
aacacttaacatgaa

SEQ ID NO: 12433 - DNA, 15 bp, Homo sapiens
caacacttaacatga

SEQ ID NO: 12434 - DNA, 15 bp, Homo sapiens
tcaacacttaacatg

SEQ ID NO: 12435 - DNA, 15 bp, Homo sapiens
atcaacacttaacat

SEQ ID NO: 12436 - DNA, 15 bp, Homo sapiens
gatcaacacttaaca

SEQ ID NO: 12437 - DNA, 15 bp, Homo sapiens
agatcaacacttaac

SEQ ID NO: 12438 - DNA, 15 bp, Homo sapiens
aagatcaacacttaa

SEQ ID NO: 12439 - DNA, 15 bp, Homo sapiens
aaagatcaacactta

SEQ ID NO: 12440 - DNA, 15 bp, Homo sapiens
aaaagatcaacactt

SEQ ID NO: 12441 - DNA, 15 bp, Homo sapiens
taaaagatcaacact

SEQ ID NO: 12442 - DNA, 15 bp, Homo sapiens
ctaaaagatcaacac

SEQ ID NO: 12443 - DNA, 15 bp, Homo sapiens
cctaaaagatcaaca

SEQ ID NO: 12444 - DNA, 15 bp, Homo sapiens
acctaaaagatcaac

SEQ ID NO: 12445 - DNA, 15 bp, Homo sapiens
tacctaaaagatcaa

SEQ ID NO: 12446 - DNA, 15 bp, Homo sapiens
atacctaaaagatca

SEQ ID NO: 12447 - DNA, 15 bp, Homo sapiens
aatacctaaaagatc

SEQ ID NO: 12448 - DNA, 15 bp, Homo sapiens
aaatacctaaaagat

SEQ ID NO: 12449 - DNA, 15 bp, Homo sapiens
caaatacctaaaaga

SEQ ID NO: 12450 - DNA, 15 bp, Homo sapiens
tcaaatacctaaaag

SEQ ID NO: 12451 - DNA, 15 bp, Homo sapiens
gtcaaatacctaaaa

SEQ ID NO: 12452 - DNA, 15 bp, Homo sapiens
cgtcaaatacctaaa

SEQ ID NO: 12453 - DNA, 15 bp, Homo sapiens
ccgtcaaatacctaa

SEQ ID NO: 12454 - DNA, 15 bp, Homo sapiens
tccgtcaaataccta

SEQ ID NO: 12455 - DNA, 15 bp, Homo sapiens
atccgtcaaatacct

SEQ ID NO: 12456 - DNA, 15 bp, Homo sapiens
tatccgtcaaatacc

SEQ ID NO: 12457 - DNA, 15 bp, Homo sapiens
atatccgtcaaatac

SEQ ID NO: 12458 - DNA, 15 bp, Homo sapiens
tatatccgtcaaata

SEQ ID NO: 12459 - DNA, 15 bp, Homo sapiens
ttatatccgtcaaat

SEQ ID NO: 12460 - DNA, 15 bp, Homo sapiens
attatatccgtcaaa

SEQ ID NO: 12461 - DNA, 15 bp, Homo sapiens
gattatatccgtcaa

SEQ ID NO: 12462 - DNA, 15 bp, Homo sapiens
tgattatatccgtca

SEQ ID NO: 12463 - DNA, 15 bp, Homo sapiens
gtgattatatccgtc

SEQ ID NO: 12464 - DNA, 15 bp, Homo sapiens
ggtgattatatccgt

SEQ ID NO: 12465 - DNA, 15 bp, Homo sapiens
gggtgattatatccg

SEQ ID NO: 12466 - DNA, 15 bp, Homo sapiens
ggggtgattatatcc

SEQ ID NO: 12467 - DNA, 15 bp, Homo sapiens
aggggtgattatatc

SEQ ID NO: 12468 - DNA, 15 bp, Homo sapiens
aaggggtgattatat

SEQ ID NO: 12469 - DNA, 15 bp, Homo sapiens
aaaggggtgattata

SEQ ID NO: 12470 - DNA, 15 bp, Homo sapiens
caaaggggtgattat

SEQ ID NO: 12471 - DNA, 15 bp, Homo sapiens
tcaaaggggtgatta

SEQ ID NO: 12472 - DNA, 15 bp, Homo sapiens
ctcaaaggggtgatt

SEQ ID NO: 12473 - DNA, 15 bp, Homo sapiens
cctcaaaggggtgat

SEQ ID NO: 12474 - DNA, 15 bp, Homo sapiens
tcctcaaaggggtga

SEQ ID NO: 12475 - DNA, 15 bp, Homo sapiens
gtcctcaaaggggtg

SEQ ID NO: 12476 - DNA, 15 bp, Homo sapiens
agtcctcaaaggggt

SEQ ID NO: 12477 - DNA, 15 bp, Homo sapiens
cagtcctcaaagggg

SEQ ID NO: 12478 - DNA, 15 bp, Homo sapiens
tcagtcctcaaaggg

SEQ ID NO: 12479 - DNA, 15 bp, Homo sapiens
ttcagtcctcaaagg

SEQ ID NO: 12480 - DNA, 15 bp, Homo sapiens
cttcagtcctcaaag

SEQ ID NO: 12481 - DNA, 15 bp, Homo sapiens
acttcagtcctcaaa

SEQ ID NO: 12482 - DNA, 15 bp, Homo sapiens
tacttcagtcctcaa

SEQ ID NO: 12483 - DNA, 15 bp, Homo sapiens
ctacttcagtcctca

SEQ ID NO: 12484 - DNA, 15 bp, Homo sapiens
tctacttcagtcctc

SEQ ID NO: 12485 - DNA, 15 bp, Homo sapiens
gtctacttcagtcct

SEQ ID NO: 12486 - DNA, 15 bp, Homo sapiens
ggtctacttcagtcc

SEQ ID NO: 12487 - DNA, 15 bp, Homo sapiens
aggtctacttcagtc

SEQ ID NO: 12488 - DNA, 15 bp, Homo sapiens
aaggtctacttcagt

SEQ ID NO: 12489 - DNA, 15 bp, Homo sapiens
aaaggtctacttcag

SEQ ID NO: 12490 - DNA, 15 bp, Homo sapiens
aaaaggtctacttca

SEQ ID NO: 12491 - DNA, 15 bp, Homo sapiens
aaaaaggtctacttc

SEQ ID NO: 12492 - DNA, 15 bp, Homo sapiens
aaaaaaggtctactt

SEQ ID NO: 12493 - DNA, 15 bp, Homo sapiens
aaaaaaaggtctact

SEQ ID NO: 12494 - DNA, 15 bp, Homo sapiens
aaaaaaaaggtctac

SEQ ID NO: 12495 - DNA, 15 bp, Homo sapiens
caaaaaaaaggtcta

SEQ ID NO: 12496 - DNA, 15 bp, Homo sapiens
acaaaaaaaaggtct

SEQ ID NO: 12497 - DNA, 15 bp, Homo sapiens
aacaaaaaaaaggtc

SEQ ID NO: 12498 - DNA, 15 bp, Homo sapiens
aaacaaaaaaaaggt

SEQ ID NO: 12499 - DNA, 15 bp, Homo sapiens
aaaacaaaaaaaagg

SEQ ID NO: 12500 - DNA, 15 bp, Homo sapiens
aaaaacaaaaaaaag

SEQ ID NO: 12501 - DNA, 15 bp, Homo sapiens
caaaaacaaaaaaaa

SEQ ID NO: 12502 - DNA, 15 bp, Homo sapiens
acaaaaacaaaaaaa

SEQ ID NO: 12503 - DNA, 15 bp, Homo sapiens
aacaaaaacaaaaaa

SEQ ID NO: 12504 - DNA, 15 bp, Homo sapiens
aaacaaaaacaaaaa

SEQ ID NO: 12505 - DNA, 15 bp, Homo sapiens
aaaacaaaaacaaaa

SEQ ID NO: 12506 - DNA, 15 bp, Homo sapiens
caaaacaaaaacaaa

SEQ ID NO: 12507 - DNA, 15 bp, Homo sapiens
tcaaaacaaaaacaa

SEQ ID NO: 12508 - DNA, 15 bp, Homo sapiens
ctcaaaacaaaaaca

SEQ ID NO: 12509 - DNA, 15 bp, Homo sapiens
tctcaaaacaaaaac

SEQ ID NO: 12510 - DNA, 15 bp, Homo sapiens
gtcggtctcaaaaca

SEQ ID NO: 12511 - DNA, 15 bp, Homo sapiens
agtcggtctcaaaac

SEQ ID NO: 12512 - DNA, 15 bp, Homo sapiens
gagtcggtctcaaaa

SEQ ID NO: 12513 - DNA, 15 bp, Homo sapiens
agagtcggtctcaaa

SEQ ID NO: 12514 - DNA, 15 bp, Homo sapiens
gagagtcggtctcaa

SEQ ID NO: 12515 - DNA, 15 bp, Homo sapiens
agagagtcggtctca

SEQ ID NO: 12516 - DNA, 15 bp, Homo sapiens
cagagagtcggtctc

SEQ ID NO: 12517 - DNA, 15 bp, Homo sapiens
acagagagtcggtct

SEQ ID NO: 12518 - DNA, 15 bp, Homo sapiens
gacagagagtcggtc

SEQ ID NO: 12519 - DNA, 15 bp, Homo sapiens
cgacagagagtcggt

SEQ ID NO: 12520 - DNA, 15 bp, Homo sapiens
gcgacagagagtcgg

SEQ ID NO: 12521 - DNA, 15 bp, Homo sapiens
ggcgacagagagtcg

SEQ ID NO: 12522 - DNA, 15 bp, Homo sapiens
gggcgacagagagtc

SEQ ID NO: 12523 - DNA, 15 bp, Homo sapiens
tgggcgacagagagt

SEQ ID NO: 12524 - DNA, 15 bp, Homo sapiens
ctgggcgacagagag

SEQ ID NO: 12525 - DNA, 15 bp, Homo sapiens
cctgggcgacagaga

SEQ ID NO: 12526 - DNA, 15 bp, Homo sapiens
tgcctgggcgacaga

SEQ ID NO: 12527 - DNA, 15 bp, Homo sapiens
ctgcctgggcgacag

SEQ ID NO: 12528 - DNA, 15 bp, Homo sapiens
cctgcctgggcgaca

SEQ ID NO: 12529 - DNA, 15 bp, Homo sapiens
tcctgcctgggcgac

SEQ ID NO: 12530 - DNA, 15 bp, Homo sapiens
ctcctgcctgggcga

SEQ ID NO: 12531 - DNA, 15 bp, Homo sapiens
actcctgcctgggcg

SEQ ID NO: 12532 - DNA, 15 bp, Homo sapiens
cactcctgcctgggc

SEQ ID NO: 12533 - DNA, 15 bp, Homo sapiens
gcactcctgcctggg

SEQ ID NO: 12534 - DNA, 15 bp, Homo sapiens
tgcactcctgcctgg

SEQ ID NO: 12535 - DNA, 15 bp, Homo sapiens
ctgcactcctgcctg

SEQ ID NO: 12536 - DNA, 15 bp, Homo sapiens
actgcactcctgcct

SEQ ID NO: 12537 - DNA, 15 bp, Homo sapiens
cactgcactcctgcc

SEQ ID NO: 12538 - DNA, 15 bp, Homo sapiens
ccactgcactcctgc

SEQ ID NO: 12539 - DNA, 15 bp, Homo sapiens
gccactgcactcctg

SEQ ID NO: 12540 - DNA, 15 bp, Homo sapiens
tgccactgcactcct

SEQ ID NO: 12541 - DNA, 15 bp, Homo sapiens
cggaggttgcagtga

SEQ ID NO: 12542 - DNA, 15 bp, Homo sapiens
gcggaggttgcagtg

SEQ ID NO: 12543 - DNA, 15 bp, Homo sapiens
ggcggaggttgcagt

SEQ ID NO: 12544 - DNA, 15 bp, Homo sapiens
aggcggaggttgcag

SEQ ID NO: 12545 - DNA, 15 bp, Homo sapiens
gaggcggaggttgca

SEQ ID NO: 12546 - DNA, 15 bp, Homo sapiens
ggaggcggaggttgc

SEQ ID NO: 12547 - DNA, 15 bp, Homo sapiens
gggaggcggaggttg

SEQ ID NO: 12548 - DNA, 15 bp, Homo sapiens
tgggaggcggaggtt

SEQ ID NO: 12549 - DNA, 15 bp, Homo sapiens
ctgggaggcggaggt

SEQ ID NO: 12550 - DNA, 15 bp, Homo sapiens
cctgggaggcggagg

SEQ ID NO: 12551 - DNA, 15 bp, Homo sapiens
acctgggaggcggag

SEQ ID NO: 12552 - DNA, 15 bp, Homo sapiens
aacctgggaggcgga

SEQ ID NO: 12553 - DNA, 15 bp, Homo sapiens
gaacctgggaggcgg

SEQ ID NO: 12554 - DNA, 15 bp, Homo sapiens
tgaacctgggaggcg

SEQ ID NO: 12555 - DNA, 15 bp, Homo sapiens
tgcttgaacctggga

SEQ ID NO: 12556 - DNA, 15 bp, Homo sapiens
ctgcttgaacctggg

SEQ ID NO: 12557 - DNA, 15 bp, Homo sapiens
actgcttgaacctgg

SEQ ID NO: 12558 - DNA, 15 bp, Homo sapiens
aactgcttgaacctg

SEQ ID NO: 12559 - DNA, 15 bp, Homo sapiens
gaactgcttgaacct

SEQ ID NO: 12560 - DNA, 15 bp, Homo sapiens
agaactgcttgaacc

SEQ ID NO: 12561 - DNA, 15 bp, Homo sapiens
cagaactgcttgaac

SEQ ID NO: 12562 - DNA, 15 bp, Homo sapiens
gcagaactgcttgaa

SEQ ID NO: 12563 - DNA, 15 bp, Homo sapiens
ggcagaactgcttga

SEQ ID NO: 12564 - DNA, 15 bp, Homo sapiens
aggcagaactgcttg

SEQ ID NO: 12565 - DNA, 15 bp, Homo sapiens
gaggcagaactgctt

SEQ ID NO: 12566 - DNA, 15 bp, Homo sapiens
tgaggcagaactgct

SEQ ID NO: 12567 - DNA, 15 bp, Homo sapiens
ctgaggcagaactgc

SEQ ID NO: 12568 - DNA, 15 bp, Homo sapiens
gctgaggcagaactg

SEQ ID NO: 12569 - DNA, 15 bp, Homo sapiens
ggctgaggcagaact

SEQ ID NO: 12570 - DNA, 15 bp, Homo sapiens
aggctgaggcagaac

SEQ ID NO: 12571 - DNA, 15 bp, Homo sapiens
aaggaggctgaggca

SEQ ID NO: 12572 - DNA, 15 bp, Homo sapiens
caaggaggctgaggc

SEQ ID NO: 12573 - DNA, 15 bp, Homo sapiens
tcaaggaggctgagg

SEQ ID NO: 12574 - DNA, 15 bp, Homo sapiens
ctcaaggaggctgag

SEQ ID NO: 12575 - DNA, 15 bp, Homo sapiens
actcaaggaggctga

SEQ ID NO: 12576 - DNA, 15 bp, Homo sapiens
tactcaaggaggctg

SEQ ID NO: 12577 - DNA, 15 bp, Homo sapiens
ctactcaaggaggct

SEQ ID NO: 12578 - DNA, 15 bp, Homo sapiens
gctactcaaggaggc

SEQ ID NO: 12579 - DNA, 15 bp, Homo sapiens
agctactcaaggagg

SEQ ID NO: 12580 - DNA, 15 bp, Homo sapiens
cagctactcaaggag

SEQ ID NO: 12581 - DNA, 15 bp, Homo sapiens
ccagctactcaagga

SEQ ID NO: 12582 - DNA, 15 bp, Homo sapiens
cccagctactcaagg

SEQ ID NO: 12583 - DNA, 15 bp, Homo sapiens
tcaggtgcctgtaat

SEQ ID NO: 12584 - DNA, 15 bp, Homo sapiens
gtcaggtgcctgtaa

SEQ ID NO: 12585 - DNA, 15 bp, Homo sapiens
tgtcaggtgcctgta

SEQ ID NO: 12586 - DNA, 15 bp, Homo sapiens
gtgtcaggtgcctgt

SEQ ID NO: 12587 - DNA, 15 bp, Homo sapiens
ggtgtcaggtgcctg

SEQ ID NO: 12588 - DNA, 15 bp, Homo sapiens
tggtgtcaggtgcct

SEQ ID NO: 12589 - DNA, 15 bp, Homo sapiens
gtggtgtcaggtgcc

SEQ ID NO: 12590 - DNA, 15 bp, Homo sapiens
tgtggtgtcaggtgc

SEQ ID NO: 12591 - DNA, 15 bp, Homo sapiens
gtgtggtgtcaggtg

SEQ ID NO: 12592 - DNA, 15 bp, Homo sapiens
ggtgtggtgtcaggt

SEQ ID NO: 12593 - DNA, 15 bp, Homo sapiens
gggtgtggtgtcagg

SEQ ID NO: 12594 - DNA, 15 bp, Homo sapiens
tgggtgtggtgtcag

SEQ ID NO: 12595 - DNA, 15 bp, Homo sapiens
ctgggtgtggtgtca

SEQ ID NO: 12596 - DNA, 15 bp, Homo sapiens
gctgggtgtggtgtc

SEQ ID NO: 12597 - DNA, 15 bp, Homo sapiens
agctgggtgtggtgt

SEQ ID NO: 12598 - DNA, 15 bp, Homo sapiens
tagctgggtgtggtg

SEQ ID NO: 12599 - DNA, 15 bp, Homo sapiens
ttagctgggtgtggt

SEQ ID NO: 12600 - DNA, 15 bp, Homo sapiens
attagctgggtgtgg

SEQ ID NO: 12601 - DNA, 15 bp, Homo sapiens
aattagctgggtgtg

SEQ ID NO: 12602 - DNA, 15 bp, Homo sapiens
aaattagctgggtgt

SEQ ID NO: 12603 - DNA, 15 bp, Homo sapiens
aaaattagctgggtg

SEQ ID NO: 12604 - DNA, 15 bp, Homo sapiens
aaaaattagctgggt

SEQ ID NO: 12605 - DNA, 15 bp, Homo sapiens
caaaaattagctggg

SEQ ID NO: 12606 - DNA, 15 bp, Homo sapiens
acaaaaattagctgg

SEQ ID NO: 12607 - DNA, 15 bp, Homo sapiens
tacaaaaattagctg

SEQ ID NO: 12608 - DNA, 15 bp, Homo sapiens
atacaaaaattagct

SEQ ID NO: 12609 - DNA, 15 bp, Homo sapiens
gatggtgaaaccccg

SEQ ID NO: 12610 - DNA, 15 bp, Homo sapiens
tgatggtgaaacccc

SEQ ID NO: 12611 - DNA, 15 bp, Homo sapiens
ctgatggtgaaaccc

SEQ ID NO: 12612 - DNA, 15 bp, Homo sapiens
cctgatggtgaaacc

SEQ ID NO: 12613 - DNA, 15 bp, Homo sapiens
gcctgatggtgaaac

SEQ ID NO: 12614 - DNA, 15 bp, Homo sapiens
agcctgatggtgaaa

SEQ ID NO: 12615 - DNA, 15 bp, Homo sapiens
cagcctgatggtgaa

SEQ ID NO: 12616 - DNA, 15 bp, Homo sapiens
ccagcctgatggtga

SEQ ID NO: 12617 - DNA, 15 bp, Homo sapiens
accagcctgatggtg

SEQ ID NO: 12618 - DNA, 15 bp, Homo sapiens
gaccagcctgatggt

SEQ ID NO: 12619 - DNA, 15 bp, Homo sapiens
agaccagcctgatgg

SEQ ID NO: 12620 - DNA, 15 bp, Homo sapiens
gagaccagcctgatg

SEQ ID NO: 12621 - DNA, 15 bp, Homo sapiens
tgagaccagcctgat

SEQ ID NO: 12622 - DNA, 15 bp, Homo sapiens
aggggtttgagacca

SEQ ID NO: 12623 - DNA, 15 bp, Homo sapiens
caggggtttgagacc

SEQ ID NO: 12624 - DNA, 15 bp, Homo sapiens
tcaggggtttgagac

SEQ ID NO: 12625 - DNA, 15 bp, Homo sapiens
gtcaggggtttgaga

SEQ ID NO: 12626 - DNA, 15 bp, Homo sapiens
ggtcaggggtttgag

SEQ ID NO: 12627 - DNA, 15 bp, Homo sapiens
aggtcaggggtttga

SEQ ID NO: 12628 - DNA, 15 bp, Homo sapiens
gaggtcaggggtttg

SEQ ID NO: 12629 - DNA, 15 bp, Homo sapiens
cgaggtcaggggttt

SEQ ID NO: 12630 - DNA, 15 bp, Homo sapiens
acgaggtcaggggtt

SEQ ID NO: 12631 - DNA, 15 bp, Homo sapiens
cacgaggtcaggggt

SEQ ID NO: 12632 - DNA, 15 bp, Homo sapiens
tcacgaggtcagggg

SEQ ID NO: 12633 - DNA, 15 bp, Homo sapiens
atcacgaggtcaggg

SEQ ID NO: 12634 - DNA, 15 bp, Homo sapiens
gatcacgaggtcagg

SEQ ID NO: 12635 - DNA, 15 bp, Homo sapiens
ggatcacgaggtcag

SEQ ID NO: 12636 - DNA, 15 bp, Homo sapiens
tggatcacgaggtca

SEQ ID NO: 12637 - DNA, 15 bp, Homo sapiens
gtggatcacgaggtc

SEQ ID NO: 12638 - DNA, 15 bp, Homo sapiens
ggtggatcacgaggt

SEQ ID NO: 12639 - DNA, 15 bp, Homo sapiens
gggtggatcacgagg

SEQ ID NO: 12640 - DNA, 15 bp, Homo sapiens
tgggtggatcacgag

SEQ ID NO: 12641 - DNA, 15 bp, Homo sapiens
gtgggtggatcacga

SEQ ID NO: 12642 - DNA, 15 bp, Homo sapiens
ggtgggtggatcacg

SEQ ID NO: 12643 - DNA, 15 bp, Homo sapiens
aggtgggtggatcac

SEQ ID NO: 12644 - DNA, 15 bp, Homo sapiens
gaggtgggtggatca

SEQ ID NO: 12645 - DNA, 15 bp, Homo sapiens
cgaggtgggtggatc

SEQ ID NO: 12646 - DNA, 15 bp, Homo sapiens
ccgaggtgggtggat

SEQ ID NO: 12647 - DNA, 15 bp, Homo sapiens
gccgaggtgggtgga

SEQ ID NO: 12648 - DNA, 15 bp, Homo sapiens
ggccgaggtgggtgg

SEQ ID NO: 12649 - DNA, 15 bp, Homo sapiens
aggccgaggtgggtg

SEQ ID NO: 12650 - DNA, 15 bp, Homo sapiens
gaggccgaggtgggt

SEQ ID NO: 12651 - DNA, 15 bp, Homo sapiens
ggaggccgaggtggg

SEQ ID NO: 12652 - DNA, 15 bp, Homo sapiens
gggaggccgaggtgg

SEQ ID NO: 12653 - DNA, 15 bp, Homo sapiens
tgggaggccgaggtg

SEQ ID NO: 12654 - DNA, 15 bp, Homo sapiens
ttgggaggccgaggt

SEQ ID NO: 12655 - DNA, 15 bp, Homo sapiens
tttgggaggccgagg

SEQ ID NO: 12656 - DNA, 15 bp, Homo sapiens
ggtggctcacacctg

SEQ ID NO: 12657 - DNA, 15 bp, Homo sapiens
tggtggctcacacct

SEQ ID NO: 12658 - DNA, 15 bp, Homo sapiens
gtggtggctcacacc

SEQ ID NO: 12659 - DNA, 15 bp, Homo sapiens
agtggtggctcacac

SEQ ID NO: 12660 - DNA, 15 bp, Homo sapiens
gagtggtggctcaca

SEQ ID NO: 12661 - DNA, 15 bp, Homo sapiens
ggagtggtggctcac

SEQ ID NO: 12662 - DNA, 15 bp, Homo sapiens
gggagtggtggctca

SEQ ID NO: 12663 - DNA, 15 bp, Homo sapiens
cgggagtggtggctc

SEQ ID NO: 12664 - DNA, 15 bp, Homo sapiens
ccgggagtggtggct

SEQ ID NO: 12665 - DNA, 15 bp, Homo sapiens
gccgggagtggtggc

SEQ ID NO: 12666 - DNA, 15 bp, Homo sapiens
ggccgggagtggtgg

SEQ ID NO: 12667 - DNA, 15 bp, Homo sapiens
aggccgggagtggtg

SEQ ID NO: 12668 - DNA, 15 bp, Homo sapiens
aaggccgggagtggt

SEQ ID NO: 12669 - DNA, 15 bp, Homo sapiens
aaaggccgggagtgg

SEQ ID NO: 12670 - DNA, 15 bp, Homo sapiens
aaaaggccgggagtg

SEQ ID NO: 12671 - DNA, 15 bp, Homo sapiens
aaaaaggccgggagt

SEQ ID NO: 12672 - DNA, 15 bp, Homo sapiens
aaaaaaggccgggag

SEQ ID NO: 12673 - DNA, 15 bp, Homo sapiens
aaaaaaaggccggga

SEQ ID NO: 12674 - DNA, 15 bp, Homo sapiens
aaaaaaaaggccggg

SEQ ID NO: 12675 - DNA, 15 bp, Homo sapiens
aaaaaaaaaggccgg

SEQ ID NO: 12676 - DNA, 15 bp, Homo sapiens
aaaaaaaaaaggccg

SEQ ID NO: 12677 - DNA, 15 bp, Homo sapiens
aaaaaaaaaaaggcc

SEQ ID NO: 12678 - DNA, 15 bp, Homo sapiens
aaaaaaaaaaaaggc

SEQ ID NO: 12679 - DNA, 15 bp, Homo sapiens
acaaaaaaaaaaaaa

SEQ ID NO: 12680 - DNA, 15 bp, Homo sapiens
aacaaaaaaaaaaaa

SEQ ID NO: 12681 - DNA, 15 bp, Homo sapiens
aaacaaaaaaaaaaa

SEQ ID NO: 12682 - DNA, 15 bp, Homo sapiens
caaacaaaaaaaaaa

SEQ ID NO: 12683 - DNA, 15 bp, Homo sapiens
acaaacaaaaaaaaa

SEQ ID NO: 12684 - DNA, 15 bp, Homo sapiens
aacaaacaaaaaaaa

SEQ ID NO: 12685 - DNA, 15 bp, Homo sapiens
aaacaaacaaaaaaa

SEQ ID NO: 12686 - DNA, 15 bp, Homo sapiens
caaacaaacaaacaa

SEQ ID NO: 12687 - DNA, 15 bp, Homo sapiens
acaaacaaacaaaca

SEQ ID NO: 12688 - DNA, 15 bp, Homo sapiens
aacaaacaaacaaac

SEQ ID NO: 12689 - DNA, 15 bp, Homo sapiens
aaaacaaacaaacaa

SEQ ID NO: 12690 - DNA, 15 bp, Homo sapiens
caaaacaaacaaaca

SEQ ID NO: 12691 - DNA, 15 bp, Homo sapiens
tcaaaacaaacaaac

SEQ ID NO: 12692 - DNA, 15 bp, Homo sapiens
gtcaaaacaaacaaa

SEQ ID NO: 12693 - DNA, 15 bp, Homo sapiens
ggtcaaaacaaacaa

SEQ ID NO: 12694 - DNA, 15 bp, Homo sapiens
cggtcaaaacaaaca

SEQ ID NO: 12695 - DNA, 15 bp, Homo sapiens
tcggtcaaaacaaac

SEQ ID NO: 12696 - DNA, 15 bp, Homo sapiens
gtcggtcaaaacaaa

SEQ ID NO: 12697 - DNA, 15 bp, Homo sapiens
agtcggtcaaaacaa

SEQ ID NO: 12698 - DNA, 15 bp, Homo sapiens
aagtcggtcaaaaca

SEQ ID NO: 12699 - DNA, 15 bp, Homo sapiens
aaagtcggtcaaaac

SEQ ID NO: 12700 - DNA, 15 bp, Homo sapiens
gaaagtcggtcaaaa

SEQ ID NO: 12701 - DNA, 15 bp, Homo sapiens
tgaaagtcggtcaaa

SEQ ID NO: 12702 - DNA, 15 bp, Homo sapiens
gtgaaagtcggtcaa

SEQ ID NO: 12703 - DNA, 15 bp, Homo sapiens
agtgaaagtcggtca

SEQ ID NO: 12704 - DNA, 15 bp, Homo sapiens
gagtgaaagtcggtc

SEQ ID NO: 12705 - DNA, 15 bp, Homo sapiens
agagtgaaagtcggt

SEQ ID NO: 12706 - DNA, 15 bp, Homo sapiens
aagagtgaaagtcgg

SEQ ID NO: 12707 - DNA, 15 bp, Homo sapiens
caagagtgaaagtcg

SEQ ID NO: 12708 - DNA, 15 bp, Homo sapiens
acaagagtgaaagtc

SEQ ID NO: 12709 - DNA, 15 bp, Homo sapiens
aacaagagtgaaagt

SEQ ID NO: 12710 - DNA, 15 bp, Homo sapiens
caacaagagtgaaag

SEQ ID NO: 12711 - DNA, 15 bp, Homo sapiens
gcaacaagagtgaaa

SEQ ID NO: 12712 - DNA, 15 bp, Homo sapiens
ggcaacaagagtgaa

SEQ ID NO: 12713 - DNA, 15 bp, Homo sapiens
tgggcaacaagagtg

SEQ ID NO: 12714 - DNA, 15 bp, Homo sapiens
ctgggcaacaagagt

SEQ ID NO: 12715 - DNA, 15 bp, Homo sapiens
tgcaccattgcactc

SEQ ID NO: 12716 - DNA, 15 bp, Homo sapiens
ctgcaccattgcact

SEQ ID NO: 12717 - DNA, 15 bp, Homo sapiens
actgcaccattgcac

SEQ ID NO: 12718 - DNA, 15 bp, Homo sapiens
gactgcaccattgca

SEQ ID NO: 12719 - DNA, 15 bp, Homo sapiens
agactgcaccattgc

SEQ ID NO: 12720 - DNA, 15 bp, Homo sapiens
aagactgcaccattg

SEQ ID NO: 12721 - DNA, 15 bp, Homo sapiens
caagactgcaccatt

SEQ ID NO: 12722 - DNA, 15 bp, Homo sapiens
ccaagactgcaccat

SEQ ID NO: 12723 - DNA, 15 bp, Homo sapiens
gccaagactgcacca

SEQ ID NO: 12724 - DNA, 15 bp, Homo sapiens
agccaagactgcacc

SEQ ID NO: 12725 - DNA, 15 bp, Homo sapiens
gagccaagactgcac

SEQ ID NO: 12726 - DNA, 15 bp, Homo sapiens
tgagccaagactgca

SEQ ID NO: 12727 - DNA, 15 bp, Homo sapiens
gtgagccaagactgc

SEQ ID NO: 12728 - DNA, 15 bp, Homo sapiens
agtgagccaagactg

SEQ ID NO: 12729 - DNA, 15 bp, Homo sapiens
cagtgagccaagact

SEQ ID NO: 12730 - DNA, 15 bp, Homo sapiens
gcagtgagccaagac

SEQ ID NO: 12731 - DNA, 15 bp, Homo sapiens
agtggaggttgcagt

SEQ ID NO: 12732 - DNA, 15 bp, Homo sapiens
aagtggaggttgcag

SEQ ID NO: 12733 - DNA, 15 bp, Homo sapiens
gaagtggaggttgca

SEQ ID NO: 12734 - DNA, 15 bp, Homo sapiens
ggaagtggaggttgc

SEQ ID NO: 12735 - DNA, 15 bp, Homo sapiens
gggaagtggaggttg

SEQ ID NO: 12736 - DNA, 15 bp, Homo sapiens
cgggaagtggaggtt

SEQ ID NO: 12737 - DNA, 15 bp, Homo sapiens
ccgggaagtggaggt

SEQ ID NO: 12738 - DNA, 15 bp, Homo sapiens
cccgggaagtggagg

SEQ ID NO: 12739 - DNA, 15 bp, Homo sapiens
tcccgggaagtggag

SEQ ID NO: 12740 - DNA, 15 bp, Homo sapiens
atcccgggaagtgga

SEQ ID NO: 12741 - DNA, 15 bp, Homo sapiens
gatcccgggaagtgg

SEQ ID NO: 12742 - DNA, 15 bp, Homo sapiens
tgatcccgggaagtg

SEQ ID NO: 12743 - DNA, 15 bp, Homo sapiens
ttgatcccgggaagt

SEQ ID NO: 12744 - DNA, 15 bp, Homo sapiens
cttgatcccgggaag

SEQ ID NO: 12745 - DNA, 15 bp, Homo sapiens
gcttgatcccgggaa

SEQ ID NO: 12746 - DNA, 15 bp, Homo sapiens
tgcttgatcccggga

SEQ ID NO: 12747 - DNA, 15 bp, Homo sapiens
ttgcttgatcccggg

SEQ ID NO: 12748 - DNA, 15 bp, Homo sapiens
attgcttgatcccgg

SEQ ID NO: 12749 - DNA, 15 bp, Homo sapiens
aattgcttgatcccg

SEQ ID NO: 12750 - DNA, 15 bp, Homo sapiens
gaattgcttgatccc

SEQ ID NO: 12751 - DNA, 15 bp, Homo sapiens
agaattgcttgatcc

SEQ ID NO: 12752 - DNA, 15 bp, Homo sapiens
gagaattgcttgatc

SEQ ID NO: 12753 - DNA, 15 bp, Homo sapiens
ggagaattgcttgat

SEQ ID NO: 12754 - DNA, 15 bp, Homo sapiens
caggagaattgcttg

SEQ ID NO: 12755 - DNA, 15 bp, Homo sapiens
gtgagacaggagaat

SEQ ID NO: 12756 - DNA, 15 bp, Homo sapiens
ggtgagacaggagaa

SEQ ID NO: 12757 - DNA, 15 bp, Homo sapiens
gggtgagacaggaga

SEQ ID NO: 12758 - DNA, 15 bp, Homo sapiens
agggtgagacaggag

SEQ ID NO: 12759 - DNA, 15 bp, Homo sapiens
gagggtgagacagga

SEQ ID NO: 12760 - DNA, 15 bp, Homo sapiens
ggagggtgagacagg

SEQ ID NO: 12761 - DNA, 15 bp, Homo sapiens
gggagggtgagacag

SEQ ID NO: 12762 - DNA, 15 bp, Homo sapiens
cgggagggtgagaca

SEQ ID NO: 12763 - DNA, 15 bp, Homo sapiens
ccgggagggtgagac

SEQ ID NO: 12764 - DNA, 15 bp, Homo sapiens
cccgggagggtgaga

SEQ ID NO: 12765 - DNA, 15 bp, Homo sapiens
acccgggagggtgag

SEQ ID NO: 12766 - DNA, 15 bp, Homo sapiens
tacccgggagggtga

SEQ ID NO: 12767 - DNA, 15 bp, Homo sapiens
ctacccgggagggtg

SEQ ID NO: 12768 - DNA, 15 bp, Homo sapiens
gctacccgggagggt

SEQ ID NO: 12769 - DNA, 15 bp, Homo sapiens
agctacccgggaggg

SEQ ID NO: 12770 - DNA, 15 bp, Homo sapiens
cagctacccgggagg

SEQ ID NO: 12771 - DNA, 15 bp, Homo sapiens
ccagctacccgggag

SEQ ID NO: 12772 - DNA, 15 bp, Homo sapiens
cccagctacccggga

SEQ ID NO: 12773 - DNA, 15 bp, Homo sapiens
tcccagctacccggg

SEQ ID NO: 12774 - DNA, 15 bp, Homo sapiens
atcccagctacccgg

SEQ ID NO: 12775 - DNA, 15 bp, Homo sapiens
aatcccagctacccg

SEQ ID NO: 12776 - DNA, 15 bp, Homo sapiens
taatcccagctaccc

SEQ ID NO: 12777 - DNA, 15 bp, Homo sapiens
gtaatcccagctacc

SEQ ID NO: 12778 - DNA, 15 bp, Homo sapiens
cgtgcctgtaatccc

SEQ ID NO: 12779 - DNA, 15 bp, Homo sapiens
acgtgcctgtaatcc

SEQ ID NO: 12780 - DNA, 15 bp, Homo sapiens
cacgtgcctgtaatc

SEQ ID NO: 12781 - DNA, 15 bp, Homo sapiens
gcacgtgcctgtaat

SEQ ID NO: 12782 - DNA, 15 bp, Homo sapiens
ggcacgtgcctgtaa

SEQ ID NO: 12783 - DNA, 15 bp, Homo sapiens
tggcacgtgcctgta

SEQ ID NO: 12784 - DNA, 15 bp, Homo sapiens
gtggcacgtgcctgt

SEQ ID NO: 12785 - DNA, 15 bp, Homo sapiens
ggtggcacgtgcctg

SEQ ID NO: 12786 - DNA, 15 bp, Homo sapiens
tggtggcacgtgcct

SEQ ID NO: 12787 - DNA, 15 bp, Homo sapiens
atggtggcacgtgcc

SEQ ID NO: 12788 - DNA, 15 bp, Homo sapiens
catggtggcacgtgc

SEQ ID NO: 12789 - DNA, 15 bp, Homo sapiens
gcatggtggcacgtg

SEQ ID NO: 12790 - DNA, 15 bp, Homo sapiens
ggcatggtggcacgt

SEQ ID NO: 12791 - DNA, 15 bp, Homo sapiens
gggcatggtggcacg

SEQ ID NO: 12792 - DNA, 15 bp, Homo sapiens
gctgggcatggtggc

SEQ ID NO: 12793 - DNA, 15 bp, Homo sapiens
agctgggcatggtgg

SEQ ID NO: 12794 - DNA, 15 bp, Homo sapiens
tagctgggcatggtg

SEQ ID NO: 12795 - DNA, 15 bp, Homo sapiens
ttagctgggcatggt

SEQ ID NO: 12796 - DNA, 15 bp, Homo sapiens
gttagctgggcatgg

SEQ ID NO: 12797 - DNA, 15 bp, Homo sapiens
agttagctgggcatg

SEQ ID NO: 12798 - DNA, 15 bp, Homo sapiens
aagttagctgggcat

SEQ ID NO: 12799 - DNA, 15 bp, Homo sapiens
taagttagctgggca

SEQ ID NO: 12800 - DNA, 15 bp, Homo sapiens
gtaagttagctgggc

SEQ ID NO: 12801 - DNA, 15 bp, Homo sapiens
agtaagttagctggg

SEQ ID NO: 12802 - DNA, 15 bp, Homo sapiens
aagtaagttagctgg

SEQ ID NO: 12803 - DNA, 15 bp, Homo sapiens
taagtaagttagctg

SEQ ID NO: 12804 - DNA, 15 bp, Homo sapiens
gtaagtaagttagct

SEQ ID NO: 12805 - DNA, 15 bp, Homo sapiens
agtaagtaagttagc

SEQ ID NO: 12806 - DNA, 15 bp, Homo sapiens
aagtaagtaagttag

SEQ ID NO: 12807 - DNA, 15 bp, Homo sapiens
aaagtaagtaagtta

SEQ ID NO: 12808 - DNA, 15 bp, Homo sapiens
aaaagtaagtaagtt

SEQ ID NO: 12809 - DNA, 15 bp, Homo sapiens
taaaagtaagtaagt

SEQ ID NO: 12810 - DNA, 15 bp, Homo sapiens
ttaaaagtaagtaag

SEQ ID NO: 12811 - DNA, 15 bp, Homo sapiens
attaaaagtaagtaa

SEQ ID NO: 12812 - DNA, 15 bp, Homo sapiens
tattaaaagtaagta

SEQ ID NO: 12813 - DNA, 15 bp, Homo sapiens
ctattaaaagtaagt

SEQ ID NO: 12814 - DNA, 15 bp, Homo sapiens
tctattaaaagtaag

SEQ ID NO: 12815 - DNA, 15 bp, Homo sapiens
ctctattaaaagtaa

SEQ ID NO: 12816 - DNA, 15 bp, Homo sapiens
tctctattaaaagta

SEQ ID NO: 12817 - DNA, 15 bp, Homo sapiens
atctctattaaaagt

SEQ ID NO: 12818 - DNA, 15 bp, Homo sapiens
catctctattaaaag

SEQ ID NO: 12819 - DNA, 15 bp, Homo sapiens
ccatctctattaaaa

SEQ ID NO: 12820 - DNA, 15 bp, Homo sapiens
cccatctctattaaa

SEQ ID NO: 12821 - DNA, 15 bp, Homo sapiens
ccccatctctattaa

SEQ ID NO: 12822 - DNA, 15 bp, Homo sapiens
accccatctctatta

SEQ ID NO: 12823 - DNA, 15 bp, Homo sapiens
aaccccatctctatt

SEQ ID NO: 12824 - DNA, 15 bp, Homo sapiens
aaaccccatctctat

SEQ ID NO: 12825 - DNA, 15 bp, Homo sapiens
atgaaaccccatctc

SEQ ID NO: 12826 - DNA, 15 bp, Homo sapiens
aatgaaaccccatct

SEQ ID NO: 12827 - DNA, 15 bp, Homo sapiens
aaatgaaaccccatc

SEQ ID NO: 12828 - DNA, 15 bp, Homo sapiens
aaaatgaaaccccat

SEQ ID NO: 12829 - DNA, 15 bp, Homo sapiens
caaaatgaaacccca

SEQ ID NO: 12830 - DNA, 15 bp, Homo sapiens
acaaaatgaaacccc

SEQ ID NO: 12831 - DNA, 15 bp, Homo sapiens
aacaaaatgaaaccc

SEQ ID NO: 12832 - DNA, 15 bp, Homo sapiens
caacaaaatgaaacc

SEQ ID NO: 12833 - DNA, 15 bp, Homo sapiens
ccaacaaaatgaaac

SEQ ID NO: 12834 - DNA, 15 bp, Homo sapiens
accaacaaaatgaaa

SEQ ID NO: 12835 - DNA, 15 bp, Homo sapiens
gaccaacaaaatgaa

SEQ ID NO: 12836 - DNA, 15 bp, Homo sapiens
tgaccaacaaaatga

SEQ ID NO: 12837 - DNA, 15 bp, Homo sapiens
ctgaccaacaaaatg

SEQ ID NO: 12838 - DNA, 15 bp, Homo sapiens
cctgaccaacaaaat

SEQ ID NO: 12839 - DNA, 15 bp, Homo sapiens
gcctgaccaacaaaa

SEQ ID NO: 12840 - DNA, 15 bp, Homo sapiens
agcctgaccaacaaa

SEQ ID NO: 12841 - DNA, 15 bp, Homo sapiens
cagcctgaccaacaa

SEQ ID NO: 12842 - DNA, 15 bp, Homo sapiens
tctgaggtcaggagt

SEQ ID NO: 12843 - DNA, 15 bp, Homo sapiens
atctgaggtcaggag

SEQ ID NO: 12844 - DNA, 15 bp, Homo sapiens
catctgaggtcagga

SEQ ID NO: 12845 - DNA, 15 bp, Homo sapiens
tcatctgaggtcagg

SEQ ID NO: 12846 - DNA, 15 bp, Homo sapiens
atcatctgaggtcag

SEQ ID NO: 12847 - DNA, 15 bp, Homo sapiens
aatcatctgaggtca

SEQ ID NO: 12848 - DNA, 15 bp, Homo sapiens
gaatcatctgaggtc

SEQ ID NO: 12849 - DNA, 15 bp, Homo sapiens
ggaatcatctgaggt

SEQ ID NO: 12850 - DNA, 15 bp, Homo sapiens
gggaatcatctgagg

SEQ ID NO: 12851 - DNA, 15 bp, Homo sapiens
ggggaatcatctgag

SEQ ID NO: 12852 - DNA, 15 bp, Homo sapiens
gggggaatcatctga

SEQ ID NO: 12853 - DNA, 15 bp, Homo sapiens
agggggaatcatctg

SEQ ID NO: 12854 - DNA, 15 bp, Homo sapiens
cagggggaatcatct

SEQ ID NO: 12855 - DNA, 15 bp, Homo sapiens
gcagggggaatcatc

SEQ ID NO: 12856 - DNA, 15 bp, Homo sapiens
ggcagggggaatcat

SEQ ID NO: 12857 - DNA, 15 bp, Homo sapiens
aggcagggggaatca

SEQ ID NO: 12858 - DNA, 15 bp, Homo sapiens
aaggcagggggaatc

SEQ ID NO: 12859 - DNA, 15 bp, Homo sapiens
caaggcagggggaat

SEQ ID NO: 12860 - DNA, 15 bp, Homo sapiens
ccaaggcagggggaa

SEQ ID NO: 12861 - DNA, 15 bp, Homo sapiens
gccaaggcaggggga

SEQ ID NO: 12862 - DNA, 15 bp, Homo sapiens
ggccaaggcaggggg

SEQ ID NO: 12863 - DNA, 15 bp, Homo sapiens
aggccaaggcagggg

SEQ ID NO: 12864 - DNA, 15 bp, Homo sapiens
gaggccaaggcaggg

SEQ ID NO: 12865 - DNA, 15 bp, Homo sapiens
tagcactttgggagg

SEQ ID NO: 12866 - DNA, 15 bp, Homo sapiens
ctagcactttgggag

SEQ ID NO: 12867 - DNA, 15 bp, Homo sapiens
cctagcactttggga

SEQ ID NO: 12868 - DNA, 15 bp, Homo sapiens
tcctagcactttggg

SEQ ID NO: 12869 - DNA, 15 bp, Homo sapiens
atcctagcactttgg

SEQ ID NO: 12870 - DNA, 15 bp, Homo sapiens
aatcctagcactttg

SEQ ID NO: 12871 - DNA, 15 bp, Homo sapiens
taatcctagcacttt

SEQ ID NO: 12872 - DNA, 15 bp, Homo sapiens
gtaatcctagcactt

SEQ ID NO: 12873 - DNA, 15 bp, Homo sapiens
tgtaatcctagcact

SEQ ID NO: 12874 - DNA, 15 bp, Homo sapiens
atgtaatcctagcac

SEQ ID NO: 12875 - DNA, 15 bp, Homo sapiens
catgtaatcctagca

SEQ ID NO: 12876 - DNA, 15 bp, Homo sapiens
gcatgtaatcctagc

SEQ ID NO: 12877 - DNA, 15 bp, Homo sapiens
cgcatgtaatcctag

SEQ ID NO: 12878 - DNA, 15 bp, Homo sapiens
acgcatgtaatccta

SEQ ID NO: 12879 - DNA, 15 bp, Homo sapiens
cacgcatgtaatcct

SEQ ID NO: 12880 - DNA, 15 bp, Homo sapiens
tcacgcatgtaatcc

SEQ ID NO: 12881 - DNA, 15 bp, Homo sapiens
ctcacgcatgtaatc

SEQ ID NO: 12882 - DNA, 15 bp, Homo sapiens
gctcacgcatgtaat

SEQ ID NO: 12883 - DNA, 15 bp, Homo sapiens
ggctcacgcatgtaa

SEQ ID NO: 12884 - DNA, 15 bp, Homo sapiens
tggctcacgcatgta

SEQ ID NO: 12885 - DNA, 15 bp, Homo sapiens
gtggctcacgcatgt

SEQ ID NO: 12886 - DNA, 15 bp, Homo sapiens
ggtggctcacgcatg

SEQ ID NO: 12887 - DNA, 15 bp, Homo sapiens
tggtggctcacgcat

SEQ ID NO: 12888 - DNA, 15 bp, Homo sapiens
gtggtggctcacgca

SEQ ID NO: 12889 - DNA, 15 bp, Homo sapiens
cgtggtggctcacgc

SEQ ID NO: 12890 - DNA, 15 bp, Homo sapiens
gcgtggtggctcacg

SEQ ID NO: 12891 - DNA, 15 bp, Homo sapiens
ggcgtggtggctcac

SEQ ID NO: 12892 - DNA, 15 bp, Homo sapiens
gggcgtggtggctca

SEQ ID NO: 12893 - DNA, 15 bp, Homo sapiens
cgggcgtggtggctc

SEQ ID NO: 12894 - DNA, 15 bp, Homo sapiens
tcgggcgtggtggct

SEQ ID NO: 12895 - DNA, 15 bp, Homo sapiens
gtcgggcgtggtggc

SEQ ID NO: 12896 - DNA, 15 bp, Homo sapiens
tgtcgggcgtggtgg

SEQ ID NO: 12897 - DNA, 15 bp, Homo sapiens
gtgtcgggcgtggtg

SEQ ID NO: 12898 - DNA, 15 bp, Homo sapiens
tgtgtcgggcgtggt

SEQ ID NO: 12899 - DNA, 15 bp, Homo sapiens
atgtgtcgggcgtgg

SEQ ID NO: 12900 - DNA, 15 bp, Homo sapiens
gatgtgtcgggcgtg

SEQ ID NO: 12901 - DNA, 15 bp, Homo sapiens
agatgtgtcgggcgt

SEQ ID NO: 12902 - DNA, 15 bp, Homo sapiens
aagatgtgtcgggcg

SEQ ID NO: 12903 - DNA, 15 bp, Homo sapiens
taagatgtgtcgggc

SEQ ID NO: 12904 - DNA, 15 bp, Homo sapiens
ataagatgtgtcggg

SEQ ID NO: 12905 - DNA, 15 bp, Homo sapiens
tataagatgtgtcgg

SEQ ID NO: 12906 - DNA, 15 bp, Homo sapiens
ttataagatgtgtcg

SEQ ID NO: 12907 - DNA, 15 bp, Homo sapiens
tttataagatgtgtc

SEQ ID NO: 12908 - DNA, 15 bp, Homo sapiens
gtttataagatgtgt

SEQ ID NO: 12909 - DNA, 15 bp, Homo sapiens
tgtttataagatgtg

SEQ ID NO: 12910 - DNA, 15 bp, Homo sapiens
atgtttataagatgt

SEQ ID NO: 12911 - DNA, 15 bp, Homo sapiens
tatgtttataagatg

SEQ ID NO: 12912 - DNA, 15 bp, Homo sapiens
gtatgtttataagat

SEQ ID NO: 12913 - DNA, 15 bp, Homo sapiens
agtatgtttataaga

SEQ ID NO: 12914 - DNA, 15 bp, Homo sapiens
aagtatgtttataag

SEQ ID NO: 12915 - DNA, 15 bp, Homo sapiens
taagtatgtttataa

SEQ ID NO: 12916 - DNA, 15 bp, Homo sapiens
ctaagtatgtttata

SEQ ID NO: 12917 - DNA, 15 bp, Homo sapiens
actaagtatgtttat

SEQ ID NO: 12918 - DNA, 15 bp, Homo sapiens
gactaagtatgttta

SEQ ID NO: 12919 - DNA, 15 bp, Homo sapiens
ggactaagtatgttt

SEQ ID NO: 12920 - DNA, 15 bp, Homo sapiens
aggactaagtatgtt

SEQ ID NO: 12921 - DNA, 15 bp, Homo sapiens
caggactaagtatgt

SEQ ID NO: 12922 - DNA, 15 bp, Homo sapiens
acaggactaagtatg

SEQ ID NO: 12923 - DNA, 15 bp, Homo sapiens
aacaggactaagtat

SEQ ID NO: 12924 - DNA, 15 bp, Homo sapiens
caacaggactaagta

SEQ ID NO: 12925 - DNA, 15 bp, Homo sapiens
tcaacaggactaagt

SEQ ID NO: 12926 - DNA, 15 bp, Homo sapiens
ttcaacaggactaag

SEQ ID NO: 12927 - DNA, 15 bp, Homo sapiens
tttcaacaggactaa

SEQ ID NO: 12928 - DNA, 15 bp, Homo sapiens
atttcaacaggacta

SEQ ID NO: 12929 - DNA, 15 bp, Homo sapiens
aatttcaacaggact

SEQ ID NO: 12930 - DNA, 15 bp, Homo sapiens
caatttcaacaggac

SEQ ID NO: 12931 - DNA, 15 bp, Homo sapiens
acaatttcaacagga

SEQ ID NO: 12932 - DNA, 15 bp, Homo sapiens
tacaatttcaacagg

SEQ ID NO: 12933 - DNA, 15 bp, Homo sapiens
ttacaatttcaacag

SEQ ID NO: 12934 - DNA, 15 bp, Homo sapiens
tttacaatttcaaca

SEQ ID NO: 12935 - DNA, 15 bp, Homo sapiens
gtttacaatttcaac

SEQ ID NO: 12936 - DNA, 15 bp, Homo sapiens
agtttacaatttcaa

SEQ ID NO: 12937 - DNA, 15 bp, Homo sapiens
aagtttacaatttca

SEQ ID NO: 12938 - DNA, 15 bp, Homo sapiens
gaagtttacaatttc

SEQ ID NO: 12939 - DNA, 15 bp, Homo sapiens
agaagtttacaattt

SEQ ID NO: 12940 - DNA, 15 bp, Homo sapiens
tagaagtttacaatt

SEQ ID NO: 12941 - DNA, 15 bp, Homo sapiens
ttagaagtttacaat

SEQ ID NO: 12942 - DNA, 15 bp, Homo sapiens
attagaagtttacaa

SEQ ID NO: 12943 - DNA, 15 bp, Homo sapiens
gattagaagtttaca

SEQ ID NO: 12944 - DNA, 15 bp, Homo sapiens
agattagaagtttac

SEQ ID NO: 12945 - DNA, 15 bp, Homo sapiens
aagattagaagttta

SEQ ID NO: 12946 - DNA, 15 bp, Homo sapiens
aaagattagaagttt

SEQ ID NO: 12947 - DNA, 15 bp, Homo sapiens
taaagattagaagtt

SEQ ID NO: 12948 - DNA, 15 bp, Homo sapiens
gtaaagattagaagt

SEQ ID NO: 12949 - DNA, 15 bp, Homo sapiens
ggtaaagattagaag

SEQ ID NO: 12950 - DNA, 15 bp, Homo sapiens
tggtaaagattagaa

SEQ ID NO: 12951 - DNA, 15 bp, Homo sapiens
ttggtaaagattaga

SEQ ID NO: 12952 - DNA, 15 bp, Homo sapiens
attggtaaagattag

SEQ ID NO: 12953 - DNA, 15 bp, Homo sapiens
tattggtaaagatta

SEQ ID NO: 12954 - DNA, 15 bp, Homo sapiens
ttattggtaaagatt

SEQ ID NO: 12955 - DNA, 15 bp, Homo sapiens
tttattggtaaagat

SEQ ID NO: 12956 - DNA, 15 bp, Homo sapiens
atttattggtaaaga

SEQ ID NO: 12957 - DNA, 15 bp, Homo sapiens
catttattggtaaag

SEQ ID NO: 12958 - DNA, 15 bp, Homo sapiens
acatttattggtaaa

SEQ ID NO: 12959 - DNA, 15 bp, Homo sapiens
aacatttattggtaa

SEQ ID NO: 12960 - DNA, 15 bp, Homo sapiens
taacatttattggta

SEQ ID NO: 12961 - DNA, 15 bp, Homo sapiens
ttaacatttattggt

SEQ ID NO: 12962 - DNA, 15 bp, Homo sapiens
gttaacatttattgg

SEQ ID NO: 12963 - DNA, 15 bp, Homo sapiens
cgttaacatttattg

SEQ ID NO: 12964 - DNA, 15 bp, Homo sapiens
tcgttaacatttatt

SEQ ID NO: 12965 - DNA, 15 bp, Homo sapiens
atcgttaacatttat

SEQ ID NO: 12966 - DNA, 15 bp, Homo sapiens
gatcgttaacattta

SEQ ID NO: 12967 - DNA, 15 bp, Homo sapiens
agatcgttaacattt

SEQ ID NO: 12968 - DNA, 15 bp, Homo sapiens
aagatcgttaacatt

SEQ ID NO: 12969 - DNA, 15 bp, Homo sapiens
aaagatcgttaacat

SEQ ID NO: 12970 - DNA, 15 bp, Homo sapiens
taaagatcgttaaca

SEQ ID NO: 12971 - DNA, 15 bp, Homo sapiens
ataaagatcgttaac

SEQ ID NO: 12972 - DNA, 15 bp, Homo sapiens
cataaagatcgttaa

SEQ ID NO: 12973 - DNA, 15 bp, Homo sapiens
acataaagatcgtta

SEQ ID NO: 12974 - DNA, 15 bp, Homo sapiens
cacataaagatcgtt

SEQ ID NO: 12975 - DNA, 15 bp, Homo sapiens
ccacataaagatcgt

SEQ ID NO: 12976 - DNA, 15 bp, Homo sapiens
accacataaagatcg

SEQ ID NO: 12977 - DNA, 15 bp, Homo sapiens
taccacataaagatc

SEQ ID NO: 12978 - DNA, 15 bp, Homo sapiens
ctaccacataaagat

SEQ ID NO: 12979 - DNA, 15 bp, Homo sapiens
cctaccacataaaga

SEQ ID NO: 12980 - DNA, 15 bp, Homo sapiens
acctaccacataaag

SEQ ID NO: 12981 - DNA, 15 bp, Homo sapiens
aacctaccacataaa

SEQ ID NO: 12982 - DNA, 15 bp, Homo sapiens
gaacctaccacataa

SEQ ID NO: 12983 - DNA, 15 bp, Homo sapiens
tgaacctaccacata

SEQ ID NO: 12984 - DNA, 15 bp, Homo sapiens
atgaacctaccacat

SEQ ID NO: 12985 - DNA, 15 bp, Homo sapiens
tatgaacctaccaca

SEQ ID NO: 12986 - DNA, 15 bp, Homo sapiens
ctatgaacctaccac

SEQ ID NO: 12987 - DNA, 15 bp, Homo sapiens
tctatgaacctacca

SEQ ID NO: 12988 - DNA, 15 bp, Homo sapiens
ttctatgaacctacc

SEQ ID NO: 12989 - DNA, 15 bp, Homo sapiens
tttctatgaacctac

SEQ ID NO: 12990 - DNA, 15 bp, Homo sapiens
ctttctatgaaccta

SEQ ID NO: 12991 - DNA, 15 bp, Homo sapiens
tctttctatgaacct

SEQ ID NO: 12992 - DNA, 15 bp, Homo sapiens
atctttctatgaacc

SEQ ID NO: 12993 - DNA, 15 bp, Homo sapiens
catctttctatgaac

SEQ ID NO: 12994 - DNA, 15 bp, Homo sapiens
ccatctttctatgaa

SEQ ID NO: 12995 - DNA, 15 bp, Homo sapiens
gccatctttctatga

SEQ ID NO: 12996 - DNA, 15 bp, Homo sapiens
ggccatctttctatg

SEQ ID NO: 12997 - DNA, 15 bp, Homo sapiens
aggccatctttctat

SEQ ID NO: 12998 - DNA, 15 bp, Homo sapiens
taggccatctttcta

SEQ ID NO: 12999 - DNA, 15 bp, Homo sapiens
gtaggccatctttct

SEQ ID NO: 13000 - DNA, 15 bp, Homo sapiens
agtaggccatctttc

SEQ ID NO: 13001 - DNA, 15 bp, Homo sapiens
aagtaggccatcttt

SEQ ID NO: 13002 - DNA, 15 bp, Homo sapiens
taagtaggccatctt

SEQ ID NO: 13003 - DNA, 15 bp, Homo sapiens
ctaagtaggccatct

SEQ ID NO: 13004 - DNA, 15 bp, Homo sapiens
tctaagtaggccatc

SEQ ID NO: 13005 - DNA, 15 bp, Homo sapiens
ctctaagtaggccat

SEQ ID NO: 13006 - DNA, 15 bp, Homo sapiens
tctctaagtaggcca

SEQ ID NO: 13007 - DNA, 15 bp, Homo sapiens
atctctaagtaggcc

SEQ ID NO: 13008 - DNA, 15 bp, Homo sapiens
aatctctaagtaggc

SEQ ID NO: 13009 - DNA, 15 bp, Homo sapiens
aaatctctaagtagg

SEQ ID NO: 13010 - DNA, 15 bp, Homo sapiens
caaatctctaagtag

SEQ ID NO: 13011 - DNA, 15 bp, Homo sapiens
acaaatctctaagta

SEQ ID NO: 13012 - DNA, 15 bp, Homo sapiens
tacaaatctctaagt

SEQ ID NO: 13013 - DNA, 15 bp, Homo sapiens
ttacaaatctctaag

SEQ ID NO: 13014 - DNA, 15 bp, Homo sapiens
attacaaatctctaa

SEQ ID NO: 13015 - DNA, 15 bp, Homo sapiens
aattacaaatctcta

SEQ ID NO: 13016 - DNA, 15 bp, Homo sapiens
caattacaaatctct

SEQ ID NO: 13017 - DNA, 15 bp, Homo sapiens
acaattacaaatctc

SEQ ID NO: 13018 - DNA, 15 bp, Homo sapiens
cacaattacaaatct

SEQ ID NO: 13019 - DNA, 15 bp, Homo sapiens
gcacaattacaaatc

SEQ ID NO: 13020 - DNA, 15 bp, Homo sapiens
ggcacaattacaaat

SEQ ID NO: 13021 - DNA, 15 bp, Homo sapiens
tggcacaattacaaa

SEQ ID NO: 13022 - DNA, 15 bp, Homo sapiens
atggcacaattacaa

SEQ ID NO: 13023 - DNA, 15 bp, Homo sapiens
tatggcacaattaca

SEQ ID NO: 13024 - DNA, 15 bp, Homo sapiens
atatggcacaattac

SEQ ID NO: 13025 - DNA, 15 bp, Homo sapiens
tatatggcacaatta

SEQ ID NO: 13026 - DNA, 15 bp, Homo sapiens
atatatggcacaatt

SEQ ID NO: 13027 - DNA, 15 bp, Homo sapiens
tatatatggcacaat

SEQ ID NO: 13028 - DNA, 15 bp, Homo sapiens
atatatatggcacaa

SEQ ID NO: 13029 - DNA, 15 bp, Homo sapiens
catatatatggcaca

SEQ ID NO: 13030 - DNA, 15 bp, Homo sapiens
acatatatatggcac

SEQ ID NO: 13031 - DNA, 15 bp, Homo sapiens
cacatatatatggca

SEQ ID NO: 13032 - DNA, 15 bp, Homo sapiens
acacatatatatggc

SEQ ID NO: 13033 - DNA, 15 bp, Homo sapiens
cacacatatatatgg

SEQ ID NO: 13034 - DNA, 15 bp, Homo sapiens
acacacatatatatg

SEQ ID NO: 13035 - DNA, 15 bp, Homo sapiens
cacacacatatatat

SEQ ID NO: 13036 - DNA, 15 bp, Homo sapiens
acacacacatatata

SEQ ID NO: 13037 - DNA, 15 bp, Homo sapiens
cacacacacatatat

SEQ ID NO: 13038 - DNA, 15 bp, Homo sapiens
acacacacacatata

SEQ ID NO: 13039 - DNA, 15 bp, Homo sapiens
cacacacacacatat

SEQ ID NO: 13040 - DNA, 15 bp, Homo sapiens
acacacacacacata

SEQ ID NO: 13041 - DNA, 15 bp, Homo sapiens
cacacacacacacat

SEQ ID NO: 13042 - DNA, 15 bp, Homo sapiens
acacacacacacaca

SEQ ID NO: 13043 - DNA, 15 bp, Homo sapiens
cacacacacacacac

SEQ ID NO: 13044 - DNA, 15 bp, Homo sapiens
tacacacacacacac

SEQ ID NO: 13045 - DNA, 15 bp, Homo sapiens
atacacacacacaca

SEQ ID NO: 13046 - DNA, 15 bp, Homo sapiens
tatacacacacacac

SEQ ID NO: 13047 - DNA, 15 bp, Homo sapiens
atatacacacacaca

SEQ ID NO: 13048 - DNA, 15 bp, Homo sapiens
tatatacacacacac

SEQ ID NO: 13049 - DNA, 15 bp, Homo sapiens
atatatacacacaca

SEQ ID NO: 13050 - DNA, 15 bp, Homo sapiens
aatatatacacacac

SEQ ID NO: 13051 - DNA, 15 bp, Homo sapiens
aaatatatacacaca

SEQ ID NO: 13052 - DNA, 15 bp, Homo sapiens
aaaatatatacacac

SEQ ID NO: 13053 - DNA, 15 bp, Homo sapiens
aaaaatatatacaca

SEQ ID NO: 13054 - DNA, 15 bp, Homo sapiens
aaaaaatatatacac

SEQ ID NO: 13055 - DNA, 15 bp, Homo sapiens
aaaaaaatatataca

SEQ ID NO: 13056 - DNA, 15 bp, Homo sapiens
aaaaaaaatatatac

SEQ ID NO: 13057 - DNA, 15 bp, Homo sapiens
aaaaaaaaatatata

SEQ ID NO: 13058 - DNA, 15 bp, Homo sapiens
aaaaaaaaaatatat

SEQ ID NO: 13059 - DNA, 15 bp, Homo sapiens
aaaaaaaaaaatata

SEQ ID NO: 13060 - DNA, 15 bp, Homo sapiens
aaaaaaaaaaaatat

SEQ ID NO: 13061 - DNA, 15 bp, Homo sapiens
aaaaaaaaaaaaata

SEQ ID NO: 13062 - DNA, 15 bp, Homo sapiens
ctaaaaaaaaaaaaa

SEQ ID NO: 13063 - DNA, 15 bp, Homo sapiens
tctaaaaaaaaaaaa

SEQ ID NO: 13064 - DNA, 15 bp, Homo sapiens
atctaaaaaaaaaaa

SEQ ID NO: 13065 - DNA, 15 bp, Homo sapiens
catctaaaaaaaaaa

SEQ ID NO: 13066 - DNA, 15 bp, Homo sapiens
ccatctaaaaaaaaa

SEQ ID NO: 13067 - DNA, 15 bp, Homo sapiens
tccatctaaaaaaaa

SEQ ID NO: 13068 - DNA, 15 bp, Homo sapiens
ctccatctaaaaaaa

SEQ ID NO: 13069 - DNA, 15 bp, Homo sapiens
actccatctaaaaaa

SEQ ID NO: 13070 - DNA, 15 bp, Homo sapiens
gactccatctaaaaa

SEQ ID NO: 13071 - DNA, 15 bp, Homo sapiens
agactccatctaaaa

SEQ ID NO: 13072 - DNA, 15 bp, Homo sapiens
aagactccatctaaa

SEQ ID NO: 13073 - DNA, 15 bp, Homo sapiens
caagactccatctaa

SEQ ID NO: 13074 - DNA, 15 bp, Homo sapiens
cacaccactgcactc

SEQ ID NO: 13075 - DNA, 15 bp, Homo sapiens
tcacaccactgcact

SEQ ID NO: 13076 - DNA, 15 bp, Homo sapiens
atcacaccactgcac

SEQ ID NO: 13077 - DNA, 15 bp, Homo sapiens
aatcacaccactgca

SEQ ID NO: 13078 - DNA, 15 bp, Homo sapiens
aaatcacaccactgc

SEQ ID NO: 13079 - DNA, 15 bp, Homo sapiens
aaaatcacaccactg

SEQ ID NO: 13080 - DNA, 15 bp, Homo sapiens
caaaatcacaccact

SEQ ID NO: 13081 - DNA, 15 bp, Homo sapiens
ccaaaatcacaccac

SEQ ID NO: 13082 - DNA, 15 bp, Homo sapiens
gccaaaatcacacca

SEQ ID NO: 13083 - DNA, 15 bp, Homo sapiens
agccaaaatcacacc

SEQ ID NO: 13084 - DNA, 15 bp, Homo sapiens
gagccaaaatcacac

SEQ ID NO: 13085 - DNA, 15 bp, Homo sapiens
tgagccaaaatcaca

SEQ ID NO: 13086 - DNA, 15 bp, Homo sapiens
gtgagccaaaatcac

SEQ ID NO: 13087 - DNA, 15 bp, Homo sapiens
agtgagccaaaatca

SEQ ID NO: 13088 - DNA, 15 bp, Homo sapiens
cagtgagccaaaatc

SEQ ID NO: 13089 - DNA, 15 bp, Homo sapiens
gcagtgagccaaaat

SEQ ID NO: 13090 - DNA, 15 bp, Homo sapiens
tgcagtgagccaaaa

SEQ ID NO: 13091 - DNA, 15 bp, Homo sapiens
ttgcagtgagccaaa

SEQ ID NO: 13092 - DNA, 15 bp, Homo sapiens
acggaggttgcagtg

SEQ ID NO: 13093 - DNA, 15 bp, Homo sapiens
gacggaggttgcagt

SEQ ID NO: 13094 - DNA, 15 bp, Homo sapiens
agacggaggttgcag

SEQ ID NO: 13095 - DNA, 15 bp, Homo sapiens
aagacggaggttgca

SEQ ID NO: 13096 - DNA, 15 bp, Homo sapiens
caagacggaggttgc

SEQ ID NO: 13097 - DNA, 15 bp, Homo sapiens
acaagacggaggttg

SEQ ID NO: 13098 - DNA, 15 bp, Homo sapiens
cacaagacggaggtt

SEQ ID NO: 13099 - DNA, 15 bp, Homo sapiens
ccacaagacggaggt

SEQ ID NO: 13100 - DNA, 15 bp, Homo sapiens
cccacaagacggagg

SEQ ID NO: 13101 - DNA, 15 bp, Homo sapiens
acccacaagacggag

SEQ ID NO: 13102 - DNA, 15 bp, Homo sapiens
aacccacaagacgga

SEQ ID NO: 13103 - DNA, 15 bp, Homo sapiens
aaacccacaagacgg

SEQ ID NO: 13104 - DNA, 15 bp, Homo sapiens
caaacccacaagacg

SEQ ID NO: 13105 - DNA, 15 bp, Homo sapiens
tcaaacccacaagac

SEQ ID NO: 13106 - DNA, 15 bp, Homo sapiens
ttcaaacccacaaga

SEQ ID NO: 13107 - DNA, 15 bp, Homo sapiens
gttcaaacccacaag

SEQ ID NO: 13108 - DNA, 15 bp, Homo sapiens
tgttcaaacccacaa

SEQ ID NO: 13109 - DNA, 15 bp, Homo sapiens
ttgttcaaacccaca

SEQ ID NO: 13110 - DNA, 15 bp, Homo sapiens
attgttcaaacccac

SEQ ID NO: 13111 - DNA, 15 bp, Homo sapiens
aattgttcaaaccca

SEQ ID NO: 13112 - DNA, 15 bp, Homo sapiens
gaattgttcaaaccc

SEQ ID NO: 13113 - DNA, 15 bp, Homo sapiens
agaattgttcaaacc

SEQ ID NO: 13114 - DNA, 15 bp, Homo sapiens
gagaattgttcaaac

SEQ ID NO: 13115 - DNA, 15 bp, Homo sapiens
ggagaattgttcaaa

SEQ ID NO: 13116 - DNA, 15 bp, Homo sapiens
aggagaattgttcaa

SEQ ID NO: 13117 - DNA, 15 bp, Homo sapiens
caggagaattgttca

SEQ ID NO: 13118 - DNA, 15 bp, Homo sapiens
gcaggagaattgttc

SEQ ID NO: 13119 - DNA, 15 bp, Homo sapiens
ggcaggagaattgtt

SEQ ID NO: 13120 - DNA, 15 bp, Homo sapiens
aggcaggagaattgt

SEQ ID NO: 13121 - DNA, 15 bp, Homo sapiens
gaggcaggagaattg

SEQ ID NO: 13122 - DNA, 15 bp, Homo sapiens
tgaggcaggagaatt

SEQ ID NO: 13123 - DNA, 15 bp, Homo sapiens
cgggaagctgaggca

SEQ ID NO: 13124 - DNA, 15 bp, Homo sapiens
tcgggaagctgaggc

SEQ ID NO: 13125 - DNA, 15 bp, Homo sapiens
ctcgggaagctgagg

SEQ ID NO: 13126 - DNA, 15 bp, Homo sapiens
actcgggaagctgag

SEQ ID NO: 13127 - DNA, 15 bp, Homo sapiens
tactcgggaagctga

SEQ ID NO: 13128 - DNA, 15 bp, Homo sapiens
ctactcgggaagctg

SEQ ID NO: 13129 - DNA, 15 bp, Homo sapiens
gctactcgggaagct

SEQ ID NO: 13130 - DNA, 15 bp, Homo sapiens
agctactcgggaagc

SEQ ID NO: 13131 - DNA, 15 bp, Homo sapiens
cagctactcgggaag

SEQ ID NO: 13132 - DNA, 15 bp, Homo sapiens
ccagctactcgggaa

SEQ ID NO: 13133 - DNA, 15 bp, Homo sapiens
acctataatcccagc

SEQ ID NO: 13134 - DNA, 15 bp, Homo sapiens
cacctataatcccag

SEQ ID NO: 13135 - DNA, 15 bp, Homo sapiens
tcacctataatccca

SEQ ID NO: 13136 - DNA, 15 bp, Homo sapiens
gtcacctataatccc

SEQ ID NO: 13137 - DNA, 15 bp, Homo sapiens
agtcacctataatcc

SEQ ID NO: 13138 - DNA, 15 bp, Homo sapiens
cagtcacctataatc

SEQ ID NO: 13139 - DNA, 15 bp, Homo sapiens
acagtcacctataat

SEQ ID NO: 13140 - DNA, 15 bp, Homo sapiens
gacagtcacctataa

SEQ ID NO: 13141 - DNA, 15 bp, Homo sapiens
tgacagtcacctata

SEQ ID NO: 13142 - DNA, 15 bp, Homo sapiens
gtgacagtcacctat

SEQ ID NO: 13143 - DNA, 15 bp, Homo sapiens
ggtgacagtcaccta

SEQ ID NO: 13144 - DNA, 15 bp, Homo sapiens
tggtgacagtcacct

SEQ ID NO: 13145 - DNA, 15 bp, Homo sapiens
atggtgacagtcacc

SEQ ID NO: 13146 - DNA, 15 bp, Homo sapiens
catggtgacagtcac

SEQ ID NO: 13147 - DNA, 15 bp, Homo sapiens
gcatggtgacagtca

SEQ ID NO: 13148 - DNA, 15 bp, Homo sapiens
ggcatggtgacagtc

SEQ ID NO: 13149 - DNA, 15 bp, Homo sapiens
aggcatggtgacagt

SEQ ID NO: 13150 - DNA, 15 bp, Homo sapiens
caggcatggtgacag

SEQ ID NO: 13151 - DNA, 15 bp, Homo sapiens
ccaggcatggtgaca

SEQ ID NO: 13152 - DNA, 15 bp, Homo sapiens
gccaggcatggtgac

SEQ ID NO: 13153 - DNA, 15 bp, Homo sapiens
agccaggcatggtga

SEQ ID NO: 13154 - DNA, 15 bp, Homo sapiens
cagccaggcatggtg

SEQ ID NO: 13155 - DNA, 15 bp, Homo sapiens
acagccaggcatggt

SEQ ID NO: 13156 - DNA, 15 bp, Homo sapiens
aacagccaggcatgg

SEQ ID NO: 13157 - DNA, 15 bp, Homo sapiens
caacagccaggcatg

SEQ ID NO: 13158 - DNA, 15 bp, Homo sapiens
acaacagccaggcat

SEQ ID NO: 13159 - DNA, 15 bp, Homo sapiens
aacaacagccaggca

SEQ ID NO: 13160 - DNA, 15 bp, Homo sapiens
aaacaacagccaggc

SEQ ID NO: 13161 - DNA, 15 bp, Homo sapiens
aaaacaacagccagg

SEQ ID NO: 13162 - DNA, 15 bp, Homo sapiens
aaaaacaacagccag

SEQ ID NO: 13163 - DNA, 15 bp, Homo sapiens
aaaaaacaacagcca

SEQ ID NO: 13164 - DNA, 15 bp, Homo sapiens
aaaaaaacaacagcc

SEQ ID NO: 13165 - DNA, 15 bp, Homo sapiens
aaaaaaaacaacagc

SEQ ID NO: 13166 - DNA, 15 bp, Homo sapiens
caaaaaaaacaacag

SEQ ID NO: 13167 - DNA, 15 bp, Homo sapiens
acaaaaaaaacaaca

SEQ ID NO: 13168 - DNA, 15 bp, Homo sapiens
aacaaaaaaaacaac

SEQ ID NO: 13169 - DNA, 15 bp, Homo sapiens
aaacaaaaaaaacaa

SEQ ID NO: 13170 - DNA, 15 bp, Homo sapiens
aaaacaaaaaaaaca

SEQ ID NO: 13171 - DNA, 15 bp, Homo sapiens
aaaaacaaaaaaaac

SEQ ID NO: 13172 - DNA, 15 bp, Homo sapiens
aaaaaacaaaaaaaa

SEQ ID NO: 13173 - DNA, 15 bp, Homo sapiens
aaaaaaacaaaaaaa

SEQ ID NO: 13174 - DNA, 15 bp, Homo sapiens
caaaaaaacaaaaaa

SEQ ID NO: 13175 - DNA, 15 bp, Homo sapiens
tcaaaaaaacaaaaa

SEQ ID NO: 13176 - DNA, 15 bp, Homo sapiens
ctcaaaaaaacaaaa

SEQ ID NO: 13177 - DNA, 15 bp, Homo sapiens
tctcaaaaaaacaaa

SEQ ID NO: 13178 - DNA, 15 bp, Homo sapiens
tgtctcaaaaaaaca

SEQ ID NO: 13179 - DNA, 15 bp, Homo sapiens
ctgtctcaaaaaaac

SEQ ID NO: 13180 - DNA, 15 bp, Homo sapiens
tctgtctcaaaaaaa

SEQ ID NO: 13181 - DNA, 15 bp, Homo sapiens
ctctgtctcaaaaaa

SEQ ID NO: 13182 - DNA, 15 bp, Homo sapiens
actctgtctcaaaaa

SEQ ID NO: 13183 - DNA, 15 bp, Homo sapiens
gactctgtctcaaaa

SEQ ID NO: 13184 - DNA, 15 bp, Homo sapiens
agactctgtctcaaa

SEQ ID NO: 13185 - DNA, 15 bp, Homo sapiens
gagactctgtctcaa

SEQ ID NO: 13186 - DNA, 15 bp, Homo sapiens
tgagactctgtctca

SEQ ID NO: 13187 - DNA, 15 bp, Homo sapiens
gtgagactctgtctc

SEQ ID NO: 13188 - DNA, 15 bp, Homo sapiens
agtgagactctgtct

SEQ ID NO: 13189 - DNA, 15 bp, Homo sapiens
gagtgagactctgtc

SEQ ID NO: 13190 - DNA, 15 bp, Homo sapiens
agagtgagactctgt

SEQ ID NO: 13191 - DNA, 15 bp, Homo sapiens
gggtgacagagtgag

SEQ ID NO: 13192 - DNA, 15 bp, Homo sapiens
tgggtgacagagtga

SEQ ID NO: 13193 - DNA, 15 bp, Homo sapiens
ctgggtgacagagtg

SEQ ID NO: 13194 - DNA, 15 bp, Homo sapiens
cctgggtgacagagt

SEQ ID NO: 13195 - DNA, 15 bp, Homo sapiens
atgccactgcactcc

SEQ ID NO: 13196 - DNA, 15 bp, Homo sapiens
catgccactgcactc

SEQ ID NO: 13197 - DNA, 15 bp, Homo sapiens
tcatgccactgcact

SEQ ID NO: 13198 - DNA, 15 bp, Homo sapiens
atcatgccactgcac

SEQ ID NO: 13199 - DNA, 15 bp, Homo sapiens
gatcatgccactgca

SEQ ID NO: 13200 - DNA, 15 bp, Homo sapiens
agatcatgccactgc

SEQ ID NO: 13201 - DNA, 15 bp, Homo sapiens
aagatcatgccactg

SEQ ID NO: 13202 - DNA, 15 bp, Homo sapiens
caagatcatgccact

SEQ ID NO: 13203 - DNA, 15 bp, Homo sapiens
ccaagatcatgccac

SEQ ID NO: 13204 - DNA, 15 bp, Homo sapiens
gccaagatcatgcca

SEQ ID NO: 13205 - DNA, 15 bp, Homo sapiens
agccaagatcatgcc

SEQ ID NO: 13206 - DNA, 15 bp, Homo sapiens
gagccaagatcatgc

SEQ ID NO: 13207 - DNA, 15 bp, Homo sapiens
tgagccaagatcatg

SEQ ID NO: 13208 - DNA, 15 bp, Homo sapiens
gtgagccaagatcat

SEQ ID NO: 13209 - DNA, 15 bp, Homo sapiens
agtgagccaagatca

SEQ ID NO: 13210 - DNA, 15 bp, Homo sapiens
cttgcagtgagccaa

SEQ ID NO: 13211 - DNA, 15 bp, Homo sapiens
gcttgcagtgagcca

SEQ ID NO: 13212 - DNA, 15 bp, Homo sapiens
agcttgcagtgagcc

SEQ ID NO: 13213 - DNA, 15 bp, Homo sapiens
gagcttgcagtgagc

SEQ ID NO: 13214 - DNA, 15 bp, Homo sapiens
ggagcttgcagtgag

SEQ ID NO: 13215 - DNA, 15 bp, Homo sapiens
cggagcttgcagtga

SEQ ID NO: 13216 - DNA, 15 bp, Homo sapiens
gcggagcttgcagtg

SEQ ID NO: 13217 - DNA, 15 bp, Homo sapiens
ggcggagcttgcagt

SEQ ID NO: 13218 - DNA, 15 bp, Homo sapiens
aggcggagcttgcag

SEQ ID NO: 13219 - DNA, 15 bp, Homo sapiens
gaggcggagcttgca

SEQ ID NO: 13220 - DNA, 15 bp, Homo sapiens
ggaggcggagcttgc

SEQ ID NO: 13221 - DNA, 15 bp, Homo sapiens
gggaggcggagcttg

SEQ ID NO: 13222 - DNA, 15 bp, Homo sapiens
cgggaggcggagctt

SEQ ID NO: 13223 - DNA, 15 bp, Homo sapiens
ccgggaggcggagct

SEQ ID NO: 13224 - DNA, 15 bp, Homo sapiens
cccgggaggcggagc

SEQ ID NO: 13225 - DNA, 15 bp, Homo sapiens
cgcccaggctcgagt

SEQ ID NO: 13226 - DNA, 15 bp, Homo sapiens
tcgcccaggctcgag

SEQ ID NO: 13227 - DNA, 15 bp, Homo sapiens
gtcgcccaggctcga

SEQ ID NO: 13228 - DNA, 15 bp, Homo sapiens
tgtcgcccaggctcg

SEQ ID NO: 13229 - DNA, 15 bp, Homo sapiens
ctgtcgcccaggctc

SEQ ID NO: 13230 - DNA, 15 bp, Homo sapiens
tctgtcgcccaggct

SEQ ID NO: 13231 - DNA, 15 bp, Homo sapiens
ctctgtcgcccaggc

SEQ ID NO: 13232 - DNA, 15 bp, Homo sapiens
agctctgtcgcccag

SEQ ID NO: 13233 - DNA, 15 bp, Homo sapiens
tagctctgtcgccca

SEQ ID NO: 13234 - DNA, 15 bp, Homo sapiens
ctagctctgtcgccc

SEQ ID NO: 13235 - DNA, 15 bp, Homo sapiens
tctagctctgtcgcc

SEQ ID NO: 13236 - DNA, 15 bp, Homo sapiens
gtctagctctgtcgc

SEQ ID NO: 13237 - DNA, 15 bp, Homo sapiens
agtctagctctgtcg

SEQ ID NO: 13238 - DNA, 15 bp, Homo sapiens
aagtctagctctgtc

SEQ ID NO: 13239 - DNA, 15 bp, Homo sapiens
gaagtctagctctgt

SEQ ID NO: 13240 - DNA, 15 bp, Homo sapiens
cgaagtctagctctg

SEQ ID NO: 13241 - DNA, 15 bp, Homo sapiens
acgaagtctagctct

SEQ ID NO: 13242 - DNA, 15 bp, Homo sapiens
gacgaagtctagctc

SEQ ID NO: 13243 - DNA, 15 bp, Homo sapiens
agacgaagtctagct

SEQ ID NO: 13244 - DNA, 15 bp, Homo sapiens
gagacgaagtctagc

SEQ ID NO: 13245 - DNA, 15 bp, Homo sapiens
tgagacgaagtctag

SEQ ID NO: 13246 - DNA, 15 bp, Homo sapiens
ctgagacgaagtcta

SEQ ID NO: 13247 - DNA, 15 bp, Homo sapiens
tctgagacgaagtct

SEQ ID NO: 13248 - DNA, 15 bp, Homo sapiens
ttctgagacgaagtc

SEQ ID NO: 13249 - DNA, 15 bp, Homo sapiens
tttctgagacgaagt

SEQ ID NO: 13250 - DNA, 15 bp, Homo sapiens
ttttctgagacgaag

SEQ ID NO: 13251 - DNA, 15 bp, Homo sapiens
tttttctgagacgaa

SEQ ID NO: 13252 - DNA, 15 bp, Homo sapiens
ttttttctgagacga

SEQ ID NO: 13253 - DNA, 15 bp, Homo sapiens
tttttttctgagacg

SEQ ID NO: 13254 - DNA, 15 bp, Homo sapiens
ttttttttctgagac

SEQ ID NO: 13255 - DNA, 15 bp, Homo sapiens
cttttttttctgaga

SEQ ID NO: 13256 - DNA, 15 bp, Homo sapiens
tcttttttttctgag

SEQ ID NO: 13257 - DNA, 15 bp, Homo sapiens
atcttttttttctga

SEQ ID NO: 13258 - DNA, 15 bp, Homo sapiens
aatcttttttttctg

SEQ ID NO: 13259 - DNA, 15 bp, Homo sapiens
gaatcttttttttct

SEQ ID NO: 13260 - DNA, 15 bp, Homo sapiens
cgaatcttttttttc

SEQ ID NO: 13261 - DNA, 15 bp, Homo sapiens
tcgaatctttttttt

SEQ ID NO: 13262 - DNA, 15 bp, Homo sapiens
ctcgaatcttttttt

SEQ ID NO: 13263 - DNA, 15 bp, Homo sapiens
actcgaatctttttt

SEQ ID NO: 13264 - DNA, 15 bp, Homo sapiens
aactcgaatcttttt

SEQ ID NO: 13265 - DNA, 15 bp, Homo sapiens
aaactcgaatctttt

SEQ ID NO: 13266 - DNA, 15 bp, Homo sapiens
aaaactcgaatcttt

SEQ ID NO: 13267 - DNA, 15 bp, Homo sapiens
aaaaactcgaatctt

SEQ ID NO: 13268 - DNA, 15 bp, Homo sapiens
taaaaactcgaatct

SEQ ID NO: 13269 - DNA, 15 bp, Homo sapiens
ttaaaaactcgaatc

SEQ ID NO: 13270 - DNA, 15 bp, Homo sapiens
tttaaaaactcgaat

SEQ ID NO: 13271 - DNA, 15 bp, Homo sapiens
ttttaaaaactcgaa

SEQ ID NO: 13272 - DNA, 15 bp, Homo sapiens
tttttaaaaactcga

SEQ ID NO: 13273 - DNA, 15 bp, Homo sapiens
ttttttaaaaactcg

SEQ ID NO: 13274 - DNA, 15 bp, Homo sapiens
tttttttaaaaactc

SEQ ID NO: 13275 - DNA, 15 bp, Homo sapiens
ctttttttaaaaact

SEQ ID NO: 13276 - DNA, 15 bp, Homo sapiens
tctttttttaaaaac

SEQ ID NO: 13277 - DNA, 15 bp, Homo sapiens
ttctttttttaaaaa

SEQ ID NO: 13278 - DNA, 15 bp, Homo sapiens
gttctttttttaaaa

SEQ ID NO: 13279 - DNA, 15 bp, Homo sapiens
tgttctttttttaaa

SEQ ID NO: 13280 - DNA, 15 bp, Homo sapiens
atgttctttttttaa

SEQ ID NO: 13281 - DNA, 15 bp, Homo sapiens
aatgttcttttttta

SEQ ID NO: 13282 - DNA, 15 bp, Homo sapiens
gaatgttcttttttt

SEQ ID NO: 13283 - DNA, 15 bp, Homo sapiens
agaatgttctttttt

SEQ ID NO: 13284 - DNA, 15 bp, Homo sapiens
aagaatgttcttttt

SEQ ID NO: 13285 - DNA, 15 bp, Homo sapiens
taagaatgttctttt

SEQ ID NO: 13286 - DNA, 15 bp, Homo sapiens
ttaagaatgttcttt

SEQ ID NO: 13287 - DNA, 15 bp, Homo sapiens
cttaagaatgttctt

SEQ ID NO: 13288 - DNA, 15 bp, Homo sapiens
acttaagaatgttct

SEQ ID NO: 13289 - DNA, 15 bp, Homo sapiens
gacttaagaatgttc

SEQ ID NO: 13290 - DNA, 15 bp, Homo sapiens
agacttaagaatgtt

SEQ ID NO: 13291 - DNA, 15 bp, Homo sapiens
aagacttaagaatgt

SEQ ID NO: 13292 - DNA, 15 bp, Homo sapiens
aaagacttaagaatg

SEQ ID NO: 13293 - DNA, 15 bp, Homo sapiens
taaagacttaagaat

SEQ ID NO: 13294 - DNA, 15 bp, Homo sapiens
ctaaagacttaagaa

SEQ ID NO: 13295 - DNA, 15 bp, Homo sapiens
actaaagacttaaga

SEQ ID NO: 13296 - DNA, 15 bp, Homo sapiens
tactaaagacttaag

SEQ ID NO: 13297 - DNA, 15 bp, Homo sapiens
atactaaagacttaa

SEQ ID NO: 13298 - DNA, 15 bp, Homo sapiens
tatactaaagactta

SEQ ID NO: 13299 - DNA, 15 bp, Homo sapiens
gtatactaaagactt

SEQ ID NO: 13300 - DNA, 15 bp, Homo sapiens
agtatactaaagact

SEQ ID NO: 13301 - DNA, 15 bp, Homo sapiens
cagtatactaaagac

SEQ ID NO: 13302 - DNA, 15 bp, Homo sapiens
tcagtatactaaaga

SEQ ID NO: 13303 - DNA, 15 bp, Homo sapiens
ttcagtatactaaag

SEQ ID NO: 13304 - DNA, 15 bp, Homo sapiens
attcagtatactaaa

SEQ ID NO: 13305 - DNA, 15 bp, Homo sapiens
cattcagtatactaa

SEQ ID NO: 13306 - DNA, 15 bp, Homo sapiens
ccattcagtatacta

SEQ ID NO: 13307 - DNA, 15 bp, Homo sapiens
accattcagtatact

SEQ ID NO: 13308 - DNA, 15 bp, Homo sapiens
taccattcagtatac

SEQ ID NO: 13309 - DNA, 15 bp, Homo sapiens
ataccattcagtata

SEQ ID NO: 13310 - DNA, 15 bp, Homo sapiens
cataccattcagtat

SEQ ID NO: 13311 - DNA, 15 bp, Homo sapiens
tcataccattcagta

SEQ ID NO: 13312 - DNA, 15 bp, Homo sapiens
ctcataccattcagt

SEQ ID NO: 13313 - DNA, 15 bp, Homo sapiens
gctcataccattcag

SEQ ID NO: 13314 - DNA, 15 bp, Homo sapiens
tgctcataccattca

SEQ ID NO: 13315 - DNA, 15 bp, Homo sapiens
ctgctcataccattc

SEQ ID NO: 13316 - DNA, 15 bp, Homo sapiens
gctgctcataccatt

SEQ ID NO: 13317 - DNA, 15 bp, Homo sapiens
tgctgctcataccat

SEQ ID NO: 13318 - DNA, 15 bp, Homo sapiens
ttgctgctcatacca

SEQ ID NO: 13319 - DNA, 15 bp, Homo sapiens
attgctgctcatacc

SEQ ID NO: 13320 - DNA, 15 bp, Homo sapiens
tattgctgctcatac

SEQ ID NO: 13321 - DNA, 15 bp, Homo sapiens
ctattgctgctcata

SEQ ID NO: 13322 - DNA, 15 bp, Homo sapiens
tctattgctgctcat

SEQ ID NO: 13323 - DNA, 15 bp, Homo sapiens
ctctattgctgctca

SEQ ID NO: 13324 - DNA, 15 bp, Homo sapiens
cctctattgctgctc

SEQ ID NO: 13325 - DNA, 15 bp, Homo sapiens
ccctctattgctgct

SEQ ID NO: 13326 - DNA, 15 bp, Homo sapiens
accctctattgctgc

SEQ ID NO: 13327 - DNA, 15 bp, Homo sapiens
aaccctctattgctg

SEQ ID NO: 13328 - DNA, 15 bp, Homo sapiens
caaccctctattgct

SEQ ID NO: 13329 - DNA, 15 bp, Homo sapiens
acaaccctctattgc

SEQ ID NO: 13330 - DNA, 15 bp, Homo sapiens
cacaaccctctattg

SEQ ID NO: 13331 - DNA, 15 bp, Homo sapiens
ccacaaccctctatt

SEQ ID NO: 13332 - DNA, 15 bp, Homo sapiens
gccacaaccctctat

SEQ ID NO: 13333 - DNA, 15 bp, Homo sapiens
ggccacaaccctcta

SEQ ID NO: 13334 - DNA, 15 bp, Homo sapiens
aggccacaaccctct

SEQ ID NO: 13335 - DNA, 15 bp, Homo sapiens
aaggccacaaccctc

SEQ ID NO: 13336 - DNA, 15 bp, Homo sapiens
gaaggccacaaccct

SEQ ID NO: 13337 - DNA, 15 bp, Homo sapiens
agaaggccacaaccc

SEQ ID NO: 13338 - DNA, 15 bp, Homo sapiens
cagaaggccacaacc

SEQ ID NO: 13339 - DNA, 15 bp, Homo sapiens
tcagaaggccacaac

SEQ ID NO: 13340 - DNA, 15 bp, Homo sapiens
ttcagaaggccacaa

SEQ ID NO: 13341 - DNA, 15 bp, Homo sapiens
tttcagaaggccaca

SEQ ID NO: 13342 - DNA, 15 bp, Homo sapiens
ctttcagaaggccac

SEQ ID NO: 13343 - DNA, 15 bp, Homo sapiens
actttcagaaggcca

SEQ ID NO: 13344 - DNA, 15 bp, Homo sapiens
tactttcagaaggcc

SEQ ID NO: 13345 - DNA, 15 bp, Homo sapiens
ttactttcagaaggc

SEQ ID NO: 13346 - DNA, 15 bp, Homo sapiens
cttactttcagaagg

SEQ ID NO: 13347 - DNA, 15 bp, Homo sapiens
ccttactttcagaag

SEQ ID NO: 13348 - DNA, 15 bp, Homo sapiens
tccttactttcagaa

SEQ ID NO: 13349 - DNA, 15 bp, Homo sapiens
ttccttactttcaga

SEQ ID NO: 13350 - DNA, 15 bp, Homo sapiens
tttccttactttcag

SEQ ID NO: 13351 - DNA, 15 bp, Homo sapiens
ttttccttactttca

SEQ ID NO: 13352 - DNA, 15 bp, Homo sapiens
attttccttactttc

SEQ ID NO: 13353 - DNA, 15 bp, Homo sapiens
aattttccttacttt

SEQ ID NO: 13354 - DNA, 15 bp, Homo sapiens
taattttccttactt

SEQ ID NO: 13355 - DNA, 15 bp, Homo sapiens
ataattttccttact

SEQ ID NO: 13356 - DNA, 15 bp, Homo sapiens
tataattttccttac

SEQ ID NO: 13357 - DNA, 15 bp, Homo sapiens
ttataattttcctta

SEQ ID NO: 13358 - DNA, 15 bp, Homo sapiens
attataattttcctt

SEQ ID NO: 13359 - DNA, 15 bp, Homo sapiens
cattataattttcct

SEQ ID NO: 13360 - DNA, 15 bp, Homo sapiens
tcattataattttcc

SEQ ID NO: 13361 - DNA, 15 bp, Homo sapiens
gtcattataattttc

SEQ ID NO: 13362 - DNA, 15 bp, Homo sapiens
tgtcattataatttt

SEQ ID NO: 13363 - DNA, 15 bp, Homo sapiens
ctgtcattataattt

SEQ ID NO: 13364 - DNA, 15 bp, Homo sapiens
actgtcattataatt

SEQ ID NO: 13365 - DNA, 15 bp, Homo sapiens
tactgtcattataat

SEQ ID NO: 13366 - DNA, 15 bp, Homo sapiens
atactgtcattataa

SEQ ID NO: 13367 - DNA, 15 bp, Homo sapiens
tatactgtcattata

SEQ ID NO: 13368 - DNA, 15 bp, Homo sapiens
ttatactgtcattat

SEQ ID NO: 13369 - DNA, 15 bp, Homo sapiens
cttatactgtcatta

SEQ ID NO: 13370 - DNA, 15 bp, Homo sapiens
ccttatactgtcatt

SEQ ID NO: 13371 - DNA, 15 bp, Homo sapiens
accttatactgtcat

SEQ ID NO: 13372 - DNA, 15 bp, Homo sapiens
taccttatactgtca

SEQ ID NO: 13373 - DNA, 15 bp, Homo sapiens
ctaccttatactgtc

SEQ ID NO: 13374 - DNA, 15 bp, Homo sapiens
actaccttatactgt

SEQ ID NO: 13375 - DNA, 15 bp, Homo sapiens
tactaccttatactg

SEQ ID NO: 13376 - DNA, 15 bp, Homo sapiens
atactaccttatact

SEQ ID NO: 13377 - DNA, 15 bp, Homo sapiens
catactaccttatac

SEQ ID NO: 13378 - DNA, 15 bp, Homo sapiens
tcatactaccttata

SEQ ID NO: 13379 - DNA, 15 bp, Homo sapiens
ctcatactaccttat

SEQ ID NO: 13380 - DNA, 15 bp, Homo sapiens
cctcatactacctta

SEQ ID NO: 13381 - DNA, 15 bp, Homo sapiens
ccctcatactacctt

SEQ ID NO: 13382 - DNA, 15 bp, Homo sapiens
cccctcatactacct

SEQ ID NO: 13383 - DNA, 15 bp, Homo sapiens
gcccctcatactacc

SEQ ID NO: 13384 - DNA, 15 bp, Homo sapiens
tgcccctcatactac

SEQ ID NO: 13385 - DNA, 15 bp, Homo sapiens
atgcccctcatacta

SEQ ID NO: 13386 - DNA, 15 bp, Homo sapiens
tatgcccctcatact

SEQ ID NO: 13387 - DNA, 15 bp, Homo sapiens
ctatgcccctcatac

SEQ ID NO: 13388 - DNA, 15 bp, Homo sapiens
actatgcccctcata

SEQ ID NO: 13389 - DNA, 15 bp, Homo sapiens
gactatgcccctcat

SEQ ID NO: 13390 - DNA, 15 bp, Homo sapiens
agactatgcccctca

SEQ ID NO: 13391 - DNA, 15 bp, Homo sapiens
aagactatgcccctc

SEQ ID NO: 13392 - DNA, 15 bp, Homo sapiens
aaagactatgcccct

SEQ ID NO: 13393 - DNA, 15 bp, Homo sapiens
aaaagactatgcccc

SEQ ID NO: 13394 - DNA, 15 bp, Homo sapiens
taaaagactatgccc

SEQ ID NO: 13395 - DNA, 15 bp, Homo sapiens
ataaaagactatgcc

SEQ ID NO: 13396 - DNA, 15 bp, Homo sapiens
aataaaagactatgc

SEQ ID NO: 13397 - DNA, 15 bp, Homo sapiens
aaataaaagactatg

SEQ ID NO: 13398 - DNA, 15 bp, Homo sapiens
gaaataaaagactat

SEQ ID NO: 13399 - DNA, 15 bp, Homo sapiens
agaaataaaagacta

SEQ ID NO: 13400 - DNA, 15 bp, Homo sapiens
cagaaataaaagact

SEQ ID NO: 13401 - DNA, 15 bp, Homo sapiens
tcagaaataaaagac

SEQ ID NO: 13402 - DNA, 15 bp, Homo sapiens
gtcagaaataaaaga

SEQ ID NO: 13403 - DNA, 15 bp, Homo sapiens
ggtcagaaataaaag

SEQ ID NO: 13404 - DNA, 15 bp, Homo sapiens
tggtcagaaataaaa

SEQ ID NO: 13405 - DNA, 15 bp, Homo sapiens
ctggtcagaaataaa

SEQ ID NO: 13406 - DNA, 15 bp, Homo sapiens
actggtcagaaataa

SEQ ID NO: 13407 - DNA, 15 bp, Homo sapiens
cactggtcagaaata

SEQ ID NO: 13408 - DNA, 15 bp, Homo sapiens
acactggtcagaaat

SEQ ID NO: 13409 - DNA, 15 bp, Homo sapiens
gacactggtcagaaa

SEQ ID NO: 13410 - DNA, 15 bp, Homo sapiens
tgacactggtcagaa

SEQ ID NO: 13411 - DNA, 15 bp, Homo sapiens
atgacactggtcaga

SEQ ID NO: 13412 - DNA, 15 bp, Homo sapiens
gatgacactggtcag

SEQ ID NO: 13413 - DNA, 15 bp, Homo sapiens
tgatgacactggtca

SEQ ID NO: 13414 - DNA, 15 bp, Homo sapiens
ttgatgacactggtc

SEQ ID NO: 13415 - DNA, 15 bp, Homo sapiens
cttgatgacactggt

SEQ ID NO: 13416 - DNA, 15 bp, Homo sapiens
ccttgatgacactgg

SEQ ID NO: 13417 - DNA, 15 bp, Homo sapiens
tccttgatgacactg

SEQ ID NO: 13418 - DNA, 15 bp, Homo sapiens
ctccttgatgacact

SEQ ID NO: 13419 - DNA, 15 bp, Homo sapiens
cctccttgatgacac

SEQ ID NO: 13420 - DNA, 15 bp, Homo sapiens
ccctccttgatgaca

SEQ ID NO: 13421 - DNA, 15 bp, Homo sapiens
gccctccttgatgac

SEQ ID NO: 13422 - DNA, 15 bp, Homo sapiens
agccctccttgatga

SEQ ID NO: 13423 - DNA, 15 bp, Homo sapiens
aagccctccttgatg

SEQ ID NO: 13424 - DNA, 15 bp, Homo sapiens
aaagccctccttgat

SEQ ID NO: 13425 - DNA, 15 bp, Homo sapiens
taaagccctccttga

SEQ ID NO: 13426 - DNA, 15 bp, Homo sapiens
ataaagccctccttg

SEQ ID NO: 13427 - DNA, 15 bp, Homo sapiens
aataaagccctcctt

SEQ ID NO: 13428 - DNA, 15 bp, Homo sapiens
aaataaagccctcct

SEQ ID NO: 13429 - DNA, 15 bp, Homo sapiens
aaaataaagccctcc

SEQ ID NO: 13430 - DNA, 15 bp, Homo sapiens
aaaaataaagccctc

SEQ ID NO: 13431 - DNA, 15 bp, Homo sapiens
aaaaaataaagccct

SEQ ID NO: 13432 - DNA, 15 bp, Homo sapiens
aaaaaaataaagccc

SEQ ID NO: 13433 - DNA, 15 bp, Homo sapiens
aaaaaaaataaagcc

SEQ ID NO: 13434 - DNA, 15 bp, Homo sapiens
taaaaaaaataaagc

SEQ ID NO: 13435 - DNA, 15 bp, Homo sapiens
ttaaaaaaaataaag

SEQ ID NO: 13436 - DNA, 15 bp, Homo sapiens
cttaaaaaaaataaa

SEQ ID NO: 13437 - DNA, 15 bp, Homo sapiens
tcttaaaaaaaataa

SEQ ID NO: 13438 - DNA, 15 bp, Homo sapiens
gtcttaaaaaaaata

SEQ ID NO: 13439 - DNA, 15 bp, Homo sapiens
cgtcttaaaaaaaat

SEQ ID NO: 13440 - DNA, 15 bp, Homo sapiens
ccgtcttaaaaaaaa

SEQ ID NO: 13441 - DNA, 15 bp, Homo sapiens
tccgtcttaaaaaaa

SEQ ID NO: 13442 - DNA, 15 bp, Homo sapiens
ctccgtcttaaaaaa

SEQ ID NO: 13443 - DNA, 15 bp, Homo sapiens
actccgtcttaaaaa

SEQ ID NO: 13444 - DNA, 15 bp, Homo sapiens
gactccgtcttaaaa

SEQ ID NO: 13445 - DNA, 15 bp, Homo sapiens
agactccgtcttaaa

SEQ ID NO: 13446 - DNA, 15 bp, Homo sapiens
gagactccgtcttaa

SEQ ID NO: 13447 - DNA, 15 bp, Homo sapiens
cgagactccgtctta

SEQ ID NO: 13448 - DNA, 15 bp, Homo sapiens
gcgagactccgtctt

SEQ ID NO: 13449 - DNA, 15 bp, Homo sapiens
agcgagactccgtct

SEQ ID NO: 13450 - DNA, 15 bp, Homo sapiens
gagcgagactccgtc

SEQ ID NO: 13451 - DNA, 15 bp, Homo sapiens
agagcgagactccgt

SEQ ID NO: 13452 - DNA, 15 bp, Homo sapiens
cagagcgagactccg

SEQ ID NO: 13453 - DNA, 15 bp, Homo sapiens
acagagcgagactcc

SEQ ID NO: 13454 - DNA, 15 bp, Homo sapiens
gacagagcgagactc

SEQ ID NO: 13455 - DNA, 15 bp, Homo sapiens
tgacagagcgagact

SEQ ID NO: 13456 - DNA, 15 bp, Homo sapiens
ttgacagagcgagac

SEQ ID NO: 13457 - DNA, 15 bp, Homo sapiens
gttgacagagcgaga

SEQ ID NO: 13458 - DNA, 15 bp, Homo sapiens
ggttgacagagcgag

SEQ ID NO: 13459 - DNA, 15 bp, Homo sapiens
tggttgacagagcga

SEQ ID NO: 13460 - DNA, 15 bp, Homo sapiens
ctggttgacagagcg

SEQ ID NO: 13461 - DNA, 15 bp, Homo sapiens
cctggttgacagagc

SEQ ID NO: 13462 - DNA, 15 bp, Homo sapiens
gcctggttgacagag

SEQ ID NO: 13463 - DNA, 15 bp, Homo sapiens
agcctggttgacaga

SEQ ID NO: 13464 - DNA, 15 bp, Homo sapiens
cagcctggttgacag

SEQ ID NO: 13465 - DNA, 15 bp, Homo sapiens
ccagcctggttgaca

SEQ ID NO: 13466 - DNA, 15 bp, Homo sapiens
tccagcctggttgac

SEQ ID NO: 13467 - DNA, 15 bp, Homo sapiens
ctccagcctggttga

SEQ ID NO: 13468 - DNA, 15 bp, Homo sapiens
actccagcctggttg

SEQ ID NO: 13469 - DNA, 15 bp, Homo sapiens
cactccagcctggtt

SEQ ID NO: 13470 - DNA, 15 bp, Homo sapiens
gcactccagcctggt

SEQ ID NO: 13471 - DNA, 15 bp, Homo sapiens
aagatcgtgccactg

SEQ ID NO: 13472 - DNA, 15 bp, Homo sapiens
caagatcgtgccact

SEQ ID NO: 13473 - DNA, 15 bp, Homo sapiens
ccaagatcgtgccac

SEQ ID NO: 13474 - DNA, 15 bp, Homo sapiens
gccaagatcgtgcca

SEQ ID NO: 13475 - DNA, 15 bp, Homo sapiens
ggccaagatcgtgcc

SEQ ID NO: 13476 - DNA, 15 bp, Homo sapiens
gggccaagatcgtgc

SEQ ID NO: 13477 - DNA, 15 bp, Homo sapiens
tgggccaagatcgtg

SEQ ID NO: 13478 - DNA, 15 bp, Homo sapiens
gtgggccaagatcgt

SEQ ID NO: 13479 - DNA, 15 bp, Homo sapiens
agtgggccaagatcg

SEQ ID NO: 13480 - DNA, 15 bp, Homo sapiens
cagtgggccaagatc

SEQ ID NO: 13481 - DNA, 15 bp, Homo sapiens
gcagtgggccaagat

SEQ ID NO: 13482 - DNA, 15 bp, Homo sapiens
tgcagtgggccaaga

SEQ ID NO: 13483 - DNA, 15 bp, Homo sapiens
ctgcagtgggccaag

SEQ ID NO: 13484 - DNA, 15 bp, Homo sapiens
gctgcagtgggccaa

SEQ ID NO: 13485 - DNA, 15 bp, Homo sapiens
ggctgcagtgggcca

SEQ ID NO: 13486 - DNA, 15 bp, Homo sapiens
aggctgcagtgggcc

SEQ ID NO: 13487 - DNA, 15 bp, Homo sapiens
gaggctgcagtgggc

SEQ ID NO: 13488 - DNA, 15 bp, Homo sapiens
ggaggctgcagtggg

SEQ ID NO: 13489 - DNA, 15 bp, Homo sapiens
tggaggctgcagtgg

SEQ ID NO: 13490 - DNA, 15 bp, Homo sapiens
gtggaggctgcagtg

SEQ ID NO: 13491 - DNA, 15 bp, Homo sapiens
ggtggaggctgcagt

SEQ ID NO: 13492 - DNA, 15 bp, Homo sapiens
aggtggaggctgcag

SEQ ID NO: 13493 - DNA, 15 bp, Homo sapiens
gaggtggaggctgca

SEQ ID NO: 13494 - DNA, 15 bp, Homo sapiens
ggaggtggaggctgc

SEQ ID NO: 13495 - DNA, 15 bp, Homo sapiens
gggaggtggaggctg

SEQ ID NO: 13496 - DNA, 15 bp, Homo sapiens
cgggaggtggaggct

SEQ ID NO: 13497 - DNA, 15 bp, Homo sapiens
ccgggaggtggaggc

SEQ ID NO: 13498 - DNA, 15 bp, Homo sapiens
tccgggaggtggagg

SEQ ID NO: 13499 - DNA, 15 bp, Homo sapiens
gtccgggaggtggag

SEQ ID NO: 13500 - DNA, 15 bp, Homo sapiens
agtccgggaggtgga

SEQ ID NO: 13501 - DNA, 15 bp, Homo sapiens
gagtccgggaggtgg

SEQ ID NO: 13502 - DNA, 15 bp, Homo sapiens
tgagtccgggaggtg

SEQ ID NO: 13503 - DNA, 15 bp, Homo sapiens
ttgagtccgggaggt

SEQ ID NO: 13504 - DNA, 15 bp, Homo sapiens
cttgagtccgggagg

SEQ ID NO: 13505 - DNA, 15 bp, Homo sapiens
tcttgagtccgggag

SEQ ID NO: 13506 - DNA, 15 bp, Homo sapiens
ctcttgagtccggga

SEQ ID NO: 13507 - DNA, 15 bp, Homo sapiens
tctcttgagtccggg

SEQ ID NO: 13508 - DNA, 15 bp, Homo sapiens
atctcttgagtccgg

SEQ ID NO: 13509 - DNA, 15 bp, Homo sapiens
aatctcttgagtccg

SEQ ID NO: 13510 - DNA, 15 bp, Homo sapiens
gaatctcttgagtcc

SEQ ID NO: 13511 - DNA, 15 bp, Homo sapiens
agaatctcttgagtc

SEQ ID NO: 13512 - DNA, 15 bp, Homo sapiens
gagaatctcttgagt

SEQ ID NO: 13513 - DNA, 15 bp, Homo sapiens
ggagaatctcttgag

SEQ ID NO: 13514 - DNA, 15 bp, Homo sapiens
gggagaatctcttga

SEQ ID NO: 13515 - DNA, 15 bp, Homo sapiens
tgggagaatctcttg

SEQ ID NO: 13516 - DNA, 15 bp, Homo sapiens
gtgggagaatctctt

SEQ ID NO: 13517 - DNA, 15 bp, Homo sapiens
ggtgggagaatctct

SEQ ID NO: 13518 - DNA, 15 bp, Homo sapiens
aggtgggagaatctc

SEQ ID NO: 13519 - DNA, 15 bp, Homo sapiens
gaggtgggagaatct

SEQ ID NO: 13520 - DNA, 15 bp, Homo sapiens
tgaggtgggagaatc

SEQ ID NO: 13521 - DNA, 15 bp, Homo sapiens
ctgaggtgggagaat

SEQ ID NO: 13522 - DNA, 15 bp, Homo sapiens
actgaggtgggagaa

SEQ ID NO: 13523 - DNA, 15 bp, Homo sapiens
gactgaggtgggaga

SEQ ID NO: 13524 - DNA, 15 bp, Homo sapiens
agactgaggtgggag

SEQ ID NO: 13525 - DNA, 15 bp, Homo sapiens
gagactgaggtggga

SEQ ID NO: 13526 - DNA, 15 bp, Homo sapiens
ggagactgaggtggg

SEQ ID NO: 13527 - DNA, 15 bp, Homo sapiens
gggagactgaggtgg

SEQ ID NO: 13528 - DNA, 15 bp, Homo sapiens
tgggagactgaggtg

SEQ ID NO: 13529 - DNA, 15 bp, Homo sapiens
ttgggagactgaggt

SEQ ID NO: 13530 - DNA, 15 bp, Homo sapiens
cttgggagactgagg

SEQ ID NO: 13531 - DNA, 15 bp, Homo sapiens
acttgggagactgag

SEQ ID NO: 13532 - DNA, 15 bp, Homo sapiens
tacttgggagactga

SEQ ID NO: 13533 - DNA, 15 bp, Homo sapiens
ctacttgggagactg

SEQ ID NO: 13534 - DNA, 15 bp, Homo sapiens
gctacttgggagact

SEQ ID NO: 13535 - DNA, 15 bp, Homo sapiens
agctacttgggagac

SEQ ID NO: 13536 - DNA, 15 bp, Homo sapiens
cagctacttgggaga

SEQ ID NO: 13537 - DNA, 15 bp, Homo sapiens
atcccagctacttgg

SEQ ID NO: 13538 - DNA, 15 bp, Homo sapiens
aatcccagctacttg

SEQ ID NO: 13539 - DNA, 15 bp, Homo sapiens
taatcccagctactt

SEQ ID NO: 13540 - DNA, 15 bp, Homo sapiens
gcacgcctgtaatcc

SEQ ID NO: 13541 - DNA, 15 bp, Homo sapiens
tgcacgcctgtaatc

SEQ ID NO: 13542 - DNA, 15 bp, Homo sapiens
gtgcacgcctgtaat

SEQ ID NO: 13543 - DNA, 15 bp, Homo sapiens
ggtgcacgcctgtaa

SEQ ID NO: 13544 - DNA, 15 bp, Homo sapiens
tggtgcacgcctgta

SEQ ID NO: 13545 - DNA, 15 bp, Homo sapiens
gtggtgcacgcctgt

SEQ ID NO: 13546 - DNA, 15 bp, Homo sapiens
ggtggtgcacgcctg

SEQ ID NO: 13547 - DNA, 15 bp, Homo sapiens
tggtggtgcacgcct

SEQ ID NO: 13548 - DNA, 15 bp, Homo sapiens
gtggtggtgcacgcc

SEQ ID NO: 13549 - DNA, 15 bp, Homo sapiens
cgtggtggtgcacgc

SEQ ID NO: 13550 - DNA, 15 bp, Homo sapiens
gcgtggtggtgcacg

SEQ ID NO: 13551 - DNA, 15 bp, Homo sapiens
ggcgtggtggtgcac

SEQ ID NO: 13552 - DNA, 15 bp, Homo sapiens
aggcgtggtggtgca

SEQ ID NO: 13553 - DNA, 15 bp, Homo sapiens
caggcgtggtggtgc

SEQ ID NO: 13554 - DNA, 15 bp, Homo sapiens
ccaggcgtggtggtg

SEQ ID NO: 13555 - DNA, 15 bp, Homo sapiens
accaggcgtggtggt

SEQ ID NO: 13556 - DNA, 15 bp, Homo sapiens
aaccaggcgtggtgg

SEQ ID NO: 13557 - DNA, 15 bp, Homo sapiens
taaccaggcgtggtg

SEQ ID NO: 13558 - DNA, 15 bp, Homo sapiens
ttaaccaggcgtggt

SEQ ID NO: 13559 - DNA, 15 bp, Homo sapiens
attaaccaggcgtgg

SEQ ID NO: 13560 - DNA, 15 bp, Homo sapiens
aattaaccaggcgtg

SEQ ID NO: 13561 - DNA, 15 bp, Homo sapiens
aaattaaccaggcgt

SEQ ID NO: 13562 - DNA, 15 bp, Homo sapiens
aaaattaaccaggcg

SEQ ID NO: 13563 - DNA, 15 bp, Homo sapiens
aaaaattaaccaggc

SEQ ID NO: 13564 - DNA, 15 bp, Homo sapiens
aaaaaattaaccagg

SEQ ID NO: 13565 - DNA, 15 bp, Homo sapiens
caaaaaattaaccag

SEQ ID NO: 13566 - DNA, 15 bp, Homo sapiens
acaaaaaattaacca

SEQ ID NO: 13567 - DNA, 15 bp, Homo sapiens
tacaaaaaattaacc

SEQ ID NO: 13568 - DNA, 15 bp, Homo sapiens
atacaaaaaattaac

SEQ ID NO: 13569 - DNA, 15 bp, Homo sapiens
aatacaaaaaattaa

SEQ ID NO: 13570 - DNA, 15 bp, Homo sapiens
tgtctctactaaaaa

SEQ ID NO: 13571 - DNA, 15 bp, Homo sapiens
ctgtctctactaaaa

SEQ ID NO: 13572 - DNA, 15 bp, Homo sapiens
actgtctctactaaa

SEQ ID NO: 13573 - DNA, 15 bp, Homo sapiens
aactgtctctactaa

SEQ ID NO: 13574 - DNA, 15 bp, Homo sapiens
aaactgtctctacta

SEQ ID NO: 13575 - DNA, 15 bp, Homo sapiens
gaaactgtctctact

SEQ ID NO: 13576 - DNA, 15 bp, Homo sapiens
tgaaactgtctctac

SEQ ID NO: 13577 - DNA, 15 bp, Homo sapiens
gtgaaactgtctcta

SEQ ID NO: 13578 - DNA, 15 bp, Homo sapiens
ggtgaaactgtctct

SEQ ID NO: 13579 - DNA, 15 bp, Homo sapiens
tggtgaaactgtctc

SEQ ID NO: 13580 - DNA, 15 bp, Homo sapiens
atggtgaaactgtct

SEQ ID NO: 13581 - DNA, 15 bp, Homo sapiens
catggtgaaactgtc

SEQ ID NO: 13582 - DNA, 15 bp, Homo sapiens
acatggtgaaactgt

SEQ ID NO: 13583 - DNA, 15 bp, Homo sapiens
aacatggtgaaactg

SEQ ID NO: 13584 - DNA, 15 bp, Homo sapiens
caacatggtgaaact

SEQ ID NO: 13585 - DNA, 15 bp, Homo sapiens
gcgagaccagcctgg

SEQ ID NO: 13586 - DNA, 15 bp, Homo sapiens
tgcgagaccagcctg

SEQ ID NO: 13587 - DNA, 15 bp, Homo sapiens
gtgcgagaccagcct

SEQ ID NO: 13588 - DNA, 15 bp, Homo sapiens
agtgcgagaccagcc

SEQ ID NO: 13589 - DNA, 15 bp, Homo sapiens
gagtgcgagaccagc

SEQ ID NO: 13590 - DNA, 15 bp, Homo sapiens
ggagtgcgagaccag

SEQ ID NO: 13591 - DNA, 15 bp, Homo sapiens
gggagtgcgagacca

SEQ ID NO: 13592 - DNA, 15 bp, Homo sapiens
tgggagtgcgagacc

SEQ ID NO: 13593 - DNA, 15 bp, Homo sapiens
ttgggagtgcgagac

SEQ ID NO: 13594 - DNA, 15 bp, Homo sapiens
gttgggagtgcgaga

SEQ ID NO: 13595 - DNA, 15 bp, Homo sapiens
ggttgggagtgcgag

SEQ ID NO: 13596 - DNA, 15 bp, Homo sapiens
aggttgggagtgcga

SEQ ID NO: 13597 - DNA, 15 bp, Homo sapiens
gaggttgggagtgcg

SEQ ID NO: 13598 - DNA, 15 bp, Homo sapiens
tgaggttgggagtgc

SEQ ID NO: 13599 - DNA, 15 bp, Homo sapiens
ctgaggttgggagtg

SEQ ID NO: 13600 - DNA, 15 bp, Homo sapiens
cctgaggttgggagt

SEQ ID NO: 13601 - DNA, 15 bp, Homo sapiens
gcctgaggttgggag

SEQ ID NO: 13602 - DNA, 15 bp, Homo sapiens
cgcctgaggttggga

SEQ ID NO: 13603 - DNA, 15 bp, Homo sapiens
tcgcctgaggttggg

SEQ ID NO: 13604 - DNA, 15 bp, Homo sapiens
atcgcctgaggttgg

SEQ ID NO: 13605 - DNA, 15 bp, Homo sapiens
gatcgcctgaggttg

SEQ ID NO: 13606 - DNA, 15 bp, Homo sapiens
ggatcgcctgaggtt

SEQ ID NO: 13607 - DNA, 15 bp, Homo sapiens
cggatcgcctgaggt

SEQ ID NO: 13608 - DNA, 15 bp, Homo sapiens
gcggatcgcctgagg

SEQ ID NO: 13609 - DNA, 15 bp, Homo sapiens
ggcggatcgcctgag

SEQ ID NO: 13610 - DNA, 15 bp, Homo sapiens
gggcggatcgcctga

SEQ ID NO: 13611 - DNA, 15 bp, Homo sapiens
tgggcggatcgcctg

SEQ ID NO: 13612 - DNA, 15 bp, Homo sapiens
gtgggcggatcgcct

SEQ ID NO: 13613 - DNA, 15 bp, Homo sapiens
ggtgggcggatcgcc

SEQ ID NO: 13614 - DNA, 15 bp, Homo sapiens
aggtgggcggatcgc

SEQ ID NO: 13615 - DNA, 15 bp, Homo sapiens
gaggtgggcggatcg

SEQ ID NO: 13616 - DNA, 15 bp, Homo sapiens
tgaggtgggcggatc

SEQ ID NO: 13617 - DNA, 15 bp, Homo sapiens
ctgaggtgggcggat

SEQ ID NO: 13618 - DNA, 15 bp, Homo sapiens
gctgaggtgggcgga

SEQ ID NO: 13619 - DNA, 15 bp, Homo sapiens
ggctgaggtgggcgg

SEQ ID NO: 13620 - DNA, 15 bp, Homo sapiens
aggctgaggtgggcg

SEQ ID NO: 13621 - DNA, 15 bp, Homo sapiens
ctgtaatcccggcac

SEQ ID NO: 13622 - DNA, 15 bp, Homo sapiens
cctgtaatcccggca

SEQ ID NO: 13623 - DNA, 15 bp, Homo sapiens
acctgtaatcccggc

SEQ ID NO: 13624 - DNA, 15 bp, Homo sapiens
cacctgtaatcccgg

SEQ ID NO: 13625 - DNA, 15 bp, Homo sapiens
acacctgtaatcccg

SEQ ID NO: 13626 - DNA, 15 bp, Homo sapiens
atggtggctcacacc

SEQ ID NO: 13627 - DNA, 15 bp, Homo sapiens
catggtggctcacac

SEQ ID NO: 13628 - DNA, 15 bp, Homo sapiens
gcatggtggctcaca

SEQ ID NO: 13629 - DNA, 15 bp, Homo sapiens
tgggcatggtggctc

SEQ ID NO: 13630 - DNA, 15 bp, Homo sapiens
ctgggcatggtggct

SEQ ID NO: 13631 - DNA, 15 bp, Homo sapiens
ggctgggcatggtgg

SEQ ID NO: 13632 - DNA, 15 bp, Homo sapiens
aggctgggcatggtg

SEQ ID NO: 13633 - DNA, 15 bp, Homo sapiens
aaggctgggcatggt

SEQ ID NO: 13634 - DNA, 15 bp, Homo sapiens
aaaggctgggcatgg

SEQ ID NO: 13635 - DNA, 15 bp, Homo sapiens
aaaaggctgggcatg

SEQ ID NO: 13636 - DNA, 15 bp, Homo sapiens
gaaaaggctgggcat

SEQ ID NO: 13637 - DNA, 15 bp, Homo sapiens
tgaaaaggctgggca

SEQ ID NO: 13638 - DNA, 15 bp, Homo sapiens
atgaaaaggctgggc

SEQ ID NO: 13639 - DNA, 15 bp, Homo sapiens
aatgaaaaggctggg

SEQ ID NO: 13640 - DNA, 15 bp, Homo sapiens
caatgaaaaggctgg

SEQ ID NO: 13641 - DNA, 15 bp, Homo sapiens
tcaatgaaaaggctg

SEQ ID NO: 13642 - DNA, 15 bp, Homo sapiens
atcaatgaaaaggct

SEQ ID NO: 13643 - DNA, 15 bp, Homo sapiens
aatcaatgaaaaggc

SEQ ID NO: 13644 - DNA, 15 bp, Homo sapiens
caatcaatgaaaagg

SEQ ID NO: 13645 - DNA, 15 bp, Homo sapiens
acaatcaatgaaaag

SEQ ID NO: 13646 - DNA, 15 bp, Homo sapiens
tacaatcaatgaaaa

SEQ ID NO: 13647 - DNA, 15 bp, Homo sapiens
ttacaatcaatgaaa

SEQ ID NO: 13648 - DNA, 15 bp, Homo sapiens
attacaatcaatgaa

SEQ ID NO: 13649 - DNA, 15 bp, Homo sapiens
aattacaatcaatga

SEQ ID NO: 13650 - DNA, 15 bp, Homo sapiens
caattacaatcaatg

SEQ ID NO: 13651 - DNA, 15 bp, Homo sapiens
acaattacaatcaat

SEQ ID NO: 13652 - DNA, 15 bp, Homo sapiens
gacaattacaatcaa

SEQ ID NO: 13653 - DNA, 15 bp, Homo sapiens
tgacaattacaatca

SEQ ID NO: 13654 - DNA, 15 bp, Homo sapiens
atgacaattacaatc

SEQ ID NO: 13655 - DNA, 15 bp, Homo sapiens
gatgacaattacaat

SEQ ID NO: 13656 - DNA, 15 bp, Homo sapiens
agatgacaattacaa

SEQ ID NO: 13657 - DNA, 15 bp, Homo sapiens
aagatgacaattaca

SEQ ID NO: 13658 - DNA, 15 bp, Homo sapiens
aaagatgacaattac

SEQ ID NO: 13659 - DNA, 15 bp, Homo sapiens
caaagatgacaatta

SEQ ID NO: 13660 - DNA, 15 bp, Homo sapiens
acaaagatgacaatt

SEQ ID NO: 13661 - DNA, 15 bp, Homo sapiens
aacaaagatgacaat

SEQ ID NO: 13662 - DNA, 15 bp, Homo sapiens
gaacaaagatgacaa

SEQ ID NO: 13663 - DNA, 15 bp, Homo sapiens
agaacaaagatgaca

SEQ ID NO: 13664 - DNA, 15 bp, Homo sapiens
gagaacaaagatgac

SEQ ID NO: 13665 - DNA, 15 bp, Homo sapiens
tgagaacaaagatga

SEQ ID NO: 13666 - DNA, 15 bp, Homo sapiens
ctgagaacaaagatg

SEQ ID NO: 13667 - DNA, 15 bp, Homo sapiens
cctgagaacaaagat

SEQ ID NO: 13668 - DNA, 15 bp, Homo sapiens
ccctgagaacaaaga

SEQ ID NO: 13669 - DNA, 15 bp, Homo sapiens
accctgagaacaaag

SEQ ID NO: 13670 - DNA, 15 bp, Homo sapiens
gaccctgagaacaaa

SEQ ID NO: 13671 - DNA, 15 bp, Homo sapiens
tgaccctgagaacaa

SEQ ID NO: 13672 - DNA, 15 bp, Homo sapiens
ctgaccctgagaaca

SEQ ID NO: 13673 - DNA, 15 bp, Homo sapiens
tctgaccctgagaac

SEQ ID NO: 13674 - DNA, 15 bp, Homo sapiens
ctctgaccctgagaa

SEQ ID NO: 13675 - DNA, 15 bp, Homo sapiens
tctctgaccctgaga

SEQ ID NO: 13676 - DNA, 15 bp, Homo sapiens
atctctgaccctgag

SEQ ID NO: 13677 - DNA, 15 bp, Homo sapiens
tatctctgaccctga

SEQ ID NO: 13678 - DNA, 15 bp, Homo sapiens
ttatctctgaccctg

SEQ ID NO: 13679 - DNA, 15 bp, Homo sapiens
attatctctgaccct

SEQ ID NO: 13680 - DNA, 15 bp, Homo sapiens
aattatctctgaccc

SEQ ID NO: 13681 - DNA, 15 bp, Homo sapiens
aaattatctctgacc

SEQ ID NO: 13682 - DNA, 15 bp, Homo sapiens
taaattatctctgac

SEQ ID NO: 13683 - DNA, 15 bp, Homo sapiens
ataaattatctctga

SEQ ID NO: 13684 - DNA, 15 bp, Homo sapiens
gataaattatctctg

SEQ ID NO: 13685 - DNA, 15 bp, Homo sapiens
agataaattatctct

SEQ ID NO: 13686 - DNA, 15 bp, Homo sapiens
aagataaattatctc

SEQ ID NO: 13687 - DNA, 15 bp, Homo sapiens
aaagataaattatct

SEQ ID NO: 13688 - DNA, 15 bp, Homo sapiens
aaaagataaattatc

SEQ ID NO: 13689 - DNA, 15 bp, Homo sapiens
aaaaagataaattat

SEQ ID NO: 13690 - DNA, 15 bp, Homo sapiens
aaaaaagataaatta

SEQ ID NO: 13691 - DNA, 15 bp, Homo sapiens
aaaaaaagataaatt

SEQ ID NO: 13692 - DNA, 15 bp, Homo sapiens
aaaaaaaagataaat

SEQ ID NO: 13693 - DNA, 15 bp, Homo sapiens
gaaaaaaaagataaa

SEQ ID NO: 13694 - DNA, 15 bp, Homo sapiens
ggaaaaaaaagataa

SEQ ID NO: 13695 - DNA, 15 bp, Homo sapiens
gggaaaaaaaagata

SEQ ID NO: 13696 - DNA, 15 bp, Homo sapiens
ggggaaaaaaaagat

SEQ ID NO: 13697 - DNA, 15 bp, Homo sapiens
gggggaaaaaaaaga

SEQ ID NO: 13698 - DNA, 15 bp, Homo sapiens
tgggggaaaaaaaag

SEQ ID NO: 13699 - DNA, 15 bp, Homo sapiens
ttgggggaaaaaaaa

SEQ ID NO: 13700 - DNA, 15 bp, Homo sapiens
cttgggggaaaaaaa

SEQ ID NO: 13701 - DNA, 15 bp, Homo sapiens
tcttgggggaaaaaa

SEQ ID NO: 13702 - DNA, 15 bp, Homo sapiens
gtcttgggggaaaaa

SEQ ID NO: 13703 - DNA, 15 bp, Homo sapiens
tgtcttgggggaaaa

SEQ ID NO: 13704 - DNA, 15 bp, Homo sapiens
ctgtcttgggggaaa

SEQ ID NO: 13705 - DNA, 15 bp, Homo sapiens
gctgtcttgggggaa

SEQ ID NO: 13706 - DNA, 15 bp, Homo sapiens
agctgtcttggggga

SEQ ID NO: 13707 - DNA, 15 bp, Homo sapiens
aagctgtcttggggg

SEQ ID NO: 13708 - DNA, 15 bp, Homo sapiens
gaagctgtcttgggg

SEQ ID NO: 13709 - DNA, 15 bp, Homo sapiens
tgaagctgtcttggg

SEQ ID NO: 13710 - DNA, 15 bp, Homo sapiens
gtgaagctgtcttgg

SEQ ID NO: 13711 - DNA, 15 bp, Homo sapiens
agtgaagctgtcttg

SEQ ID NO: 13712 - DNA, 15 bp, Homo sapiens
gagtgaagctgtctt

SEQ ID NO: 13713 - DNA, 15 bp, Homo sapiens
agagtgaagctgtct

SEQ ID NO: 13714 - DNA, 15 bp, Homo sapiens
aagagtgaagctgtc

SEQ ID NO: 13715 - DNA, 15 bp, Homo sapiens
caagagtgaagctgt

SEQ ID NO: 13716 - DNA, 15 bp, Homo sapiens
gcaagagtgaagctg

SEQ ID NO: 13717 - DNA, 15 bp, Homo sapiens
ggcaagagtgaagct

SEQ ID NO: 13718 - DNA, 15 bp, Homo sapiens
gggcaagagtgaagc

SEQ ID NO: 13719 - DNA, 15 bp, Homo sapiens
tgggcaagagtgaag

SEQ ID NO: 13720 - DNA, 15 bp, Homo sapiens
ctgggcaagagtgaa

SEQ ID NO: 13721 - DNA, 15 bp, Homo sapiens
cctgggcaagagtga

SEQ ID NO: 13722 - DNA, 15 bp, Homo sapiens
gcctgggcaagagtg

SEQ ID NO: 13723 - DNA, 15 bp, Homo sapiens
agcctgggcaagagt

SEQ ID NO: 13724 - DNA, 15 bp, Homo sapiens
cagcctgggcaagag

SEQ ID NO: 13725 - DNA, 15 bp, Homo sapiens
ccagcctgggcaaga

SEQ ID NO: 13726 - DNA, 15 bp, Homo sapiens
tccagcctgggcaag

SEQ ID NO: 13727 - DNA, 15 bp, Homo sapiens
acactgcactccagc

SEQ ID NO: 13728 - DNA, 15 bp, Homo sapiens
gacactgcactccag

SEQ ID NO: 13729 - DNA, 15 bp, Homo sapiens
tgacactgcactcca

SEQ ID NO: 13730 - DNA, 15 bp, Homo sapiens
atgacactgcactcc

SEQ ID NO: 13731 - DNA, 15 bp, Homo sapiens
tatgacactgcactc

SEQ ID NO: 13732 - DNA, 15 bp, Homo sapiens
ttatgacactgcact

SEQ ID NO: 13733 - DNA, 15 bp, Homo sapiens
attatgacactgcac

SEQ ID NO: 13734 - DNA, 15 bp, Homo sapiens
gattatgacactgca

SEQ ID NO: 13735 - DNA, 15 bp, Homo sapiens
tgattatgacactgc

SEQ ID NO: 13736 - DNA, 15 bp, Homo sapiens
gtgattatgacactg

SEQ ID NO: 13737 - DNA, 15 bp, Homo sapiens
tgtgattatgacact

SEQ ID NO: 13738 - DNA, 15 bp, Homo sapiens
ctgtgattatgacac

SEQ ID NO: 13739 - DNA, 15 bp, Homo sapiens
gctgtgattatgaca

SEQ ID NO: 13740 - DNA, 15 bp, Homo sapiens
agctgtgattatgac

SEQ ID NO: 13741 - DNA, 15 bp, Homo sapiens
gagctgtgattatga

SEQ ID NO: 13742 - DNA, 15 bp, Homo sapiens
tgagctgtgattatg

SEQ ID NO: 13743 - DNA, 15 bp, Homo sapiens
gtgagctgtgattat

SEQ ID NO: 13744 - DNA, 15 bp, Homo sapiens
agtgagctgtgatta

SEQ ID NO: 13745 - DNA, 15 bp, Homo sapiens
gagtgagctgtgatt

SEQ ID NO: 13746 - DNA, 15 bp, Homo sapiens
ggagtgagctgtgat

SEQ ID NO: 13747 - DNA, 15 bp, Homo sapiens
tggagtgagctgtga

SEQ ID NO: 13748 - DNA, 15 bp, Homo sapiens
ttggagtgagctgtg

SEQ ID NO: 13749 - DNA, 15 bp, Homo sapiens
attggagtgagctgt

SEQ ID NO: 13750 - DNA, 15 bp, Homo sapiens
gattggagtgagctg

SEQ ID NO: 13751 - DNA, 15 bp, Homo sapiens
agattggagtgagct

SEQ ID NO: 13752 - DNA, 15 bp, Homo sapiens
gagattggagtgagc

SEQ ID NO: 13753 - DNA, 15 bp, Homo sapiens
agagattggagtgag

SEQ ID NO: 13754 - DNA, 15 bp, Homo sapiens
cagagattggagtga

SEQ ID NO: 13755 - DNA, 15 bp, Homo sapiens
gcagagattggagtg

SEQ ID NO: 13756 - DNA, 15 bp, Homo sapiens
ggcagagattggagt

SEQ ID NO: 13757 - DNA, 15 bp, Homo sapiens
aggcagagattggag

SEQ ID NO: 13758 - DNA, 15 bp, Homo sapiens
gaggcagagattgga

SEQ ID NO: 13759 - DNA, 15 bp, Homo sapiens
cgaggcagagattgg

SEQ ID NO: 13760 - DNA, 15 bp, Homo sapiens
gcgaggcagagattg

SEQ ID NO: 13761 - DNA, 15 bp, Homo sapiens
tgcgaggcagagatt

SEQ ID NO: 13762 - DNA, 15 bp, Homo sapiens
ctgcgaggcagagat

SEQ ID NO: 13763 - DNA, 15 bp, Homo sapiens
cctgcgaggcagaga

SEQ ID NO: 13764 - DNA, 15 bp, Homo sapiens
gcctgcgaggcagag

SEQ ID NO: 13765 - DNA, 15 bp, Homo sapiens
agcctgcgaggcaga

SEQ ID NO: 13766 - DNA, 15 bp, Homo sapiens
aagcctgcgaggcag

SEQ ID NO: 13767 - DNA, 15 bp, Homo sapiens
taagcctgcgaggca

SEQ ID NO: 13768 - DNA, 15 bp, Homo sapiens
ctaagcctgcgaggc

SEQ ID NO: 13769 - DNA, 15 bp, Homo sapiens
actaagcctgcgagg

SEQ ID NO: 13770 - DNA, 15 bp, Homo sapiens
cactaagcctgcgag

SEQ ID NO: 13771 - DNA, 15 bp, Homo sapiens
tcactaagcctgcga

SEQ ID NO: 13772 - DNA, 15 bp, Homo sapiens
atcactaagcctgcg

SEQ ID NO: 13773 - DNA, 15 bp, Homo sapiens
gatcactaagcctgc

SEQ ID NO: 13774 - DNA, 15 bp, Homo sapiens
ggatcactaagcctg

SEQ ID NO: 13775 - DNA, 15 bp, Homo sapiens
aggatcactaagcct

SEQ ID NO: 13776 - DNA, 15 bp, Homo sapiens
gaggatcactaagcc

SEQ ID NO: 13777 - DNA, 15 bp, Homo sapiens
ggaggatcactaagc

SEQ ID NO: 13778 - DNA, 15 bp, Homo sapiens
gggaggatcactaag

SEQ ID NO: 13779 - DNA, 15 bp, Homo sapiens
tgggaggatcactaa

SEQ ID NO: 13780 - DNA, 15 bp, Homo sapiens
gtgggaggatcacta

SEQ ID NO: 13781 - DNA, 15 bp, Homo sapiens
ggtgggaggatcact

SEQ ID NO: 13782 - DNA, 15 bp, Homo sapiens
aggtgggaggatcac

SEQ ID NO: 13783 - DNA, 15 bp, Homo sapiens
gaggtgggaggatca

SEQ ID NO: 13784 - DNA, 15 bp, Homo sapiens
tgaggtgggaggatc

SEQ ID NO: 13785 - DNA, 15 bp, Homo sapiens
ctgaggtgggaggat

SEQ ID NO: 13786 - DNA, 15 bp, Homo sapiens
gctgaggtgggagga

SEQ ID NO: 13787 - DNA, 15 bp, Homo sapiens
ggctgaggtgggagg

SEQ ID NO: 13788 - DNA, 15 bp, Homo sapiens
aggctgaggtgggag

SEQ ID NO: 13789 - DNA, 15 bp, Homo sapiens
gaggctgaggtggga

SEQ ID NO: 13790 - DNA, 15 bp, Homo sapiens
aggaggctgaggtgg

SEQ ID NO: 13791 - DNA, 15 bp, Homo sapiens
caggaggctgaggtg

SEQ ID NO: 13792 - DNA, 15 bp, Homo sapiens
tcaggaggctgaggt

SEQ ID NO: 13793 - DNA, 15 bp, Homo sapiens
gctcaggaggctgag

SEQ ID NO: 13794 - DNA, 15 bp, Homo sapiens
tgctcaggaggctga

SEQ ID NO: 13795 - DNA, 15 bp, Homo sapiens
ctgctcaggaggctg

SEQ ID NO: 13796 - DNA, 15 bp, Homo sapiens
gctgctcaggaggct

SEQ ID NO: 13797 - DNA, 15 bp, Homo sapiens
agctgctcaggaggc

SEQ ID NO: 13798 - DNA, 15 bp, Homo sapiens
cagctgctcaggagg

SEQ ID NO: 13799 - DNA, 15 bp, Homo sapiens
tcagctgctcaggag

SEQ ID NO: 13800 - DNA, 15 bp, Homo sapiens
ctcagctgctcagga

SEQ ID NO: 13801 - DNA, 15 bp, Homo sapiens
tctcagctgctcagg

SEQ ID NO: 13802 - DNA, 15 bp, Homo sapiens
gtctcagctgctcag

SEQ ID NO: 13803 - DNA, 15 bp, Homo sapiens
agtctcagctgctca

SEQ ID NO: 13804 - DNA, 15 bp, Homo sapiens
cagtctcagctgctc

SEQ ID NO: 13805 - DNA, 15 bp, Homo sapiens
gcagtctcagctgct

SEQ ID NO: 13806 - DNA, 15 bp, Homo sapiens
tgcagtctcagctgc

SEQ ID NO: 13807 - DNA, 15 bp, Homo sapiens
ctgcagtctcagctg

SEQ ID NO: 13808 - DNA, 15 bp, Homo sapiens
cctgcagtctcagct

SEQ ID NO: 13809 - DNA, 15 bp, Homo sapiens
acctgcagtctcagc

SEQ ID NO: 13810 - DNA, 15 bp, Homo sapiens
cacctgcagtctcag

SEQ ID NO: 13811 - DNA, 15 bp, Homo sapiens
acacctgcagtctca

SEQ ID NO: 13812 - DNA, 15 bp, Homo sapiens
tacacctgcagtctc

SEQ ID NO: 13813 - DNA, 15 bp, Homo sapiens
atacacctgcagtct

SEQ ID NO: 13814 - DNA, 15 bp, Homo sapiens
catacacctgcagtc

SEQ ID NO: 13815 - DNA, 15 bp, Homo sapiens
ccatacacctgcagt

SEQ ID NO: 13816 - DNA, 15 bp, Homo sapiens
gccatacacctgcag

SEQ ID NO: 13817 - DNA, 15 bp, Homo sapiens
tgccatacacctgca

SEQ ID NO: 13818 - DNA, 15 bp, Homo sapiens
gtgccatacacctgc

SEQ ID NO: 13819 - DNA, 15 bp, Homo sapiens
ggtgccatacacctg

SEQ ID NO: 13820 - DNA, 15 bp, Homo sapiens
tggtgccatacacct

SEQ ID NO: 13821 - DNA, 15 bp, Homo sapiens
atggtgccatacacc

SEQ ID NO: 13822 - DNA, 15 bp, Homo sapiens
catggtgccatacac

SEQ ID NO: 13823 - DNA, 15 bp, Homo sapiens
acatggtgccataca

SEQ ID NO: 13824 - DNA, 15 bp, Homo sapiens
gacatggtgccatac

SEQ ID NO: 13825 - DNA, 15 bp, Homo sapiens
tgacatggtgccata

SEQ ID NO: 13826 - DNA, 15 bp, Homo sapiens
ctgacatggtgccat

SEQ ID NO: 13827 - DNA, 15 bp, Homo sapiens
cctgacatggtgcca

SEQ ID NO: 13828 - DNA, 15 bp, Homo sapiens
tcctgacatggtgcc

SEQ ID NO: 13829 - DNA, 15 bp, Homo sapiens
atcctgacatggtgc

SEQ ID NO: 13830 - DNA, 15 bp, Homo sapiens
tatcctgacatggtg

SEQ ID NO: 13831 - DNA, 15 bp, Homo sapiens
ttatcctgacatggt

SEQ ID NO: 13832 - DNA, 15 bp, Homo sapiens
attatcctgacatgg

SEQ ID NO: 13833 - DNA, 15 bp, Homo sapiens
aattatcctgacatg

SEQ ID NO: 13834 - DNA, 15 bp, Homo sapiens
aaattatcctgacat

SEQ ID NO: 13835 - DNA, 15 bp, Homo sapiens
aaaattatcctgaca

SEQ ID NO: 13836 - DNA, 15 bp, Homo sapiens
aaaaattatcctgac

SEQ ID NO: 13837 - DNA, 15 bp, Homo sapiens
caaaaattatcctga

SEQ ID NO: 13838 - DNA, 15 bp, Homo sapiens
gcaaaaattatcctg

SEQ ID NO: 13839 - DNA, 15 bp, Homo sapiens
tgcaaaaattatcct

SEQ ID NO: 13840 - DNA, 15 bp, Homo sapiens
atgcaaaaattatcc

SEQ ID NO: 13841 - DNA, 15 bp, Homo sapiens
aatgcaaaaattatc

SEQ ID NO: 13842 - DNA, 15 bp, Homo sapiens
aaatgcaaaaattat

SEQ ID NO: 13843 - DNA, 15 bp, Homo sapiens
aaaatgcaaaaatta

SEQ ID NO: 13844 - DNA, 15 bp, Homo sapiens
aaaaatgcaaaaatt

SEQ ID NO: 13845 - DNA, 15 bp, Homo sapiens
gaaaaatgcaaaaat

SEQ ID NO: 13846 - DNA, 15 bp, Homo sapiens
cgaaaaatgcaaaaa

SEQ ID NO: 13847 - DNA, 15 bp, Homo sapiens
acgaaaaatgcaaaa

SEQ ID NO: 13848 - DNA, 15 bp, Homo sapiens
tacgaaaaatgcaaa

SEQ ID NO: 13849 - DNA, 15 bp, Homo sapiens
ctacgaaaaatgcaa

SEQ ID NO: 13850 - DNA, 15 bp, Homo sapiens
tctacgaaaaatgca

SEQ ID NO: 13851 - DNA, 15 bp, Homo sapiens
ctctacgaaaaatgc

SEQ ID NO: 13852 - DNA, 15 bp, Homo sapiens
tctctacgaaaaatg

SEQ ID NO: 13853 - DNA, 15 bp, Homo sapiens
gtctctacgaaaaat

SEQ ID NO: 13854 - DNA, 15 bp, Homo sapiens
tgtctctacgaaaaa

SEQ ID NO: 13855 - DNA, 15 bp, Homo sapiens
gtgtctctacgaaaa

SEQ ID NO: 13856 - DNA, 15 bp, Homo sapiens
agtgtctctacgaaa

SEQ ID NO: 13857 - DNA, 15 bp, Homo sapiens
cagtgtctctacgaa

SEQ ID NO: 13858 - DNA, 15 bp, Homo sapiens
acagtgtctctacga

SEQ ID NO: 13859 - DNA, 15 bp, Homo sapiens
gacagtgtctctacg

SEQ ID NO: 13860 - DNA, 15 bp, Homo sapiens
agacagtgtctctac

SEQ ID NO: 13861 - DNA, 15 bp, Homo sapiens
gagacagtgtctcta

SEQ ID NO: 13862 - DNA, 15 bp, Homo sapiens
cgagacagtgtctct

SEQ ID NO: 13863 - DNA, 15 bp, Homo sapiens
acgagacagtgtctc

SEQ ID NO: 13864 - DNA, 15 bp, Homo sapiens
aacgagacagtgtct

SEQ ID NO: 13865 - DNA, 15 bp, Homo sapiens
taacgagacagtgtc

SEQ ID NO: 13866 - DNA, 15 bp, Homo sapiens
ataacgagacagtgt

SEQ ID NO: 13867 - DNA, 15 bp, Homo sapiens
cataacgagacagtg

SEQ ID NO: 13868 - DNA, 15 bp, Homo sapiens
acataacgagacagt

SEQ ID NO: 13869 - DNA, 15 bp, Homo sapiens
aacataacgagacag

SEQ ID NO: 13870 - DNA, 15 bp, Homo sapiens
gaacataacgagaca

SEQ ID NO: 13871 - DNA, 15 bp, Homo sapiens
tgaacataacgagac

SEQ ID NO: 13872 - DNA, 15 bp, Homo sapiens
ctgaacataacgaga

SEQ ID NO: 13873 - DNA, 15 bp, Homo sapiens
gctgaacataacgag

SEQ ID NO: 13874 - DNA, 15 bp, Homo sapiens
ggctgaacataacga

SEQ ID NO: 13875 - DNA, 15 bp, Homo sapiens
gggctgaacataacg

SEQ ID NO: 13876 - DNA, 15 bp, Homo sapiens
tgggctgaacataac

SEQ ID NO: 13877 - DNA, 15 bp, Homo sapiens
ctgggctgaacataa

SEQ ID NO: 13878 - DNA, 15 bp, Homo sapiens
cctgggctgaacata

SEQ ID NO: 13879 - DNA, 15 bp, Homo sapiens
acctgggctgaacat

SEQ ID NO: 13880 - DNA, 15 bp, Homo sapiens
aacctgggctgaaca

SEQ ID NO: 13881 - DNA, 15 bp, Homo sapiens
caacctgggctgaac

SEQ ID NO: 13882 - DNA, 15 bp, Homo sapiens
ccaacctgggctgaa

SEQ ID NO: 13883 - DNA, 15 bp, Homo sapiens
accaacctgggctga

SEQ ID NO: 13884 - DNA, 15 bp, Homo sapiens
gaccaacctgggctg

SEQ ID NO: 13885 - DNA, 15 bp, Homo sapiens
agaccaacctgggct

SEQ ID NO: 13886 - DNA, 15 bp, Homo sapiens
cagaccaacctgggc

SEQ ID NO: 13887 - DNA, 15 bp, Homo sapiens
ccagaccaacctggg

SEQ ID NO: 13888 - DNA, 15 bp, Homo sapiens
tccagaccaacctgg

SEQ ID NO: 13889 - DNA, 15 bp, Homo sapiens
ccaagagttccagac

SEQ ID NO: 13890 - DNA, 15 bp, Homo sapiens
cccaagagttccaga

SEQ ID NO: 13891 - DNA, 15 bp, Homo sapiens
gcccaagagttccag

SEQ ID NO: 13892 - DNA, 15 bp, Homo sapiens
agcccaagagttcca

SEQ ID NO: 13893 - DNA, 15 bp, Homo sapiens
gagcccaagagttcc

SEQ ID NO: 13894 - DNA, 15 bp, Homo sapiens
tgagcccaagagttc

SEQ ID NO: 13895 - DNA, 15 bp, Homo sapiens
ttgagcccaagagtt

SEQ ID NO: 13896 - DNA, 15 bp, Homo sapiens
cttgagcccaagagt

SEQ ID NO: 13897 - DNA, 15 bp, Homo sapiens
gcttgagcccaagag

SEQ ID NO: 13898 - DNA, 15 bp, Homo sapiens
tgcttgagcccaaga

SEQ ID NO: 13899 - DNA, 15 bp, Homo sapiens
ctgcttgagcccaag

SEQ ID NO: 13900 - DNA, 15 bp, Homo sapiens
actgcttgagcccaa

SEQ ID NO: 13901 - DNA, 15 bp, Homo sapiens
gactgcttgagccca

SEQ ID NO: 13902 - DNA, 15 bp, Homo sapiens
ggactgcttgagccc

SEQ ID NO: 13903 - DNA, 15 bp, Homo sapiens
aggactgcttgagcc

SEQ ID NO: 13904 - DNA, 15 bp, Homo sapiens
gaggactgcttgagc

SEQ ID NO: 13905 - DNA, 15 bp, Homo sapiens
agaggactgcttgag

SEQ ID NO: 13906 - DNA, 15 bp, Homo sapiens
aagaggactgcttga

SEQ ID NO: 13907 - DNA, 15 bp, Homo sapiens
taagaggactgcttg

SEQ ID NO: 13908 - DNA, 15 bp, Homo sapiens
gtaagaggactgctt

SEQ ID NO: 13909 - DNA, 15 bp, Homo sapiens
ggtaagaggactgct

SEQ ID NO: 13910 - DNA, 15 bp, Homo sapiens
aggtaagaggactgc

SEQ ID NO: 13911 - DNA, 15 bp, Homo sapiens
gaggtaagaggactg

SEQ ID NO: 13912 - DNA, 15 bp, Homo sapiens
tgaggtaagaggact

SEQ ID NO: 13913 - DNA, 15 bp, Homo sapiens
ctgaggtaagaggac

SEQ ID NO: 13914 - DNA, 15 bp, Homo sapiens
gctgaggtaagagga

SEQ ID NO: 13915 - DNA, 15 bp, Homo sapiens
ggctgaggtaagagg

SEQ ID NO: 13916 - DNA, 15 bp, Homo sapiens
aggctgaggtaagag

SEQ ID NO: 13917 - DNA, 15 bp, Homo sapiens
gaggctgaggtaaga

SEQ ID NO: 13918 - DNA, 15 bp, Homo sapiens
ggaggctgaggtaag

SEQ ID NO: 13919 - DNA, 15 bp, Homo sapiens
gggaggctgaggtaa

SEQ ID NO: 13920 - DNA, 15 bp, Homo sapiens
tgggaggctgaggta

SEQ ID NO: 13921 - DNA, 15 bp, Homo sapiens
cttttgggaggctga

SEQ ID NO: 13922 - DNA, 15 bp, Homo sapiens
acttttgggaggctg

SEQ ID NO: 13923 - DNA, 15 bp, Homo sapiens
cacttttgggaggct

SEQ ID NO: 13924 - DNA, 15 bp, Homo sapiens
gcacttttgggaggc

SEQ ID NO: 13925 - DNA, 15 bp, Homo sapiens
agcacttttgggagg

SEQ ID NO: 13926 - DNA, 15 bp, Homo sapiens
cagcacttttgggag

SEQ ID NO: 13927 - DNA, 15 bp, Homo sapiens
ccagcacttttggga

SEQ ID NO: 13928 - DNA, 15 bp, Homo sapiens
cccagcacttttggg

SEQ ID NO: 13929 - DNA, 15 bp, Homo sapiens
tcccagcacttttgg

SEQ ID NO: 13930 - DNA, 15 bp, Homo sapiens
atcccagcacttttg

SEQ ID NO: 13931 - DNA, 15 bp, Homo sapiens
aatcccagcactttt

SEQ ID NO: 13932 - DNA, 15 bp, Homo sapiens
ctcatgcctgtaatc

SEQ ID NO: 13933 - DNA, 15 bp, Homo sapiens
gctcatgcctgtaat

SEQ ID NO: 13934 - DNA, 15 bp, Homo sapiens
agctcatgcctgtaa

SEQ ID NO: 13935 - DNA, 15 bp, Homo sapiens
tagctcatgcctgta

SEQ ID NO: 13936 - DNA, 15 bp, Homo sapiens
gtagctcatgcctgt

SEQ ID NO: 13937 - DNA, 15 bp, Homo sapiens
agtagctcatgcctg

SEQ ID NO: 13938 - DNA, 15 bp, Homo sapiens
cagtagctcatgcct

SEQ ID NO: 13939 - DNA, 15 bp, Homo sapiens
acagtagctcatgcc

SEQ ID NO: 13940 - DNA, 15 bp, Homo sapiens
cacagtagctcatgc

SEQ ID NO: 13941 - DNA, 15 bp, Homo sapiens
gcacagtagctcatg

SEQ ID NO: 13942 - DNA, 15 bp, Homo sapiens
agcacagtagctcat

SEQ ID NO: 13943 - DNA, 15 bp, Homo sapiens
gagcacagtagctca

SEQ ID NO: 13944 - DNA, 15 bp, Homo sapiens
tgagcacagtagctc

SEQ ID NO: 13945 - DNA, 15 bp, Homo sapiens
ctgagcacagtagct

SEQ ID NO: 13946 - DNA, 15 bp, Homo sapiens
gctgagcacagtagc

SEQ ID NO: 13947 - DNA, 15 bp, Homo sapiens
agctgagcacagtag

SEQ ID NO: 13948 - DNA, 15 bp, Homo sapiens
cagctgagcacagta

SEQ ID NO: 13949 - DNA, 15 bp, Homo sapiens
tcagctgagcacagt

SEQ ID NO: 13950 - DNA, 15 bp, Homo sapiens
atcagctgagcacag

SEQ ID NO: 13951 - DNA, 15 bp, Homo sapiens
tatcagctgagcaca

SEQ ID NO: 13952 - DNA, 15 bp, Homo sapiens
ttatcagctgagcac

SEQ ID NO: 13953 - DNA, 15 bp, Homo sapiens
attatcagctgagca

SEQ ID NO: 13954 - DNA, 15 bp, Homo sapiens
aattatcagctgagc

SEQ ID NO: 13955 - DNA, 15 bp, Homo sapiens
aaattatcagctgag

SEQ ID NO: 13956 - DNA, 15 bp, Homo sapiens
taaattatcagctga

SEQ ID NO: 13957 - DNA, 15 bp, Homo sapiens
ttaaattatcagctg

SEQ ID NO: 13958 - DNA, 15 bp, Homo sapiens
cttaaattatcagct

SEQ ID NO: 13959 - DNA, 15 bp, Homo sapiens
gcttaaattatcagc

SEQ ID NO: 13960 - DNA, 15 bp, Homo sapiens
tgcttaaattatcag

SEQ ID NO: 13961 - DNA, 15 bp, Homo sapiens
gtgcttaaattatca

SEQ ID NO: 13962 - DNA, 15 bp, Homo sapiens
tgtgcttaaattatc

SEQ ID NO: 13963 - DNA, 15 bp, Homo sapiens
atgtgcttaaattat

SEQ ID NO: 13964 - DNA, 15 bp, Homo sapiens
catgtgcttaaatta

SEQ ID NO: 13965 - DNA, 15 bp, Homo sapiens
gcatgtgcttaaatt

SEQ ID NO: 13966 - DNA, 15 bp, Homo sapiens
tgcatgtgcttaaat

SEQ ID NO: 13967 - DNA, 15 bp, Homo sapiens
ttgcatgtgcttaaa

SEQ ID NO: 13968 - DNA, 15 bp, Homo sapiens
tttgcatgtgcttaa

SEQ ID NO: 13969 - DNA, 15 bp, Homo sapiens
ttttgcatgtgctta

SEQ ID NO: 13970 - DNA, 15 bp, Homo sapiens
attttgcatgtgctt

SEQ ID NO: 13971 - DNA, 15 bp, Homo sapiens
tattttgcatgtgct

SEQ ID NO: 13972 - DNA, 15 bp, Homo sapiens
gtattttgcatgtgc

SEQ ID NO: 13973 - DNA, 15 bp, Homo sapiens
tgtattttgcatgtg

SEQ ID NO: 13974 - DNA, 15 bp, Homo sapiens
ctgtattttgcatgt

SEQ ID NO: 13975 - DNA, 15 bp, Homo sapiens
actgtattttgcatg

SEQ ID NO: 13976 - DNA, 15 bp, Homo sapiens
cactgtattttgcat

SEQ ID NO: 13977 - DNA, 15 bp, Homo sapiens
gcactgtattttgca

SEQ ID NO: 13978 - DNA, 15 bp, Homo sapiens
agcactgtattttgc

SEQ ID NO: 13979 - DNA, 15 bp, Homo sapiens
gagcactgtattttg

SEQ ID NO: 13980 - DNA, 15 bp, Homo sapiens
tgagcactgtatttt

SEQ ID NO: 13981 - DNA, 15 bp, Homo sapiens
atgagcactgtattt

SEQ ID NO: 13982 - DNA, 15 bp, Homo sapiens
catgagcactgtatt

SEQ ID NO: 13983 - DNA, 15 bp, Homo sapiens
ccatgagcactgtat

SEQ ID NO: 13984 - DNA, 15 bp, Homo sapiens
cccatgagcactgta

SEQ ID NO: 13985 - DNA, 15 bp, Homo sapiens
tcccatgagcactgt

SEQ ID NO: 13986 - DNA, 15 bp, Homo sapiens
atcccatgagcactg

SEQ ID NO: 13987 - DNA, 15 bp, Homo sapiens
tatcccatgagcact

SEQ ID NO: 13988 - DNA, 15 bp, Homo sapiens
atatcccatgagcac

SEQ ID NO: 13989 - DNA, 15 bp, Homo sapiens
aatatcccatgagca

SEQ ID NO: 13990 - DNA, 15 bp, Homo sapiens
aaatatcccatgagc

SEQ ID NO: 13991 - DNA, 15 bp, Homo sapiens
caaatatcccatgag

SEQ ID NO: 13992 - DNA, 15 bp, Homo sapiens
acaaatatcccatga

SEQ ID NO: 13993 - DNA, 15 bp, Homo sapiens
aacaaatatcccatg

SEQ ID NO: 13994 - DNA, 15 bp, Homo sapiens
aaacaaatatcccat

SEQ ID NO: 13995 - DNA, 15 bp, Homo sapiens
taaacaaatatccca

SEQ ID NO: 13996 - DNA, 15 bp, Homo sapiens
ttaaacaaatatccc

SEQ ID NO: 13997 - DNA, 15 bp, Homo sapiens
gttaaacaaatatcc

SEQ ID NO: 13998 - DNA, 15 bp, Homo sapiens
ggttaaacaaatatc

SEQ ID NO: 13999 - DNA, 15 bp, Homo sapiens
aggttaaacaaatat

SEQ ID NO: 14000 - DNA, 15 bp, Homo sapiens
aaggttaaacaaata

SEQ ID NO: 14001 - DNA, 15 bp, Homo sapiens
caaggttaaacaaat

SEQ ID NO: 14002 - DNA, 15 bp, Homo sapiens
tcaaggttaaacaaa

SEQ ID NO: 14003 - DNA, 15 bp, Homo sapiens
ctcaaggttaaacaa

SEQ ID NO: 14004 - DNA, 15 bp, Homo sapiens
gctcaaggttaaaca

SEQ ID NO: 14005 - DNA, 15 bp, Homo sapiens
tgctcaaggttaaac

SEQ ID NO: 14006 - DNA, 15 bp, Homo sapiens
ctgctcaaggttaaa

SEQ ID NO: 14007 - DNA, 15 bp, Homo sapiens
actgctcaaggttaa

SEQ ID NO: 14008 - DNA, 15 bp, Homo sapiens
gactgctcaaggtta

SEQ ID NO: 14009 - DNA, 15 bp, Homo sapiens
ggactgctcaaggtt

SEQ ID NO: 14010 - DNA, 15 bp, Homo sapiens
tggactgctcaaggt

SEQ ID NO: 14011 - DNA, 15 bp, Homo sapiens
ctggactgctcaagg

SEQ ID NO: 14012 - DNA, 15 bp, Homo sapiens
actggactgctcaag

SEQ ID NO: 14013 - DNA, 15 bp, Homo sapiens
aactggactgctcaa

SEQ ID NO: 14014 - DNA, 15 bp, Homo sapiens
taactggactgctca

SEQ ID NO: 14015 - DNA, 15 bp, Homo sapiens
ttaactggactgctc

SEQ ID NO: 14016 - DNA, 15 bp, Homo sapiens
tttaactggactgct

SEQ ID NO: 14017 - DNA, 15 bp, Homo sapiens
atttaactggactgc

SEQ ID NO: 14018 - DNA, 15 bp, Homo sapiens
aatttaactggactg

SEQ ID NO: 14019 - DNA, 15 bp, Homo sapiens
gaatttaactggact

SEQ ID NO: 14020 - DNA, 15 bp, Homo sapiens
ggaatttaactggac

SEQ ID NO: 14021 - DNA, 15 bp, Homo sapiens
tggaatttaactgga

SEQ ID NO: 14022 - DNA, 15 bp, Homo sapiens
gtggaatttaactgg

SEQ ID NO: 14023 - DNA, 15 bp, Homo sapiens
ggtggaatttaactg

SEQ ID NO: 14024 - DNA, 15 bp, Homo sapiens
gggtggaatttaact

SEQ ID NO: 14025 - DNA, 15 bp, Homo sapiens
tgggtggaatttaac

SEQ ID NO: 14026 - DNA, 15 bp, Homo sapiens
ttgggtggaatttaa

SEQ ID NO: 14027 - DNA, 15 bp, Homo sapiens
gttgggtggaattta

SEQ ID NO: 14028 - DNA, 15 bp, Homo sapiens
tgttgggtggaattt

SEQ ID NO: 14029 - DNA, 15 bp, Homo sapiens
atgttgggtggaatt

SEQ ID NO: 14030 - DNA, 15 bp, Homo sapiens
catgttgggtggaat

SEQ ID NO: 14031 - DNA, 15 bp, Homo sapiens
tcatgttgggtggaa

SEQ ID NO: 14032 - DNA, 15 bp, Homo sapiens
atcatgttgggtgga

SEQ ID NO: 14033 - DNA, 15 bp, Homo sapiens
gatcatgttgggtgg

SEQ ID NO: 14034 - DNA, 15 bp, Homo sapiens
agatcatgttgggtg

SEQ ID NO: 14035 - DNA, 15 bp, Homo sapiens
aagatcatgttgggt

SEQ ID NO: 14036 - DNA, 15 bp, Homo sapiens
caagatcatgttggg

SEQ ID NO: 14037 - DNA, 15 bp, Homo sapiens
tcaagatcatgttgg

SEQ ID NO: 14038 - DNA, 15 bp, Homo sapiens
ttcaagatcatgttg

SEQ ID NO: 14039 - DNA, 15 bp, Homo sapiens
cttcaagatcatgtt

SEQ ID NO: 14040 - DNA, 15 bp, Homo sapiens
ccttcaagatcatgt

SEQ ID NO: 14041 - DNA, 15 bp, Homo sapiens
cccttcaagatcatg

SEQ ID NO: 14042 - DNA, 15 bp, Homo sapiens
acccttcaagatcat

SEQ ID NO: 14043 - DNA, 15 bp, Homo sapiens
tacccttcaagatca

SEQ ID NO: 14044 - DNA, 15 bp, Homo sapiens
ttacccttcaagatc

SEQ ID NO: 14045 - DNA, 15 bp, Homo sapiens
cttacccttcaagat

SEQ ID NO: 14046 - DNA, 15 bp, Homo sapiens
tcttacccttcaaga

SEQ ID NO: 14047 - DNA, 15 bp, Homo sapiens
ttcttacccttcaag

SEQ ID NO: 14048 - DNA, 15 bp, Homo sapiens
attcttacccttcaa

SEQ ID NO: 14049 - DNA, 15 bp, Homo sapiens
cattcttacccttca

SEQ ID NO: 14050 - DNA, 15 bp, Homo sapiens
acattcttacccttc

SEQ ID NO: 14051 - DNA, 15 bp, Homo sapiens
gacattcttaccctt

SEQ ID NO: 14052 - DNA, 15 bp, Homo sapiens
agacattcttaccct

SEQ ID NO: 14053 - DNA, 15 bp, Homo sapiens
cagacattcttaccc

SEQ ID NO: 14054 - DNA, 15 bp, Homo sapiens
tcagacattcttacc

SEQ ID NO: 14055 - DNA, 15 bp, Homo sapiens
atcagacattcttac

SEQ ID NO: 14056 - DNA, 15 bp, Homo sapiens
tatcagacattctta

SEQ ID NO: 14057 - DNA, 15 bp, Homo sapiens
atatcagacattctt

SEQ ID NO: 14058 - DNA, 15 bp, Homo sapiens
catatcagacattct

SEQ ID NO: 14059 - DNA, 15 bp, Homo sapiens
tcatatcagacattc

SEQ ID NO: 14060 - DNA, 15 bp, Homo sapiens
ctcatatcagacatt

SEQ ID NO: 14061 - DNA, 15 bp, Homo sapiens
tctcatatcagacat

SEQ ID NO: 14062 - DNA, 15 bp, Homo sapiens
atctcatatcagaca

SEQ ID NO: 14063 - DNA, 15 bp, Homo sapiens
aatctcatatcagac

SEQ ID NO: 14064 - DNA, 15 bp, Homo sapiens
caatctcatatcaga

SEQ ID NO: 14065 - DNA, 15 bp, Homo sapiens
tcaatctcatatcag

SEQ ID NO: 14066 - DNA, 15 bp, Homo sapiens
ttcaatctcatatca

SEQ ID NO: 14067 - DNA, 15 bp, Homo sapiens
tttcaatctcatatc

SEQ ID NO: 14068 - DNA, 15 bp, Homo sapiens
atttcaatctcatat

SEQ ID NO: 14069 - DNA, 15 bp, Homo sapiens
aatttcaatctcata

SEQ ID NO: 14070 - DNA, 15 bp, Homo sapiens
taatttcaatctcat

SEQ ID NO: 14071 - DNA, 15 bp, Homo sapiens
ttaatttcaatctca

SEQ ID NO: 14072 - DNA, 15 bp, Homo sapiens
gttaatttcaatctc

SEQ ID NO: 14073 - DNA, 15 bp, Homo sapiens
agttaatttcaatct

SEQ ID NO: 14074 - DNA, 15 bp, Homo sapiens
aagttaatttcaatc

SEQ ID NO: 14075 - DNA, 15 bp, Homo sapiens
aaagttaatttcaat

SEQ ID NO: 14076 - DNA, 15 bp, Homo sapiens
taaagttaatttcaa

SEQ ID NO: 14077 - DNA, 15 bp, Homo sapiens
ataaagttaatttca

SEQ ID NO: 14078 - DNA, 15 bp, Homo sapiens
gataaagttaatttc

SEQ ID NO: 14079 - DNA, 15 bp, Homo sapiens
tgataaagttaattt

SEQ ID NO: 14080 - DNA, 15 bp, Homo sapiens
atgataaagttaatt

SEQ ID NO: 14081 - DNA, 15 bp, Homo sapiens
catgataaagttaat

SEQ ID NO: 14082 - DNA, 15 bp, Homo sapiens
tcatgataaagttaa

SEQ ID NO: 14083 - DNA, 15 bp, Homo sapiens
ttcatgataaagtta

SEQ ID NO: 14084 - DNA, 15 bp, Homo sapiens
attcatgataaagtt

SEQ ID NO: 14085 - DNA, 15 bp, Homo sapiens
aattcatgataaagt

SEQ ID NO: 14086 - DNA, 15 bp, Homo sapiens
aaattcatgataaag

SEQ ID NO: 14087 - DNA, 15 bp, Homo sapiens
gaaattcatgataaa

SEQ ID NO: 14088 - DNA, 15 bp, Homo sapiens
ggaaattcatgataa

SEQ ID NO: 14089 - DNA, 15 bp, Homo sapiens
gggaaattcatgata

SEQ ID NO: 14090 - DNA, 15 bp, Homo sapiens
tgggaaattcatgat

SEQ ID NO: 14091 - DNA, 15 bp, Homo sapiens
ttgggaaattcatga

SEQ ID NO: 14092 - DNA, 15 bp, Homo sapiens
attgggaaattcatg

SEQ ID NO: 14093 - DNA, 15 bp, Homo sapiens
aattgggaaattcat

SEQ ID NO: 14094 - DNA, 15 bp, Homo sapiens
taattgggaaattca

SEQ ID NO: 14095 - DNA, 15 bp, Homo sapiens
ttaattgggaaattc

SEQ ID NO: 14096 - DNA, 15 bp, Homo sapiens
cttaattgggaaatt

SEQ ID NO: 14097 - DNA, 15 bp, Homo sapiens
ccttaattgggaaat

SEQ ID NO: 14098 - DNA, 15 bp, Homo sapiens
accttaattgggaaa

SEQ ID NO: 14099 - DNA, 15 bp, Homo sapiens
aaccttaattgggaa

SEQ ID NO: 14100 - DNA, 15 bp, Homo sapiens
aaaccttaattggga

SEQ ID NO: 14101 - DNA, 15 bp, Homo sapiens
aaaaccttaattggg

SEQ ID NO: 14102 - DNA, 15 bp, Homo sapiens
aaaaaccttaattgg

SEQ ID NO: 14103 - DNA, 15 bp, Homo sapiens
aaaaaaccttaattg

SEQ ID NO: 14104 - DNA, 15 bp, Homo sapiens
aaaaaaaccttaatt

SEQ ID NO: 14105 - DNA, 15 bp, Homo sapiens
taaaaaaaccttaat

SEQ ID NO: 14106 - DNA, 15 bp, Homo sapiens
ataaaaaaaccttaa

SEQ ID NO: 14107 - DNA, 15 bp, Homo sapiens
tataaaaaaacctta

SEQ ID NO: 14108 - DNA, 15 bp, Homo sapiens
gtataaaaaaacctt

SEQ ID NO: 14109 - DNA, 15 bp, Homo sapiens
agtataaaaaaacct

SEQ ID NO: 14110 - DNA, 15 bp, Homo sapiens
aagtataaaaaaacc

SEQ ID NO: 14111 - DNA, 15 bp, Homo sapiens
aaagtataaaaaaac

SEQ ID NO: 14112 - DNA, 15 bp, Homo sapiens
aaaagtataaaaaaa

SEQ ID NO: 14113 - DNA, 15 bp, Homo sapiens
aaaaagtataaaaaa

SEQ ID NO: 14114 - DNA, 15 bp, Homo sapiens
gaaaaagtataaaaa

SEQ ID NO: 14115 - DNA, 15 bp, Homo sapiens
agaaaaagtataaaa

SEQ ID NO: 14116 - DNA, 15 bp, Homo sapiens
cagaaaaagtataaa

SEQ ID NO: 14117 - DNA, 15 bp, Homo sapiens
ccagaaaaagtataa

SEQ ID NO: 14118 - DNA, 15 bp, Homo sapiens
cccagaaaaagtata

SEQ ID NO: 14119 - DNA, 15 bp, Homo sapiens
ccccagaaaaagtat

SEQ ID NO: 14120 - DNA, 15 bp, Homo sapiens
accccagaaaaagta

SEQ ID NO: 14121 - DNA, 15 bp, Homo sapiens
taccccagaaaaagt

SEQ ID NO: 14122 - DNA, 15 bp, Homo sapiens
ataccccagaaaaag

SEQ ID NO: 14123 - DNA, 15 bp, Homo sapiens
tataccccagaaaaa

SEQ ID NO: 14124 - DNA, 15 bp, Homo sapiens
atataccccagaaaa

SEQ ID NO: 14125 - DNA, 15 bp, Homo sapiens
tatataccccagaaa

SEQ ID NO: 14126 - DNA, 15 bp, Homo sapiens
gtatataccccagaa

SEQ ID NO: 14127 - DNA, 15 bp, Homo sapiens
tgtatataccccaga

SEQ ID NO: 14128 - DNA, 15 bp, Homo sapiens
atgtatataccccag

SEQ ID NO: 14129 - DNA, 15 bp, Homo sapiens
gatgtatatacccca

SEQ ID NO: 14130 - DNA, 15 bp, Homo sapiens
tgatgtatatacccc

SEQ ID NO: 14131 - DNA, 15 bp, Homo sapiens
ttgatgtatataccc

SEQ ID NO: 14132 - DNA, 15 bp, Homo sapiens
tttgatgtatatacc

SEQ ID NO: 14133 - DNA, 15 bp, Homo sapiens
ttttgatgtatatac

SEQ ID NO: 14134 - DNA, 15 bp, Homo sapiens
gttttgatgtatata

SEQ ID NO: 14135 - DNA, 15 bp, Homo sapiens
agttttgatgtatat

SEQ ID NO: 14136 - DNA, 15 bp, Homo sapiens
cagttttgatgtata

SEQ ID NO: 14137 - DNA, 15 bp, Homo sapiens
tcagttttgatgtat

SEQ ID NO: 14138 - DNA, 15 bp, Homo sapiens
ctcagttttgatgta

SEQ ID NO: 14139 - DNA, 15 bp, Homo sapiens
cctcagttttgatgt

SEQ ID NO: 14140 - DNA, 15 bp, Homo sapiens
acctcagttttgatg

SEQ ID NO: 14141 - DNA, 15 bp, Homo sapiens
tacctcagttttgat

SEQ ID NO: 14142 - DNA, 15 bp, Homo sapiens
gtacctcagttttga

SEQ ID NO: 14143 - DNA, 15 bp, Homo sapiens
tgtacctcagttttg

SEQ ID NO: 14144 - DNA, 15 bp, Homo sapiens
gtgtacctcagtttt

SEQ ID NO: 14145 - DNA, 15 bp, Homo sapiens
cgtgtacctcagttt

SEQ ID NO: 14146 - DNA, 15 bp, Homo sapiens
acgtgtacctcagtt

SEQ ID NO: 14147 - DNA, 15 bp, Homo sapiens
cacgtgtacctcagt

SEQ ID NO: 14148 - DNA, 15 bp, Homo sapiens
acacgtgtacctcag

SEQ ID NO: 14149 - DNA, 15 bp, Homo sapiens
aacacgtgtacctca

SEQ ID NO: 14150 - DNA, 15 bp, Homo sapiens
taacacgtgtacctc

SEQ ID NO: 14151 - DNA, 15 bp, Homo sapiens
gtaacacgtgtacct

SEQ ID NO: 14152 - DNA, 15 bp, Homo sapiens
ggtaacacgtgtacc

SEQ ID NO: 14153 - DNA, 15 bp, Homo sapiens
tggtaacacgtgtac

SEQ ID NO: 14154 - DNA, 15 bp, Homo sapiens
ctggtaacacgtgta

SEQ ID NO: 14155 - DNA, 15 bp, Homo sapiens
gctggtaacacgtgt

SEQ ID NO: 14156 - DNA, 15 bp, Homo sapiens
agctggtaacacgtg

SEQ ID NO: 14157 - DNA, 15 bp, Homo sapiens
aagctggtaacacgt

SEQ ID NO: 14158 - DNA, 15 bp, Homo sapiens
aaagctggtaacacg

SEQ ID NO: 14159 - DNA, 15 bp, Homo sapiens
gaaagctggtaacac

SEQ ID NO: 14160 - DNA, 15 bp, Homo sapiens
tgaaagctggtaaca

SEQ ID NO: 14161 - DNA, 15 bp, Homo sapiens
atgaaagctggtaac

SEQ ID NO: 14162 - DNA, 15 bp, Homo sapiens
gatgaaagctggtaa

SEQ ID NO: 14163 - DNA, 15 bp, Homo sapiens
agatgaaagctggta

SEQ ID NO: 14164 - DNA, 15 bp, Homo sapiens
aagatgaaagctggt

SEQ ID NO: 14165 - DNA, 15 bp, Homo sapiens
aaagatgaaagctgg

SEQ ID NO: 14166 - DNA, 15 bp, Homo sapiens
caaagatgaaagctg

SEQ ID NO: 14167 - DNA, 15 bp, Homo sapiens
acaaagatgaaagct

SEQ ID NO: 14168 - DNA, 15 bp, Homo sapiens
cacaaagatgaaagc

SEQ ID NO: 14169 - DNA, 15 bp, Homo sapiens
acacaaagatgaaag

SEQ ID NO: 14170 - DNA, 15 bp, Homo sapiens
gacacaaagatgaaa

SEQ ID NO: 14171 - DNA, 15 bp, Homo sapiens
tgacacaaagatgaa

SEQ ID NO: 14172 - DNA, 15 bp, Homo sapiens
atgacacaaagatga

SEQ ID NO: 14173 - DNA, 15 bp, Homo sapiens
aatgacacaaagatg

SEQ ID NO: 14174 - DNA, 15 bp, Homo sapiens
aaatgacacaaagat

SEQ ID NO: 14175 - DNA, 15 bp, Homo sapiens
caaatgacacaaaga

SEQ ID NO: 14176 - DNA, 15 bp, Homo sapiens
tcaaatgacacaaag

SEQ ID NO: 14177 - DNA, 15 bp, Homo sapiens
atcaaatgacacaaa

SEQ ID NO: 14178 - DNA, 15 bp, Homo sapiens
aatcaaatgacacaa

SEQ ID NO: 14179 - DNA, 15 bp, Homo sapiens
gaatcaaatgacaca

SEQ ID NO: 14180 - DNA, 15 bp, Homo sapiens
agaatcaaatgacac

SEQ ID NO: 14181 - DNA, 15 bp, Homo sapiens
gagaatcaaatgaca

SEQ ID NO: 14182 - DNA, 15 bp, Homo sapiens
agagaatcaaatgac

SEQ ID NO: 14183 - DNA, 15 bp, Homo sapiens
aagagaatcaaatga

SEQ ID NO: 14184 - DNA, 15 bp, Homo sapiens
aaagagaatcaaatg

SEQ ID NO: 14185 - DNA, 15 bp, Homo sapiens
taaagagaatcaaat

SEQ ID NO: 14186 - DNA, 15 bp, Homo sapiens
ctaaagagaatcaaa

SEQ ID NO: 14187 - DNA, 15 bp, Homo sapiens
cctaaagagaatcaa

SEQ ID NO: 14188 - DNA, 15 bp, Homo sapiens
gcctaaagagaatca

SEQ ID NO: 14189 - DNA, 15 bp, Homo sapiens
agcctaaagagaatc

SEQ ID NO: 14190 - DNA, 15 bp, Homo sapiens
cagcctaaagagaat

SEQ ID NO: 14191 - DNA, 15 bp, Homo sapiens
ccagcctaaagagaa

SEQ ID NO: 14192 - DNA, 15 bp, Homo sapiens
accagcctaaagaga

SEQ ID NO: 14193 - DNA, 15 bp, Homo sapiens
aaccagcctaaagag

SEQ ID NO: 14194 - DNA, 15 bp, Homo sapiens
aaaccagcctaaaga

SEQ ID NO: 14195 - DNA, 15 bp, Homo sapiens
caaaccagcctaaag

SEQ ID NO: 14196 - DNA, 15 bp, Homo sapiens
tcaaaccagcctaaa

SEQ ID NO: 14197 - DNA, 15 bp, Homo sapiens
atcaaaccagcctaa

SEQ ID NO: 14198 - DNA, 15 bp, Homo sapiens
aatcaaaccagccta

SEQ ID NO: 14199 - DNA, 15 bp, Homo sapiens
gaatcaaaccagcct

SEQ ID NO: 14200 - DNA, 15 bp, Homo sapiens
agaatcaaaccagcc

SEQ ID NO: 14201 - DNA, 15 bp, Homo sapiens
tagaatcaaaccagc

SEQ ID NO: 14202 - DNA, 15 bp, Homo sapiens
gtagaatcaaaccag

SEQ ID NO: 14203 - DNA, 15 bp, Homo sapiens
tgtagaatcaaacca

SEQ ID NO: 14204 - DNA, 15 bp, Homo sapiens
ttgtagaatcaaacc

SEQ ID NO: 14205 - DNA, 15 bp, Homo sapiens
gttgtagaatcaaac

SEQ ID NO: 14206 - DNA, 15 bp, Homo sapiens
agttgtagaatcaaa

SEQ ID NO: 14207 - DNA, 15 bp, Homo sapiens
aagttgtagaatcaa

SEQ ID NO: 14208 - DNA, 15 bp, Homo sapiens
gaagttgtagaatca

SEQ ID NO: 14209 - DNA, 15 bp, Homo sapiens
ggaagttgtagaatc

SEQ ID NO: 14210 - DNA, 15 bp, Homo sapiens
tggaagttgtagaat

SEQ ID NO: 14211 - DNA, 15 bp, Homo sapiens
atggaagttgtagaa

SEQ ID NO: 14212 - DNA, 15 bp, Homo sapiens
aatggaagttgtaga

SEQ ID NO: 14213 - DNA, 15 bp, Homo sapiens
gaatggaagttgtag

SEQ ID NO: 14214 - DNA, 15 bp, Homo sapiens
agaatggaagttgta

SEQ ID NO: 14215 - DNA, 15 bp, Homo sapiens
cagaatggaagttgt

SEQ ID NO: 14216 - DNA, 15 bp, Homo sapiens
tcagaatggaagttg

SEQ ID NO: 14217 - DNA, 15 bp, Homo sapiens
ttcagaatggaagtt

SEQ ID NO: 14218 - DNA, 15 bp, Homo sapiens
tttcagaatggaagt

SEQ ID NO: 14219 - DNA, 15 bp, Homo sapiens
atttcagaatggaag

SEQ ID NO: 14220 - DNA, 15 bp, Homo sapiens
gatttcagaatggaa

SEQ ID NO: 14221 - DNA, 15 bp, Homo sapiens
cgatttcagaatgga

SEQ ID NO: 14222 - DNA, 15 bp, Homo sapiens
ccgatttcagaatgg

SEQ ID NO: 14223 - DNA, 15 bp, Homo sapiens
cccgatttcagaatg

SEQ ID NO: 14224 - DNA, 15 bp, Homo sapiens
tcccgatttcagaat

SEQ ID NO: 14225 - DNA, 15 bp, Homo sapiens
ttcccgatttcagaa

SEQ ID NO: 14226 - DNA, 15 bp, Homo sapiens
cttcccgatttcaga

SEQ ID NO: 14227 - DNA, 15 bp, Homo sapiens
tcttcccgatttcag

SEQ ID NO: 14228 - DNA, 15 bp, Homo sapiens
ttcttcccgatttca

SEQ ID NO: 14229 - DNA, 15 bp, Homo sapiens
tttcttcccgatttc

SEQ ID NO: 14230 - DNA, 15 bp, Homo sapiens
ttttcttcccgattt

SEQ ID NO: 14231 - DNA, 15 bp, Homo sapiens
attttcttcccgatt

SEQ ID NO: 14232 - DNA, 15 bp, Homo sapiens
aattttcttcccgat

SEQ ID NO: 14233 - DNA, 15 bp, Homo sapiens
taattttcttcccga

SEQ ID NO: 14234 - DNA, 15 bp, Homo sapiens
gtaattttcttcccg

SEQ ID NO: 14235 - DNA, 15 bp, Homo sapiens
agtaattttcttccc

SEQ ID NO: 14236 - DNA, 15 bp, Homo sapiens
cagtaattttcttcc

SEQ ID NO: 14237 - DNA, 15 bp, Homo sapiens
acagtaattttcttc

SEQ ID NO: 14238 - DNA, 15 bp, Homo sapiens
cacagtaattttctt

SEQ ID NO: 14239 - DNA, 15 bp, Homo sapiens
tcacagtaattttct

SEQ ID NO: 14240 - DNA, 15 bp, Homo sapiens
gtcacagtaattttc

SEQ ID NO: 14241 - DNA, 15 bp, Homo sapiens
agtcacagtaatttt

SEQ ID NO: 14242 - DNA, 15 bp, Homo sapiens
aagtcacagtaattt

SEQ ID NO: 14243 - DNA, 15 bp, Homo sapiens
gaagtcacagtaatt

SEQ ID NO: 14244 - DNA, 15 bp, Homo sapiens
agaagtcacagtaat

SEQ ID NO: 14245 - DNA, 15 bp, Homo sapiens
tagaagtcacagtaa

SEQ ID NO: 14246 - DNA, 15 bp, Homo sapiens
ttagaagtcacagta

SEQ ID NO: 14247 - DNA, 15 bp, Homo sapiens
gttagaagtcacagt

SEQ ID NO: 14248 - DNA, 15 bp, Homo sapiens
cgttagaagtcacag

SEQ ID NO: 14249 - DNA, 15 bp, Homo sapiens
ccgttagaagtcaca

SEQ ID NO: 14250 - DNA, 15 bp, Homo sapiens
accgttagaagtcac

SEQ ID NO: 14251 - DNA, 15 bp, Homo sapiens
aaccgttagaagtca

SEQ ID NO: 14252 - DNA, 15 bp, Homo sapiens
caaccgttagaagtc

SEQ ID NO: 14253 - DNA, 15 bp, Homo sapiens
tcaaccgttagaagt

SEQ ID NO: 14254 - DNA, 15 bp, Homo sapiens
atcaaccgttagaag

SEQ ID NO: 14255 - DNA, 15 bp, Homo sapiens
tatcaaccgttagaa

SEQ ID NO: 14256 - DNA, 15 bp, Homo sapiens
ctatcaaccgttaga

SEQ ID NO: 14257 - DNA, 15 bp, Homo sapiens
actatcaaccgttag

SEQ ID NO: 14258 - DNA, 15 bp, Homo sapiens
aactatcaaccgtta

SEQ ID NO: 14259 - DNA, 15 bp, Homo sapiens
gaactatcaaccgtt

SEQ ID NO: 14260 - DNA, 15 bp, Homo sapiens
tgaactatcaaccgt

SEQ ID NO: 14261 - DNA, 15 bp, Homo sapiens
atgaactatcaaccg

SEQ ID NO: 14262 - DNA, 15 bp, Homo sapiens
tatgaactatcaacc

SEQ ID NO: 14263 - DNA, 15 bp, Homo sapiens
atatgaactatcaac

SEQ ID NO: 14264 - DNA, 15 bp, Homo sapiens
tatatgaactatcaa

SEQ ID NO: 14265 - DNA, 15 bp, Homo sapiens
atatatgaactatca

SEQ ID NO: 14266 - DNA, 15 bp, Homo sapiens
catatatgaactatc

SEQ ID NO: 14267 - DNA, 15 bp, Homo sapiens
tcatatatgaactat

SEQ ID NO: 14268 - DNA, 15 bp, Homo sapiens
atcatatatgaacta

SEQ ID NO: 14269 - DNA, 15 bp, Homo sapiens
catcatatatgaact

SEQ ID NO: 14270 - DNA, 15 bp, Homo sapiens
acatcatatatgaac

SEQ ID NO: 14271 - DNA, 15 bp, Homo sapiens
gacatcatatatgaa

SEQ ID NO: 14272 - DNA, 15 bp, Homo sapiens
tgacatcatatatga

SEQ ID NO: 14273 - DNA, 15 bp, Homo sapiens
atgacatcatatatg

SEQ ID NO: 14274 - DNA, 15 bp, Homo sapiens
catgacatcatatat

SEQ ID NO: 14275 - DNA, 15 bp, Homo sapiens
tcatgacatcatata

SEQ ID NO: 14276 - DNA, 15 bp, Homo sapiens
ctcatgacatcatat

SEQ ID NO: 14277 - DNA, 15 bp, Homo sapiens
tctcatgacatcata

SEQ ID NO: 14278 - DNA, 15 bp, Homo sapiens
ttctcatgacatcat

SEQ ID NO: 14279 - DNA, 15 bp, Homo sapiens
tttctcatgacatca

SEQ ID NO: 14280 - DNA, 15 bp, Homo sapiens
atttctcatgacatc

SEQ ID NO: 14281 - DNA, 15 bp, Homo sapiens
tatttctcatgacat

SEQ ID NO: 14282 - DNA, 15 bp, Homo sapiens
atatttctcatgaca

SEQ ID NO: 14283 - DNA, 15 bp, Homo sapiens
tatatttctcatgac

SEQ ID NO: 14284 - DNA, 15 bp, Homo sapiens
atatatttctcatga

SEQ ID NO: 14285 - DNA, 15 bp, Homo sapiens
tatatatttctcatg

SEQ ID NO: 14286 - DNA, 15 bp, Homo sapiens
ctatatatttctcat

SEQ ID NO: 14287 - DNA, 15 bp, Homo sapiens
gctatatatttctca

SEQ ID NO: 14288 - DNA, 15 bp, Homo sapiens
agctatatatttctc

SEQ ID NO: 14289 - DNA, 15 bp, Homo sapiens
aagctatatatttct

SEQ ID NO: 14290 - DNA, 15 bp, Homo sapiens
caagctatatatttc

SEQ ID NO: 14291 - DNA, 15 bp, Homo sapiens
ccaagctatatattt

SEQ ID NO: 14292 - DNA, 15 bp, Homo sapiens
cccaagctatatatt

SEQ ID NO: 14293 - DNA, 15 bp, Homo sapiens
tcccaagctatatat

SEQ ID NO: 14294 - DNA, 15 bp, Homo sapiens
gtcccaagctatata

SEQ ID NO: 14295 - DNA, 15 bp, Homo sapiens
agtcccaagctatat

SEQ ID NO: 14296 - DNA, 15 bp, Homo sapiens
cagtcccaagctata

SEQ ID NO: 14297 - DNA, 15 bp, Homo sapiens
ccagtcccaagctat

SEQ ID NO: 14298 - DNA, 15 bp, Homo sapiens
gccagtcccaagcta

SEQ ID NO: 14299 - DNA, 15 bp, Homo sapiens
tgccagtcccaagct

SEQ ID NO: 14300 - DNA, 15 bp, Homo sapiens
ctgccagtcccaagc

SEQ ID NO: 14301 - DNA, 15 bp, Homo sapiens
actgccagtcccaag

SEQ ID NO: 14302 - DNA, 15 bp, Homo sapiens
cactgccagtcccaa

SEQ ID NO: 14303 - DNA, 15 bp, Homo sapiens
gcactgccagtccca

SEQ ID NO: 14304 - DNA, 15 bp, Homo sapiens
agcactgccagtccc

SEQ ID NO: 14305 - DNA, 15 bp, Homo sapiens
tagcactgccagtcc

SEQ ID NO: 14306 - DNA, 15 bp, Homo sapiens
atagcactgccagtc

SEQ ID NO: 14307 - DNA, 15 bp, Homo sapiens
catagcactgccagt

SEQ ID NO: 14308 - DNA, 15 bp, Homo sapiens
tcatagcactgccag

SEQ ID NO: 14309 - DNA, 15 bp, Homo sapiens
atcatagcactgcca

SEQ ID NO: 14310 - DNA, 15 bp, Homo sapiens
catcatagcactgcc

SEQ ID NO: 14311 - DNA, 15 bp, Homo sapiens
tcatcatagcactgc

SEQ ID NO: 14312 - DNA, 15 bp, Homo sapiens
ctcatcatagcactg

SEQ ID NO: 14313 - DNA, 15 bp, Homo sapiens
tctcatcatagcact

SEQ ID NO: 14314 - DNA, 15 bp, Homo sapiens
ctctcatcatagcac

SEQ ID NO: 14315 - DNA, 15 bp, Homo sapiens
actctcatcatagca

SEQ ID NO: 14316 - DNA, 15 bp, Homo sapiens
gactctcatcatagc

SEQ ID NO: 14317 - DNA, 15 bp, Homo sapiens
ggactctcatcatag

SEQ ID NO: 14318 - DNA, 15 bp, Homo sapiens
tggactctcatcata

SEQ ID NO: 14319 - DNA, 15 bp, Homo sapiens
ctggactctcatcat

SEQ ID NO: 14320 - DNA, 15 bp, Homo sapiens
gctggactctcatca

SEQ ID NO: 14321 - DNA, 15 bp, Homo sapiens
ggctggactctcatc

SEQ ID NO: 14322 - DNA, 15 bp, Homo sapiens
tggctggactctcat

SEQ ID NO: 14323 - DNA, 15 bp, Homo sapiens
atggctggactctca

SEQ ID NO: 14324 - DNA, 15 bp, Homo sapiens
aatggctggactctc

SEQ ID NO: 14325 - DNA, 15 bp, Homo sapiens
gaatggctggactct

SEQ ID NO: 14326 - DNA, 15 bp, Homo sapiens
tgaatggctggactc

SEQ ID NO: 14327 - DNA, 15 bp, Homo sapiens
atgaatggctggact

SEQ ID NO: 14328 - DNA, 15 bp, Homo sapiens
aatgaatggctggac

SEQ ID NO: 14329 - DNA, 15 bp, Homo sapiens
caatgaatggctgga

SEQ ID NO: 14330 - DNA, 15 bp, Homo sapiens
ccaatgaatggctgg

SEQ ID NO: 14331 - DNA, 15 bp, Homo sapiens
accaatgaatggctg

SEQ ID NO: 14332 - DNA, 15 bp, Homo sapiens
gaccaatgaatggct

SEQ ID NO: 14333 - DNA, 15 bp, Homo sapiens
agaccaatgaatggc

SEQ ID NO: 14334 - DNA, 15 bp, Homo sapiens
aagaccaatgaatgg

SEQ ID NO: 14335 - DNA, 15 bp, Homo sapiens
aaagaccaatgaatg

SEQ ID NO: 14336 - DNA, 15 bp, Homo sapiens
taaagaccaatgaat

SEQ ID NO: 14337 - DNA, 15 bp, Homo sapiens
gtaaagaccaatgaa

SEQ ID NO: 14338 - DNA, 15 bp, Homo sapiens
tgtaaagaccaatga

SEQ ID NO: 14339 - DNA, 15 bp, Homo sapiens
ttgtaaagaccaatg

SEQ ID NO: 14340 - DNA, 15 bp, Homo sapiens
gttgtaaagaccaat

SEQ ID NO: 14341 - DNA, 15 bp, Homo sapiens
agttgtaaagaccaa

SEQ ID NO: 14342 - DNA, 15 bp, Homo sapiens
cagttgtaaagacca

SEQ ID NO: 14343 - DNA, 15 bp, Homo sapiens
ccagttgtaaagacc

SEQ ID NO: 14344 - DNA, 15 bp, Homo sapiens
tccagttgtaaagac

SEQ ID NO: 14345 - DNA, 15 bp, Homo sapiens
ctccagttgtaaaga

SEQ ID NO: 14346 - DNA, 15 bp, Homo sapiens
cctccagttgtaaag

SEQ ID NO: 14347 - DNA, 15 bp, Homo sapiens
ccctccagttgtaaa

SEQ ID NO: 14348 - DNA, 15 bp, Homo sapiens
tccctccagttgtaa

SEQ ID NO: 14349 - DNA, 15 bp, Homo sapiens
atccctccagttgta

SEQ ID NO: 14350 - DNA, 15 bp, Homo sapiens
tatccctccagttgt

SEQ ID NO: 14351 - DNA, 15 bp, Homo sapiens
ctatccctccagttg

SEQ ID NO: 14352 - DNA, 15 bp, Homo sapiens
actatccctccagtt

SEQ ID NO: 14353 - DNA, 15 bp, Homo sapiens
aactatccctccagt

SEQ ID NO: 14354 - DNA, 15 bp, Homo sapiens
gaactatccctccag

SEQ ID NO: 14355 - DNA, 15 bp, Homo sapiens
agaactatccctcca

SEQ ID NO: 14356 - DNA, 15 bp, Homo sapiens
aagaactatccctcc

SEQ ID NO: 14357 - DNA, 15 bp, Homo sapiens
taagaactatccctc

SEQ ID NO: 14358 - DNA, 15 bp, Homo sapiens
ctaagaactatccct

SEQ ID NO: 14359 - DNA, 15 bp, Homo sapiens
tctaagaactatccc

SEQ ID NO: 14360 - DNA, 15 bp, Homo sapiens
ttctaagaactatcc

SEQ ID NO: 14361 - DNA, 15 bp, Homo sapiens
attctaagaactatc

SEQ ID NO: 14362 - DNA, 15 bp, Homo sapiens
aattctaagaactat

SEQ ID NO: 14363 - DNA, 15 bp, Homo sapiens
aaattctaagaacta

SEQ ID NO: 14364 - DNA, 15 bp, Homo sapiens
caaattctaagaact

SEQ ID NO: 14365 - DNA, 15 bp, Homo sapiens
acaaattctaagaac

SEQ ID NO: 14366 - DNA, 15 bp, Homo sapiens
cacaaattctaagaa

SEQ ID NO: 14367 - DNA, 15 bp, Homo sapiens
tcacaaattctaaga

SEQ ID NO: 14368 - DNA, 15 bp, Homo sapiens
ctcacaaattctaag

SEQ ID NO: 14369 - DNA, 15 bp, Homo sapiens
tctcacaaattctaa

SEQ ID NO: 14370 - DNA, 15 bp, Homo sapiens
ctctcacaaattcta

SEQ ID NO: 14371 - DNA, 15 bp, Homo sapiens
tctctcacaaattct

SEQ ID NO: 14372 - DNA, 15 bp, Homo sapiens
atctctcacaaattc

SEQ ID NO: 14373 - DNA, 15 bp, Homo sapiens
tatctctcacaaatt

SEQ ID NO: 14374 - DNA, 15 bp, Homo sapiens
gtatctctcacaaat

SEQ ID NO: 14375 - DNA, 15 bp, Homo sapiens
agtatctctcacaaa

SEQ ID NO: 14376 - DNA, 15 bp, Homo sapiens
gagtatctctcacaa

SEQ ID NO: 14377 - DNA, 15 bp, Homo sapiens
tgagtatctctcaca

SEQ ID NO: 14378 - DNA, 15 bp, Homo sapiens
atgagtatctctcac

SEQ ID NO: 14379 - DNA, 15 bp, Homo sapiens
gatgagtatctctca

SEQ ID NO: 14380 - DNA, 15 bp, Homo sapiens
tgatgagtatctctc

SEQ ID NO: 14381 - DNA, 15 bp, Homo sapiens
gtgatgagtatctct

SEQ ID NO: 14382 - DNA, 15 bp, Homo sapiens
agtgatgagtatctc

SEQ ID NO: 14383 - DNA, 15 bp, Homo sapiens
gagtgatgagtatct

SEQ ID NO: 14384 - DNA, 15 bp, Homo sapiens
tgagtgatgagtatc

SEQ ID NO: 14385 - DNA, 15 bp, Homo sapiens
atgagtgatgagtat

SEQ ID NO: 14386 - DNA, 15 bp, Homo sapiens
tatgagtgatgagta

SEQ ID NO: 14387 - DNA, 15 bp, Homo sapiens
ctatgagtgatgagt

SEQ ID NO: 14388 - DNA, 15 bp, Homo sapiens
gctatgagtgatgag

SEQ ID NO: 14389 - DNA, 15 bp, Homo sapiens
tgctatgagtgatga

SEQ ID NO: 14390 - DNA, 15 bp, Homo sapiens
atgctatgagtgatg

SEQ ID NO: 14391 - DNA, 15 bp, Homo sapiens
aatgctatgagtgat

SEQ ID NO: 14392 - DNA, 15 bp, Homo sapiens
aaatgctatgagtga

SEQ ID NO: 14393 - DNA, 15 bp, Homo sapiens
taaatgctatgagtg

SEQ ID NO: 14394 - DNA, 15 bp, Homo sapiens
gtaaatgctatgagt

SEQ ID NO: 14395 - DNA, 15 bp, Homo sapiens
agtaaatgctatgag

SEQ ID NO: 14396 - DNA, 15 bp, Homo sapiens
cagtaaatgctatga

SEQ ID NO: 14397 - DNA, 15 bp, Homo sapiens
acagtaaatgctatg

SEQ ID NO: 14398 - DNA, 15 bp, Homo sapiens
cacagtaaatgctat

SEQ ID NO: 14399 - DNA, 15 bp, Homo sapiens
acacagtaaatgcta

SEQ ID NO: 14400 - DNA, 15 bp, Homo sapiens
cacacagtaaatgct

SEQ ID NO: 14401 - DNA, 15 bp, Homo sapiens
gcacacagtaaatgc

SEQ ID NO: 14402 - DNA, 15 bp, Homo sapiens
ggcacacagtaaatg

SEQ ID NO: 14403 - DNA, 15 bp, Homo sapiens
gggcacacagtaaat

SEQ ID NO: 14404 - DNA, 15 bp, Homo sapiens
tgggcacacagtaaa

SEQ ID NO: 14405 - DNA, 15 bp, Homo sapiens
ttgggcacacagtaa

SEQ ID NO: 14406 - DNA, 15 bp, Homo sapiens
tttgggcacacagta

SEQ ID NO: 14407 - DNA, 15 bp, Homo sapiens
gtttgggcacacagt

SEQ ID NO: 14408 - DNA, 15 bp, Homo sapiens
tgtttgggcacacag

SEQ ID NO: 14409 - DNA, 15 bp, Homo sapiens
gtgtttgggcacaca

SEQ ID NO: 14410 - DNA, 15 bp, Homo sapiens
tgtgtttgggcacac

SEQ ID NO: 14411 - DNA, 15 bp, Homo sapiens
ttgtgtttgggcaca

SEQ ID NO: 14412 - DNA, 15 bp, Homo sapiens
attgtgtttgggcac

SEQ ID NO: 14413 - DNA, 15 bp, Homo sapiens
gattgtgtttgggca

SEQ ID NO: 14414 - DNA, 15 bp, Homo sapiens
agattgtgtttgggc

SEQ ID NO: 14415 - DNA, 15 bp, Homo sapiens
tagattgtgtttggg

SEQ ID NO: 14416 - DNA, 15 bp, Homo sapiens
ttagattgtgtttgg

SEQ ID NO: 14417 - DNA, 15 bp, Homo sapiens
cttagattgtgtttg

SEQ ID NO: 14418 - DNA, 15 bp, Homo sapiens
gcttagattgtgttt

SEQ ID NO: 14419 - DNA, 15 bp, Homo sapiens
tgcttagattgtgtt

SEQ ID NO: 14420 - DNA, 15 bp, Homo sapiens
atgcttagattgtgt

SEQ ID NO: 14421 - DNA, 15 bp, Homo sapiens
catgcttagattgtg

SEQ ID NO: 14422 - DNA, 15 bp, Homo sapiens
acatgcttagattgt

SEQ ID NO: 14423 - DNA, 15 bp, Homo sapiens
aacatgcttagattg

SEQ ID NO: 14424 - DNA, 15 bp, Homo sapiens
taacatgcttagatt

SEQ ID NO: 14425 - DNA, 15 bp, Homo sapiens
gtaacatgcttagat

SEQ ID NO: 14426 - DNA, 15 bp, Homo sapiens
tgtaacatgcttaga

SEQ ID NO: 14427 - DNA, 15 bp, Homo sapiens
atgtaacatgcttag

SEQ ID NO: 14428 - DNA, 15 bp, Homo sapiens
tatgtaacatgctta

SEQ ID NO: 14429 - DNA, 15 bp, Homo sapiens
atatgtaacatgctt

SEQ ID NO: 14430 - DNA, 15 bp, Homo sapiens
catatgtaacatgct

SEQ ID NO: 14431 - DNA, 15 bp, Homo sapiens
tcatatgtaacatgc

SEQ ID NO: 14432 - DNA, 15 bp, Homo sapiens
gtcatatgtaacatg

SEQ ID NO: 14433 - DNA, 15 bp, Homo sapiens
agtcatatgtaacat

SEQ ID NO: 14434 - DNA, 15 bp, Homo sapiens
aagtcatatgtaaca

SEQ ID NO: 14435 - DNA, 15 bp, Homo sapiens
gaagtcatatgtaac

SEQ ID NO: 14436 - DNA, 15 bp, Homo sapiens
agaagtcatatgtaa

SEQ ID NO: 14437 - DNA, 15 bp, Homo sapiens
aagaagtcatatgta

SEQ ID NO: 14438 - DNA, 15 bp, Homo sapiens
taagaagtcatatgt

SEQ ID NO: 14439 - DNA, 15 bp, Homo sapiens
ataagaagtcatatg

SEQ ID NO: 14440 - DNA, 15 bp, Homo sapiens
gataagaagtcatat

SEQ ID NO: 14441 - DNA, 15 bp, Homo sapiens
ggataagaagtcata

SEQ ID NO: 14442 - DNA, 15 bp, Homo sapiens
aggataagaagtcat

SEQ ID NO: 14443 - DNA, 15 bp, Homo sapiens
gaggataagaagtca

SEQ ID NO: 14444 - DNA, 15 bp, Homo sapiens
tgaggataagaagtc

SEQ ID NO: 14445 - DNA, 15 bp, Homo sapiens
gtgaggataagaagt

SEQ ID NO: 14446 - DNA, 15 bp, Homo sapiens
tgtgaggataagaag

SEQ ID NO: 14447 - DNA, 15 bp, Homo sapiens
ttgtgaggataagaa

SEQ ID NO: 14448 - DNA, 15 bp, Homo sapiens
tttgtgaggataaga

SEQ ID NO: 14449 - DNA, 15 bp, Homo sapiens
gtttgtgaggataag

SEQ ID NO: 14450 - DNA, 15 bp, Homo sapiens
ggtttgtgaggataa

SEQ ID NO: 14451 - DNA, 15 bp, Homo sapiens
aggtttgtgaggata

SEQ ID NO: 14452 - DNA, 15 bp, Homo sapiens
aaggtttgtgaggat

SEQ ID NO: 14453 - DNA, 15 bp, Homo sapiens
caaggtttgtgagga

SEQ ID NO: 14454 - DNA, 15 bp, Homo sapiens
tcaaggtttgtgagg

SEQ ID NO: 14455 - DNA, 15 bp, Homo sapiens
ctcaaggtttgtgag

SEQ ID NO: 14456 - DNA, 15 bp, Homo sapiens
cctcaaggtttgtga

SEQ ID NO: 14457 - DNA, 15 bp, Homo sapiens
acctcaaggtttgtg

SEQ ID NO: 14458 - DNA, 15 bp, Homo sapiens
tacctcaaggtttgt

SEQ ID NO: 14459 - DNA, 15 bp, Homo sapiens
ctacctcaaggtttg

SEQ ID NO: 14460 - DNA, 15 bp, Homo sapiens
cctacctcaaggttt

SEQ ID NO: 14461 - DNA, 15 bp, Homo sapiens
tcctacctcaaggtt

SEQ ID NO: 14462 - DNA, 15 bp, Homo sapiens
ttcctacctcaaggt

SEQ ID NO: 14463 - DNA, 15 bp, Homo sapiens
gttcctacctcaagg

SEQ ID NO: 14464 - DNA, 15 bp, Homo sapiens
agttcctacctcaag

SEQ ID NO: 14465 - DNA, 15 bp, Homo sapiens
cagttcctacctcaa

SEQ ID NO: 14466 - DNA, 15 bp, Homo sapiens
acagttcctacctca

SEQ ID NO: 14467 - DNA, 15 bp, Homo sapiens
aacagttcctacctc

SEQ ID NO: 14468 - DNA, 15 bp, Homo sapiens
taacagttcctacct

SEQ ID NO: 14469 - DNA, 15 bp, Homo sapiens
ctaacagttcctacc

SEQ ID NO: 14470 - DNA, 15 bp, Homo sapiens
actaacagttcctac

SEQ ID NO: 14471 - DNA, 15 bp, Homo sapiens
cactaacagttccta

SEQ ID NO: 14472 - DNA, 15 bp, Homo sapiens
acactaacagttcct

SEQ ID NO: 14473 - DNA, 15 bp, Homo sapiens
aacactaacagttcc

SEQ ID NO: 14474 - DNA, 15 bp, Homo sapiens
caacactaacagttc

SEQ ID NO: 14475 - DNA, 15 bp, Homo sapiens
acaacactaacagtt

SEQ ID NO: 14476 - DNA, 15 bp, Homo sapiens
gacaacactaacagt

SEQ ID NO: 14477 - DNA, 15 bp, Homo sapiens
tgacaacactaacag

SEQ ID NO: 14478 - DNA, 15 bp, Homo sapiens
atgacaacactaaca

SEQ ID NO: 14479 - DNA, 15 bp, Homo sapiens
aatgacaacactaac

SEQ ID NO: 14480 - DNA, 15 bp, Homo sapiens
aaatgacaacactaa

SEQ ID NO: 14481 - DNA, 15 bp, Homo sapiens
aaaatgacaacacta

SEQ ID NO: 14482 - DNA, 15 bp, Homo sapiens
taaaatgacaacact

SEQ ID NO: 14483 - DNA, 15 bp, Homo sapiens
ataaaatgacaacac

SEQ ID NO: 14484 - DNA, 15 bp, Homo sapiens
tataaaatgacaaca

SEQ ID NO: 14485 - DNA, 15 bp, Homo sapiens
ctataaaatgacaac

SEQ ID NO: 14486 - DNA, 15 bp, Homo sapiens
tctataaaatgacaa

SEQ ID NO: 14487 - DNA, 15 bp, Homo sapiens
gtctataaaatgaca

SEQ ID NO: 14488 - DNA, 15 bp, Homo sapiens
tgtctataaaatgac

SEQ ID NO: 14489 - DNA, 15 bp, Homo sapiens
ctgtctataaaatga

SEQ ID NO: 14490 - DNA, 15 bp, Homo sapiens
actgtctataaaatg

SEQ ID NO: 14491 - DNA, 15 bp, Homo sapiens
tactgtctataaaat

SEQ ID NO: 14492 - DNA, 15 bp, Homo sapiens
ttactgtctataaaa

SEQ ID NO: 14493 - DNA, 15 bp, Homo sapiens
tttactgtctataaa

SEQ ID NO: 14494 - DNA, 15 bp, Homo sapiens
gtttactgtctataa

SEQ ID NO: 14495 - DNA, 15 bp, Homo sapiens
agtttactgtctata

SEQ ID NO: 14496 - DNA, 15 bp, Homo sapiens
aagtttactgtctat

SEQ ID NO: 14497 - DNA, 15 bp, Homo sapiens
caagtttactgtcta

SEQ ID NO: 14498 - DNA, 15 bp, Homo sapiens
acaagtttactgtct

SEQ ID NO: 14499 - DNA, 15 bp, Homo sapiens
cacaagtttactgtc

SEQ ID NO: 14500 - DNA, 15 bp, Homo sapiens
acacaagtttactgt

SEQ ID NO: 14501 - DNA, 15 bp, Homo sapiens
cacacaagtttactg

SEQ ID NO: 14502 - DNA, 15 bp, Homo sapiens
acacacaagtttact

SEQ ID NO: 14503 - DNA, 15 bp, Homo sapiens
aacacacaagtttac

SEQ ID NO: 14504 - DNA, 15 bp, Homo sapiens
caacacacaagttta

SEQ ID NO: 14505 - DNA, 15 bp, Homo sapiens
acaacacacaagttt

SEQ ID NO: 14506 - DNA, 15 bp, Homo sapiens
cacaacacacaagtt

SEQ ID NO: 14507 - DNA, 15 bp, Homo sapiens
acacaacacacaagt

SEQ ID NO: 14508 - DNA, 15 bp, Homo sapiens
tacacaacacacaag

SEQ ID NO: 14509 - DNA, 15 bp, Homo sapiens
ttacacaacacacaa

SEQ ID NO: 14510 - DNA, 15 bp, Homo sapiens
gttacacaacacaca

SEQ ID NO: 14511 - DNA, 15 bp, Homo sapiens
ggttacacaacacac

SEQ ID NO: 14512 - DNA, 15 bp, Homo sapiens
aggttacacaacaca

SEQ ID NO: 14513 - DNA, 15 bp, Homo sapiens
gaggttacacaacac

SEQ ID NO: 14514 - DNA, 15 bp, Homo sapiens
agaggttacacaaca

SEQ ID NO: 14515 - DNA, 15 bp, Homo sapiens
gagaggttacacaac

SEQ ID NO: 14516 - DNA, 15 bp, Homo sapiens
agagaggttacacaa

SEQ ID NO: 14517 - DNA, 15 bp, Homo sapiens
tagagaggttacaca

SEQ ID NO: 14518 - DNA, 15 bp, Homo sapiens
gtagagaggttacac

SEQ ID NO: 14519 - DNA, 15 bp, Homo sapiens
tgtagagaggttaca

SEQ ID NO: 14520 - DNA, 15 bp, Homo sapiens
ctgtagagaggttac

SEQ ID NO: 14521 - DNA, 15 bp, Homo sapiens
actgtagagaggtta

SEQ ID NO: 14522 - DNA, 15 bp, Homo sapiens
cactgtagagaggtt

SEQ ID NO: 14523 - DNA, 15 bp, Homo sapiens
tcactgtagagaggt

SEQ ID NO: 14524 - DNA, 15 bp, Homo sapiens
gtcactgtagagagg

SEQ ID NO: 14525 - DNA, 15 bp, Homo sapiens
tgtcactgtagagag

SEQ ID NO: 14526 - DNA, 15 bp, Homo sapiens
atgtcactgtagaga

SEQ ID NO: 14527 - DNA, 15 bp, Homo sapiens
tatgtcactgtagag

SEQ ID NO: 14528 - DNA, 15 bp, Homo sapiens
ctatgtcactgtaga

SEQ ID NO: 14529 - DNA, 15 bp, Homo sapiens
gctatgtcactgtag

SEQ ID NO: 14530 - DNA, 15 bp, Homo sapiens
agctatgtcactgta

SEQ ID NO: 14531 - DNA, 15 bp, Homo sapiens
cagctatgtcactgt

SEQ ID NO: 14532 - DNA, 15 bp, Homo sapiens
acagctatgtcactg

SEQ ID NO: 14533 - DNA, 15 bp, Homo sapiens
aacagctatgtcact

SEQ ID NO: 14534 - DNA, 15 bp, Homo sapiens
taacagctatgtcac

SEQ ID NO: 14535 - DNA, 15 bp, Homo sapiens
ttaacagctatgtca

SEQ ID NO: 14536 - DNA, 15 bp, Homo sapiens
cttaacagctatgtc

SEQ ID NO: 14537 - DNA, 15 bp, Homo sapiens
tcttaacagctatgt

SEQ ID NO: 14538 - DNA, 15 bp, Homo sapiens
ctcttaacagctatg

SEQ ID NO: 14539 - DNA, 15 bp, Homo sapiens
gctcttaacagctat

SEQ ID NO: 14540 - DNA, 15 bp, Homo sapiens
ggctcttaacagcta

SEQ ID NO: 14541 - DNA, 15 bp, Homo sapiens
aggctcttaacagct

SEQ ID NO: 14542 - DNA, 15 bp, Homo sapiens
caggctcttaacagc

SEQ ID NO: 14543 - DNA, 15 bp, Homo sapiens
acaggctcttaacag

SEQ ID NO: 14544 - DNA, 15 bp, Homo sapiens
tacaggctcttaaca

SEQ ID NO: 14545 - DNA, 15 bp, Homo sapiens
atacaggctcttaac

SEQ ID NO: 14546 - DNA, 15 bp, Homo sapiens
aatacaggctcttaa

SEQ ID NO: 14547 - DNA, 15 bp, Homo sapiens
caatacaggctctta

SEQ ID NO: 14548 - DNA, 15 bp, Homo sapiens
tcaatacaggctctt

SEQ ID NO: 14549 - DNA, 15 bp, Homo sapiens
ttcaatacaggctct

SEQ ID NO: 14550 - DNA, 15 bp, Homo sapiens
gttcaatacaggctc

SEQ ID NO: 14551 - DNA, 15 bp, Homo sapiens
ggttcaatacaggct

SEQ ID NO: 14552 - DNA, 15 bp, Homo sapiens
aggttcaatacaggc

SEQ ID NO: 14553 - DNA, 15 bp, Homo sapiens
caggttcaatacagg

SEQ ID NO: 14554 - DNA, 15 bp, Homo sapiens
ccaggttcaatacag

SEQ ID NO: 14555 - DNA, 15 bp, Homo sapiens
cccaggttcaataca

SEQ ID NO: 14556 - DNA, 15 bp, Homo sapiens
gcccaggttcaatac

SEQ ID NO: 14557 - DNA, 15 bp, Homo sapiens
tgcccaggttcaata

SEQ ID NO: 14558 - DNA, 15 bp, Homo sapiens
ctgcccaggttcaat

SEQ ID NO: 14559 - DNA, 15 bp, Homo sapiens
gctgcccaggttcaa

SEQ ID NO: 14560 - DNA, 15 bp, Homo sapiens
agctgcccaggttca

SEQ ID NO: 14561 - DNA, 15 bp, Homo sapiens
aagctgcccaggttc

SEQ ID NO: 14562 - DNA, 15 bp, Homo sapiens
taagctgcccaggtt

SEQ ID NO: 14563 - DNA, 15 bp, Homo sapiens
ctaagctgcccaggt

SEQ ID NO: 14564 - DNA, 15 bp, Homo sapiens
gctaagctgcccagg

SEQ ID NO: 14565 - DNA, 15 bp, Homo sapiens
ggctaagctgcccag

SEQ ID NO: 14566 - DNA, 15 bp, Homo sapiens
gggctaagctgccca

SEQ ID NO: 14567 - DNA, 15 bp, Homo sapiens
tgggctaagctgccc

SEQ ID NO: 14568 - DNA, 15 bp, Homo sapiens
ctgggctaagctgcc

SEQ ID NO: 14569 - DNA, 15 bp, Homo sapiens
tctgggctaagctgc

SEQ ID NO: 14570 - DNA, 15 bp, Homo sapiens
ctctgggctaagctg

SEQ ID NO: 14571 - DNA, 15 bp, Homo sapiens
actctgggctaagct

SEQ ID NO: 14572 - DNA, 15 bp, Homo sapiens
aactctgggctaagc

SEQ ID NO: 14573 - DNA, 15 bp, Homo sapiens
caactctgggctaag

SEQ ID NO: 14574 - DNA, 15 bp, Homo sapiens
ccaactctgggctaa

SEQ ID NO: 14575 - DNA, 15 bp, Homo sapiens
cccaactctgggcta

SEQ ID NO: 14576 - DNA, 15 bp, Homo sapiens
acccaactctgggct

SEQ ID NO: 14577 - DNA, 15 bp, Homo sapiens
aacccaactctgggc

SEQ ID NO: 14578 - DNA, 15 bp, Homo sapiens
caacccaactctggg

SEQ ID NO: 14579 - DNA, 15 bp, Homo sapiens
ccaacccaactctgg

SEQ ID NO: 14580 - DNA, 15 bp, Homo sapiens
cccaacccaactctg

SEQ ID NO: 14581 - DNA, 15 bp, Homo sapiens
acccaacccaactct

SEQ ID NO: 14582 - DNA, 15 bp, Homo sapiens
aacccaacccaactc

SEQ ID NO: 14583 - DNA, 15 bp, Homo sapiens
caacccaacccaact

SEQ ID NO: 14584 - DNA, 15 bp, Homo sapiens
ccaacccaacccaac

SEQ ID NO: 14585 - DNA, 15 bp, Homo sapiens
cccaacccaacccaa

SEQ ID NO: 14586 - DNA, 15 bp, Homo sapiens
ccccaacccaaccca

SEQ ID NO: 14587 - DNA, 15 bp, Homo sapiens
accccaacccaaccc

SEQ ID NO: 14588 - DNA, 15 bp, Homo sapiens
aaccccaacccaacc

SEQ ID NO: 14589 - DNA, 15 bp, Homo sapiens
aaaccccaacccaac

SEQ ID NO: 14590 - DNA, 15 bp, Homo sapiens
aaaaccccaacccaa

SEQ ID NO: 14591 - DNA, 15 bp, Homo sapiens
aaaaaccccaaccca

SEQ ID NO: 14592 - DNA, 15 bp, Homo sapiens
aaaaaaccccaaccc

SEQ ID NO: 14593 - DNA, 15 bp, Homo sapiens
aaaaaaaccccaacc

SEQ ID NO: 14594 - DNA, 15 bp, Homo sapiens
aaaaaaaaccccaac

SEQ ID NO: 14595 - DNA, 15 bp, Homo sapiens
caaaaaaaaccccaa

SEQ ID NO: 14596 - DNA, 15 bp, Homo sapiens
acaaaaaaaacccca

SEQ ID NO: 14597 - DNA, 15 bp, Homo sapiens
aacaaaaaaaacccc

SEQ ID NO: 14598 - DNA, 15 bp, Homo sapiens
aaacaaaaaaaaccc

SEQ ID NO: 14599 - DNA, 15 bp, Homo sapiens
aaaacaaaaaaaacc

SEQ ID NO: 14600 - DNA, 15 bp, Homo sapiens
caaaacaaaaaaaac

SEQ ID NO: 14601 - DNA, 15 bp, Homo sapiens
acaaaacaaaaaaaa

SEQ ID NO: 14602 - DNA, 15 bp, Homo sapiens
aacaaaacaaaaaaa

SEQ ID NO: 14603 - DNA, 15 bp, Homo sapiens
aaacaaaacaaaaaa

SEQ ID NO: 14604 - DNA, 15 bp, Homo sapiens
aaaacaaaacaaaaa

SEQ ID NO: 14605 - DNA, 15 bp, Homo sapiens
caaaacaaaacaaaa

SEQ ID NO: 14606 - DNA, 15 bp, Homo sapiens
acaaaacaaaacaaa

SEQ ID NO: 14607 - DNA, 15 bp, Homo sapiens
aacaaaacaaaacaa

SEQ ID NO: 14608 - DNA, 15 bp, Homo sapiens
aaacaaaacaaaaca

SEQ ID NO: 14609 - DNA, 15 bp, Homo sapiens
aaaacaaaacaaaac

SEQ ID NO: 14610 - DNA, 15 bp, Homo sapiens
aaaaacaaaacaaaa

SEQ ID NO: 14611 - DNA, 15 bp, Homo sapiens
aaaaaacaaaacaaa

SEQ ID NO: 14612 - DNA, 15 bp, Homo sapiens
aaaaaaacaaaacaa

SEQ ID NO: 14613 - DNA, 15 bp, Homo sapiens
caaaaaaacaaaaca

SEQ ID NO: 14614 - DNA, 15 bp, Homo sapiens
tcaaaaaaacaaaac

SEQ ID NO: 14615 - DNA, 15 bp, Homo sapiens
gtcaaaaaaacaaaa

SEQ ID NO: 14616 - DNA, 15 bp, Homo sapiens
tgtcaaaaaaacaaa

SEQ ID NO: 14617 - DNA, 15 bp, Homo sapiens
atgtcaaaaaaacaa

SEQ ID NO: 14618 - DNA, 15 bp, Homo sapiens
tatgtcaaaaaaaca

SEQ ID NO: 14619 - DNA, 15 bp, Homo sapiens
ctatgtcaaaaaaac

SEQ ID NO: 14620 - DNA, 15 bp, Homo sapiens
actatgtcaaaaaaa

SEQ ID NO: 14621 - DNA, 15 bp, Homo sapiens
gactatgtcaaaaaa

SEQ ID NO: 14622 - DNA, 15 bp, Homo sapiens
agactatgtcaaaaa

SEQ ID NO: 14623 - DNA, 15 bp, Homo sapiens
gagactatgtcaaaa

SEQ ID NO: 14624 - DNA, 15 bp, Homo sapiens
agagactatgtcaaa

SEQ ID NO: 14625 - DNA, 15 bp, Homo sapiens
aagagactatgtcaa

SEQ ID NO: 14626 - DNA, 15 bp, Homo sapiens
aaagagactatgtca

SEQ ID NO: 14627 - DNA, 15 bp, Homo sapiens
gaaagagactatgtc

SEQ ID NO: 14628 - DNA, 15 bp, Homo sapiens
agaaagagactatgt

SEQ ID NO: 14629 - DNA, 15 bp, Homo sapiens
cagaaagagactatg

SEQ ID NO: 14630 - DNA, 15 bp, Homo sapiens
acagaaagagactat

SEQ ID NO: 14631 - DNA, 15 bp, Homo sapiens
aacagaaagagacta

SEQ ID NO: 14632 - DNA, 15 bp, Homo sapiens
caacagaaagagact

SEQ ID NO: 14633 - DNA, 15 bp, Homo sapiens
gcaacagaaagagac

SEQ ID NO: 14634 - DNA, 15 bp, Homo sapiens
ggcaacagaaagaga

SEQ ID NO: 14635 - DNA, 15 bp, Homo sapiens
gggcaacagaaagag

SEQ ID NO: 14636 - DNA, 15 bp, Homo sapiens
tgggcaacagaaaga

SEQ ID NO: 14637 - DNA, 15 bp, Homo sapiens
ctgggcaacagaaag

SEQ ID NO: 14638 - DNA, 15 bp, Homo sapiens
cctgggcaacagaaa

SEQ ID NO: 14639 - DNA, 15 bp, Homo sapiens
gcctgggcaacagaa

SEQ ID NO: 14640 - DNA, 15 bp, Homo sapiens
ctgccactgcactcc

SEQ ID NO: 14641 - DNA, 15 bp, Homo sapiens
cctgccactgcactc

SEQ ID NO: 14642 - DNA, 15 bp, Homo sapiens
tcctgccactgcact

SEQ ID NO: 14643 - DNA, 15 bp, Homo sapiens
atcctgccactgcac

SEQ ID NO: 14644 - DNA, 15 bp, Homo sapiens
gatcctgccactgca

SEQ ID NO: 14645 - DNA, 15 bp, Homo sapiens
agatcctgccactgc

SEQ ID NO: 14646 - DNA, 15 bp, Homo sapiens
gagatcctgccactg

SEQ ID NO: 14647 - DNA, 15 bp, Homo sapiens
cgagatcctgccact

SEQ ID NO: 14648 - DNA, 15 bp, Homo sapiens
acgagatcctgccac

SEQ ID NO: 14649 - DNA, 15 bp, Homo sapiens
gacgagatcctgcca

SEQ ID NO: 14650 - DNA, 15 bp, Homo sapiens
agacgagatcctgcc

SEQ ID NO: 14651 - DNA, 15 bp, Homo sapiens
gagacgagatcctgc

SEQ ID NO: 14652 - DNA, 15 bp, Homo sapiens
tgagacgagatcctg

SEQ ID NO: 14653 - DNA, 15 bp, Homo sapiens
gtgagacgagatcct

SEQ ID NO: 14654 - DNA, 15 bp, Homo sapiens
agtgagacgagatcc

SEQ ID NO: 14655 - DNA, 15 bp, Homo sapiens
cagtgagacgagatc

SEQ ID NO: 14656 - DNA, 15 bp, Homo sapiens
gcagtgagacgagat

SEQ ID NO: 14657 - DNA, 15 bp, Homo sapiens
tgcagtgagacgaga

SEQ ID NO: 14658 - DNA, 15 bp, Homo sapiens
ctgcagtgagacgag

SEQ ID NO: 14659 - DNA, 15 bp, Homo sapiens
gctgcagtgagacga

SEQ ID NO: 14660 - DNA, 15 bp, Homo sapiens
ggctgcagtgagacg

SEQ ID NO: 14661 - DNA, 15 bp, Homo sapiens
aggctgcagtgagac

SEQ ID NO: 14662 - DNA, 15 bp, Homo sapiens
gaggctgcagtgaga

SEQ ID NO: 14663 - DNA, 15 bp, Homo sapiens
ggaggctgcagtgag

SEQ ID NO: 14664 - DNA, 15 bp, Homo sapiens
cggaggctgcagtga

SEQ ID NO: 14665 - DNA, 15 bp, Homo sapiens
gcggaggctgcagtg

SEQ ID NO: 14666 - DNA, 15 bp, Homo sapiens
ggcggaggctgcagt

SEQ ID NO: 14667 - DNA, 15 bp, Homo sapiens
aggcggaggctgcag

SEQ ID NO: 14668 - DNA, 15 bp, Homo sapiens
gaggcggaggctgca

SEQ ID NO: 14669 - DNA, 15 bp, Homo sapiens
agaggcggaggctgc

SEQ ID NO: 14670 - DNA, 15 bp, Homo sapiens
gagaggcggaggctg

SEQ ID NO: 14671 - DNA, 15 bp, Homo sapiens
cgagaggcggaggct

SEQ ID NO: 14672 - DNA, 15 bp, Homo sapiens
ccgagaggcggaggc

SEQ ID NO: 14673 - DNA, 15 bp, Homo sapiens
cccgagaggcggagg

SEQ ID NO: 14674 - DNA, 15 bp, Homo sapiens
acccgagaggcggag

SEQ ID NO: 14675 - DNA, 15 bp, Homo sapiens
aacccgagaggcgga

SEQ ID NO: 14676 - DNA, 15 bp, Homo sapiens
gaacccgagaggcgg

SEQ ID NO: 14677 - DNA, 15 bp, Homo sapiens
tgaacccgagaggcg

SEQ ID NO: 14678 - DNA, 15 bp, Homo sapiens
ttgaacccgagaggc

SEQ ID NO: 14679 - DNA, 15 bp, Homo sapiens
cttgaacccgagagg

SEQ ID NO: 14680 - DNA, 15 bp, Homo sapiens
gcttgaacccgagag

SEQ ID NO: 14681 - DNA, 15 bp, Homo sapiens
cgcttgaacccgaga

SEQ ID NO: 14682 - DNA, 15 bp, Homo sapiens
tcgcttgaacccgag

SEQ ID NO: 14683 - DNA, 15 bp, Homo sapiens
atcgcttgaacccga

SEQ ID NO: 14684 - DNA, 15 bp, Homo sapiens
aagaatcgcttgaac

SEQ ID NO: 14685 - DNA, 15 bp, Homo sapiens
gaagaatcgcttgaa

SEQ ID NO: 14686 - DNA, 15 bp, Homo sapiens
agaagaatcgcttga

SEQ ID NO: 14687 - DNA, 15 bp, Homo sapiens
cagaagaatcgcttg

SEQ ID NO: 14688 - DNA, 15 bp, Homo sapiens
gcagaagaatcgctt

SEQ ID NO: 14689 - DNA, 15 bp, Homo sapiens
ggcagaagaatcgct

SEQ ID NO: 14690 - DNA, 15 bp, Homo sapiens
aggcagaagaatcgc

SEQ ID NO: 14691 - DNA, 15 bp, Homo sapiens
gaggcagaagaatcg

SEQ ID NO: 14692 - DNA, 15 bp, Homo sapiens
tgaggcagaagaatc

SEQ ID NO: 14693 - DNA, 15 bp, Homo sapiens
ctgaggcagaagaat

SEQ ID NO: 14694 - DNA, 15 bp, Homo sapiens
gctgaggcagaagaa

SEQ ID NO: 14695 - DNA, 15 bp, Homo sapiens
ggctcaggaggctga

SEQ ID NO: 14696 - DNA, 15 bp, Homo sapiens
gggctcaggaggctg

SEQ ID NO: 14697 - DNA, 15 bp, Homo sapiens
tgggctcaggaggct

SEQ ID NO: 14698 - DNA, 15 bp, Homo sapiens
ctgggctcaggaggc

SEQ ID NO: 14699 - DNA, 15 bp, Homo sapiens
tctgggctcaggagg

SEQ ID NO: 14700 - DNA, 15 bp, Homo sapiens
gtctgggctcaggag

SEQ ID NO: 14701 - DNA, 15 bp, Homo sapiens
agtctgggctcagga

SEQ ID NO: 14702 - DNA, 15 bp, Homo sapiens
tagtctgggctcagg

SEQ ID NO: 14703 - DNA, 15 bp, Homo sapiens
atagtctgggctcag

SEQ ID NO: 14704 - DNA, 15 bp, Homo sapiens
aatagtctgggctca

SEQ ID NO: 14705 - DNA, 15 bp, Homo sapiens
taatagtctgggctc

SEQ ID NO: 14706 - DNA, 15 bp, Homo sapiens
ttaatagtctgggct

SEQ ID NO: 14707 - DNA, 15 bp, Homo sapiens
cttaatagtctgggc

SEQ ID NO: 14708 - DNA, 15 bp, Homo sapiens
gcttaatagtctggg

SEQ ID NO: 14709 - DNA, 15 bp, Homo sapiens
agcttaatagtctgg

SEQ ID NO: 14710 - DNA, 15 bp, Homo sapiens
cagcttaatagtctg

SEQ ID NO: 14711 - DNA, 15 bp, Homo sapiens
acagcttaatagtct

SEQ ID NO: 14712 - DNA, 15 bp, Homo sapiens
tacagcttaatagtc

SEQ ID NO: 14713 - DNA, 15 bp, Homo sapiens
gtacagcttaatagt

SEQ ID NO: 14714 - DNA, 15 bp, Homo sapiens
agtacagcttaatag

SEQ ID NO: 14715 - DNA, 15 bp, Homo sapiens
cagtacagcttaata

SEQ ID NO: 14716 - DNA, 15 bp, Homo sapiens
gcagtacagcttaat

SEQ ID NO: 14717 - DNA, 15 bp, Homo sapiens
ggcagtacagcttaa

SEQ ID NO: 14718 - DNA, 15 bp, Homo sapiens
aggcagtacagctta

SEQ ID NO: 14719 - DNA, 15 bp, Homo sapiens
gaggcagtacagctt

SEQ ID NO: 14720 - DNA, 15 bp, Homo sapiens
agaggcagtacagct

SEQ ID NO: 14721 - DNA, 15 bp, Homo sapiens
gagaggcagtacagc

SEQ ID NO: 14722 - DNA, 15 bp, Homo sapiens
tgagaggcagtacag

SEQ ID NO: 14723 - DNA, 15 bp, Homo sapiens
atgagaggcagtaca

SEQ ID NO: 14724 - DNA, 15 bp, Homo sapiens
catgagaggcagtac

SEQ ID NO: 14725 - DNA, 15 bp, Homo sapiens
tcatgagaggcagta

SEQ ID NO: 14726 - DNA, 15 bp, Homo sapiens
ctcatgagaggcagt

SEQ ID NO: 14727 - DNA, 15 bp, Homo sapiens
tctcatgagaggcag

SEQ ID NO: 14728 - DNA, 15 bp, Homo sapiens
gtctcatgagaggca

SEQ ID NO: 14729 - DNA, 15 bp, Homo sapiens
tgtctcatgagaggc

SEQ ID NO: 14730 - DNA, 15 bp, Homo sapiens
ctgtctcatgagagg

SEQ ID NO: 14731 - DNA, 15 bp, Homo sapiens
tctgtctcatgagag

SEQ ID NO: 14732 - DNA, 15 bp, Homo sapiens
ttctgtctcatgaga

SEQ ID NO: 14733 - DNA, 15 bp, Homo sapiens
attctgtctcatgag

SEQ ID NO: 14734 - DNA, 15 bp, Homo sapiens
aattctgtctcatga

SEQ ID NO: 14735 - DNA, 15 bp, Homo sapiens
caattctgtctcatg

SEQ ID NO: 14736 - DNA, 15 bp, Homo sapiens
tcaattctgtctcat

SEQ ID NO: 14737 - DNA, 15 bp, Homo sapiens
atcaattctgtctca

SEQ ID NO: 14738 - DNA, 15 bp, Homo sapiens
aatcaattctgtctc

SEQ ID NO: 14739 - DNA, 15 bp, Homo sapiens
aaatcaattctgtct

SEQ ID NO: 14740 - DNA, 15 bp, Homo sapiens
aaaatcaattctgtc

SEQ ID NO: 14741 - DNA, 15 bp, Homo sapiens
taaaatcaattctgt

SEQ ID NO: 14742 - DNA, 15 bp, Homo sapiens
ttaaaatcaattctg

SEQ ID NO: 14743 - DNA, 15 bp, Homo sapiens
tttaaaatcaattct

SEQ ID NO: 14744 - DNA, 15 bp, Homo sapiens
atttaaaatcaattc

SEQ ID NO: 14745 - DNA, 15 bp, Homo sapiens
catttaaaatcaatt

SEQ ID NO: 14746 - DNA, 15 bp, Homo sapiens
ccatttaaaatcaat

SEQ ID NO: 14747 - DNA, 15 bp, Homo sapiens
gccatttaaaatcaa

SEQ ID NO: 14748 - DNA, 15 bp, Homo sapiens
tgccatttaaaatca

SEQ ID NO: 14749 - DNA, 15 bp, Homo sapiens
ctgccatttaaaatc

SEQ ID NO: 14750 - DNA, 15 bp, Homo sapiens
cctgccatttaaaat

SEQ ID NO: 14751 - DNA, 15 bp, Homo sapiens
ccctgccatttaaaa

SEQ ID NO: 14752 - DNA, 15 bp, Homo sapiens
cccctgccatttaaa

SEQ ID NO: 14753 - DNA, 15 bp, Homo sapiens
ccccctgccatttaa

SEQ ID NO: 14754 - DNA, 15 bp, Homo sapiens
tccccctgccattta

SEQ ID NO: 14755 - DNA, 15 bp, Homo sapiens
atccccctgccattt

SEQ ID NO: 14756 - DNA, 15 bp, Homo sapiens
aatccccctgccatt

SEQ ID NO: 14757 - DNA, 15 bp, Homo sapiens
aaatccccctgccat

SEQ ID NO: 14758 - DNA, 15 bp, Homo sapiens
caaatccccctgcca

SEQ ID NO: 14759 - DNA, 15 bp, Homo sapiens
ccaaatccccctgcc

SEQ ID NO: 14760 - DNA, 15 bp, Homo sapiens
gccaaatccccctgc

SEQ ID NO: 14761 - DNA, 15 bp, Homo sapiens
agccaaatccccctg

SEQ ID NO: 14762 - DNA, 15 bp, Homo sapiens
tagccaaatccccct

SEQ ID NO: 14763 - DNA, 15 bp, Homo sapiens
ttagccaaatccccc

SEQ ID NO: 14764 - DNA, 15 bp, Homo sapiens
tttagccaaatcccc

SEQ ID NO: 14765 - DNA, 15 bp, Homo sapiens
ctttagccaaatccc

SEQ ID NO: 14766 - DNA, 15 bp, Homo sapiens
cctttagccaaatcc

SEQ ID NO: 14767 - DNA, 15 bp, Homo sapiens
acctttagccaaatc

SEQ ID NO: 14768 - DNA, 15 bp, Homo sapiens
cacctttagccaaat

SEQ ID NO: 14769 - DNA, 15 bp, Homo sapiens
tcacctttagccaaa

SEQ ID NO: 14770 - DNA, 15 bp, Homo sapiens
ttcacctttagccaa

SEQ ID NO: 14771 - DNA, 15 bp, Homo sapiens
tttcacctttagcca

SEQ ID NO: 14772 - DNA, 15 bp, Homo sapiens
ctttcacctttagcc

SEQ ID NO: 14773 - DNA, 15 bp, Homo sapiens
gctttcacctttagc

SEQ ID NO: 14774 - DNA, 15 bp, Homo sapiens
agctttcacctttag

SEQ ID NO: 14775 - DNA, 15 bp, Homo sapiens
cagctttcaccttta

SEQ ID NO: 14776 - DNA, 15 bp, Homo sapiens
acagctttcaccttt

SEQ ID NO: 14777 - DNA, 15 bp, Homo sapiens
cacagctttcacctt

SEQ ID NO: 14778 - DNA, 15 bp, Homo sapiens
acacagctttcacct

SEQ ID NO: 14779 - DNA, 15 bp, Homo sapiens
aacacagctttcacc

SEQ ID NO: 14780 - DNA, 15 bp, Homo sapiens
aaacacagctttcac

SEQ ID NO: 14781 - DNA, 15 bp, Homo sapiens
aaaacacagctttca

SEQ ID NO: 14782 - DNA, 15 bp, Homo sapiens
taaaacacagctttc

SEQ ID NO: 14783 - DNA, 15 bp, Homo sapiens
gtaaaacacagcttt

SEQ ID NO: 14784 - DNA, 15 bp, Homo sapiens
tgtaaaacacagctt

SEQ ID NO: 14785 - DNA, 15 bp, Homo sapiens
ctgtaaaacacagct

SEQ ID NO: 14786 - DNA, 15 bp, Homo sapiens
actgtaaaacacagc

SEQ ID NO: 14787 - DNA, 15 bp, Homo sapiens
gactgtaaaacacag

SEQ ID NO: 14788 - DNA, 15 bp, Homo sapiens
agactgtaaaacaca

SEQ ID NO: 14789 - DNA, 15 bp, Homo sapiens
aagactgtaaaacac

SEQ ID NO: 14790 - DNA, 15 bp, Homo sapiens
taagactgtaaaaca

SEQ ID NO: 14791 - DNA, 15 bp, Homo sapiens
ctaagactgtaaaac

SEQ ID NO: 14792 - DNA, 15 bp, Homo sapiens
cctaagactgtaaaa

SEQ ID NO: 14793 - DNA, 15 bp, Homo sapiens
ccctaagactgtaaa

SEQ ID NO: 14794 - DNA, 15 bp, Homo sapiens
tccctaagactgtaa

SEQ ID NO: 14795 - DNA, 15 bp, Homo sapiens
gtccctaagactgta

SEQ ID NO: 14796 - DNA, 15 bp, Homo sapiens
tgtccctaagactgt

SEQ ID NO: 14797 - DNA, 15 bp, Homo sapiens
ctgtccctaagactg

SEQ ID NO: 14798 - DNA, 15 bp, Homo sapiens
gctgtccctaagact

SEQ ID NO: 14799 - DNA, 15 bp, Homo sapiens
tgctgtccctaagac

SEQ ID NO: 14800 - DNA, 15 bp, Homo sapiens
ctgctgtccctaaga

SEQ ID NO: 14801 - DNA, 15 bp, Homo sapiens
tctgctgtccctaag

SEQ ID NO: 14802 - DNA, 15 bp, Homo sapiens
ctctgctgtccctaa

SEQ ID NO: 14803 - DNA, 15 bp, Homo sapiens
actctgctgtcccta

SEQ ID NO: 14804 - DNA, 15 bp, Homo sapiens
gactctgctgtccct

SEQ ID NO: 14805 - DNA, 15 bp, Homo sapiens
agactctgctgtccc

SEQ ID NO: 14806 - DNA, 15 bp, Homo sapiens
cagactctgctgtcc

SEQ ID NO: 14807 - DNA, 15 bp, Homo sapiens
acagactctgctgtc

SEQ ID NO: 14808 - DNA, 15 bp, Homo sapiens
tacagactctgctgt

SEQ ID NO: 14809 - DNA, 15 bp, Homo sapiens
ttacagactctgctg

SEQ ID NO: 14810 - DNA, 15 bp, Homo sapiens
attacagactctgct

SEQ ID NO: 14811 - DNA, 15 bp, Homo sapiens
aattacagactctgc

SEQ ID NO: 14812 - DNA, 15 bp, Homo sapiens
caattacagactctg

SEQ ID NO: 14813 - DNA, 15 bp, Homo sapiens
gcaattacagactct

SEQ ID NO: 14814 - DNA, 15 bp, Homo sapiens
agcaattacagactc

SEQ ID NO: 14815 - DNA, 15 bp, Homo sapiens
aagcaattacagact

SEQ ID NO: 14816 - DNA, 15 bp, Homo sapiens
aaagcaattacagac

SEQ ID NO: 14817 - DNA, 15 bp, Homo sapiens
aaaagcaattacaga

SEQ ID NO: 14818 - DNA, 15 bp, Homo sapiens
gaaaagcaattacag

SEQ ID NO: 14819 - DNA, 15 bp, Homo sapiens
ggaaaagcaattaca

SEQ ID NO: 14820 - DNA, 15 bp, Homo sapiens
aggaaaagcaattac

SEQ ID NO: 14821 - DNA, 15 bp, Homo sapiens
gaggaaaagcaatta

SEQ ID NO: 14822 - DNA, 15 bp, Homo sapiens
tgaggaaaagcaatt

SEQ ID NO: 14823 - DNA, 15 bp, Homo sapiens
atgaggaaaagcaat

SEQ ID NO: 14824 - DNA, 15 bp, Homo sapiens
aatgaggaaaagcaa

SEQ ID NO: 14825 - DNA, 15 bp, Homo sapiens
caatgaggaaaagca

SEQ ID NO: 14826 - DNA, 15 bp, Homo sapiens
acaatgaggaaaagc

SEQ ID NO: 14827 - DNA, 15 bp, Homo sapiens
aacaatgaggaaaag

SEQ ID NO: 14828 - DNA, 15 bp, Homo sapiens
aaacaatgaggaaaa

SEQ ID NO: 14829 - DNA, 15 bp, Homo sapiens
aaaacaatgaggaaa

SEQ ID NO: 14830 - DNA, 15 bp, Homo sapiens
taaaacaatgaggaa

SEQ ID NO: 14831 - DNA, 15 bp, Homo sapiens
ataaaacaatgagga

SEQ ID NO: 14832 - DNA, 15 bp, Homo sapiens
gataaaacaatgagg

SEQ ID NO: 14833 - DNA, 15 bp, Homo sapiens
ggataaaacaatgag

SEQ ID NO: 14834 - DNA, 15 bp, Homo sapiens
gggataaaacaatga

SEQ ID NO: 14835 - DNA, 15 bp, Homo sapiens
ggggataaaacaatg

SEQ ID NO: 14836 - DNA, 15 bp, Homo sapiens
aggggataaaacaat

SEQ ID NO: 14837 - DNA, 15 bp, Homo sapiens
aaggggataaaacaa

SEQ ID NO: 14838 - DNA, 15 bp, Homo sapiens
taaggggataaaaca

SEQ ID NO: 14839 - DNA, 15 bp, Homo sapiens
ctaaggggataaaac

SEQ ID NO: 14840 - DNA, 15 bp, Homo sapiens
gctaaggggataaaa

SEQ ID NO: 14841 - DNA, 15 bp, Homo sapiens
agctaaggggataaa

SEQ ID NO: 14842 - DNA, 15 bp, Homo sapiens
aagctaaggggataa

SEQ ID NO: 14843 - DNA, 15 bp, Homo sapiens
taagctaaggggata

SEQ ID NO: 14844 - DNA, 15 bp, Homo sapiens
ttaagctaaggggat

SEQ ID NO: 14845 - DNA, 15 bp, Homo sapiens
attaagctaagggga

SEQ ID NO: 14846 - DNA, 15 bp, Homo sapiens
aattaagctaagggg

SEQ ID NO: 14847 - DNA, 15 bp, Homo sapiens
caattaagctaaggg

SEQ ID NO: 14848 - DNA, 15 bp, Homo sapiens
tcaattaagctaagg

SEQ ID NO: 14849 - DNA, 15 bp, Homo sapiens
ctcaattaagctaag

SEQ ID NO: 14850 - DNA, 15 bp, Homo sapiens
cctcaattaagctaa

SEQ ID NO: 14851 - DNA, 15 bp, Homo sapiens
ccctcaattaagcta

SEQ ID NO: 14852 - DNA, 15 bp, Homo sapiens
accctcaattaagct

SEQ ID NO: 14853 - DNA, 15 bp, Homo sapiens
taccctcaattaagc

SEQ ID NO: 14854 - DNA, 15 bp, Homo sapiens
gtaccctcaattaag

SEQ ID NO: 14855 - DNA, 15 bp, Homo sapiens
agtaccctcaattaa

SEQ ID NO: 14856 - DNA, 15 bp, Homo sapiens
aagtaccctcaatta

SEQ ID NO: 14857 - DNA, 15 bp, Homo sapiens
taagtaccctcaatt

SEQ ID NO: 14858 - DNA, 15 bp, Homo sapiens
ttaagtaccctcaat

SEQ ID NO: 14859 - DNA, 15 bp, Homo sapiens
gttaagtaccctcaa

SEQ ID NO: 14860 - DNA, 15 bp, Homo sapiens
cgttaagtaccctca

SEQ ID NO: 14861 - DNA, 15 bp, Homo sapiens
acgttaagtaccctc

SEQ ID NO: 14862 - DNA, 15 bp, Homo sapiens
aacgttaagtaccct

SEQ ID NO: 14863 - DNA, 15 bp, Homo sapiens
aaacgttaagtaccc

SEQ ID NO: 14864 - DNA, 15 bp, Homo sapiens
gaaacgttaagtacc

SEQ ID NO: 14865 - DNA, 15 bp, Homo sapiens
cgaaacgttaagtac

SEQ ID NO: 14866 - DNA, 15 bp, Homo sapiens
acgaaacgttaagta

SEQ ID NO: 14867 - DNA, 15 bp, Homo sapiens
aacgaaacgttaagt

SEQ ID NO: 14868 - DNA, 15 bp, Homo sapiens
aaacgaaacgttaag

SEQ ID NO: 14869 - DNA, 15 bp, Homo sapiens
aaaacgaaacgttaa

SEQ ID NO: 14870 - DNA, 15 bp, Homo sapiens
aaaaacgaaacgtta

SEQ ID NO: 14871 - DNA, 15 bp, Homo sapiens
taaaaacgaaacgtt

SEQ ID NO: 14872 - DNA, 15 bp, Homo sapiens
ttaaaaacgaaacgt

SEQ ID NO: 14873 - DNA, 15 bp, Homo sapiens
attaaaaacgaaacg

SEQ ID NO: 14874 - DNA, 15 bp, Homo sapiens
tattaaaaacgaaac

SEQ ID NO: 14875 - DNA, 15 bp, Homo sapiens
gtattaaaaacgaaa

SEQ ID NO: 14876 - DNA, 15 bp, Homo sapiens
tgtattaaaaacgaa

SEQ ID NO: 14877 - DNA, 15 bp, Homo sapiens
ttgtattaaaaacga

SEQ ID NO: 14878 - DNA, 15 bp, Homo sapiens
tttgtattaaaaacg

SEQ ID NO: 14879 - DNA, 15 bp, Homo sapiens
atttgtattaaaaac

SEQ ID NO: 14880 - DNA, 15 bp, Homo sapiens
aatttgtattaaaaa

SEQ ID NO: 14881 - DNA, 15 bp, Homo sapiens
taatttgtattaaaa

SEQ ID NO: 14882 - DNA, 15 bp, Homo sapiens
ttaatttgtattaaa

SEQ ID NO: 14883 - DNA, 15 bp, Homo sapiens
attaatttgtattaa

SEQ ID NO: 14884 - DNA, 15 bp, Homo sapiens
tattaatttgtatta

SEQ ID NO: 14885 - DNA, 15 bp, Homo sapiens
ttattaatttgtatt

SEQ ID NO: 14886 - DNA, 15 bp, Homo sapiens
tttattaatttgtat

SEQ ID NO: 14887 - DNA, 15 bp, Homo sapiens
atttattaatttgta

SEQ ID NO: 14888 - DNA, 15 bp, Homo sapiens
catttattaatttgt

SEQ ID NO: 14889 - DNA, 15 bp, Homo sapiens
acatttattaatttg

SEQ ID NO: 14890 - DNA, 15 bp, Homo sapiens
gacatttattaattt

SEQ ID NO: 14891 - DNA, 15 bp, Homo sapiens
ggacatttattaatt

SEQ ID NO: 14892 - DNA, 15 bp, Homo sapiens
aggacatttattaat

SEQ ID NO: 14893 - DNA, 15 bp, Homo sapiens
aaggacatttattaa

SEQ ID NO: 14894 - DNA, 15 bp, Homo sapiens
caaggacatttatta

SEQ ID NO: 14895 - DNA, 15 bp, Homo sapiens
acaaggacatttatt

SEQ ID NO: 14896 - DNA, 15 bp, Homo sapiens
cacaaggacatttat

SEQ ID NO: 14897 - DNA, 15 bp, Homo sapiens
acacaaggacattta

SEQ ID NO: 14898 - DNA, 15 bp, Homo sapiens
gacacaaggacattt

SEQ ID NO: 14899 - DNA, 15 bp, Homo sapiens
agacacaaggacatt

SEQ ID NO: 14900 - DNA, 15 bp, Homo sapiens
cagacacaaggacat

SEQ ID NO: 14901 - DNA, 15 bp, Homo sapiens
acagacacaaggaca

SEQ ID NO: 14902 - DNA, 15 bp, Homo sapiens
aacagacacaaggac

SEQ ID NO: 14903 - DNA, 15 bp, Homo sapiens
caacagacacaagga

SEQ ID NO: 14904 - DNA, 15 bp, Homo sapiens
gcaacagacacaagg

SEQ ID NO: 14905 - DNA, 15 bp, Homo sapiens
ggcaacagacacaag

SEQ ID NO: 14906 - DNA, 15 bp, Homo sapiens
aggcaacagacacaa

SEQ ID NO: 14907 - DNA, 15 bp, Homo sapiens
aaggcaacagacaca

SEQ ID NO: 14908 - DNA, 15 bp, Homo sapiens
taaggcaacagacac

SEQ ID NO: 14909 - DNA, 15 bp, Homo sapiens
ctaaggcaacagaca

SEQ ID NO: 14910 - DNA, 15 bp, Homo sapiens
tctaaggcaacagac

SEQ ID NO: 14911 - DNA, 15 bp, Homo sapiens
atctaaggcaacaga

SEQ ID NO: 14912 - DNA, 15 bp, Homo sapiens
catctaaggcaacag

SEQ ID NO: 14913 - DNA, 15 bp, Homo sapiens
acatctaaggcaaca

SEQ ID NO: 14914 - DNA, 15 bp, Homo sapiens
cacatctaaggcaac

SEQ ID NO: 14915 - DNA, 15 bp, Homo sapiens
tcacatctaaggcaa

SEQ ID NO: 14916 - DNA, 15 bp, Homo sapiens
ttcacatctaaggca

SEQ ID NO: 14917 - DNA, 15 bp, Homo sapiens
attcacatctaaggc

SEQ ID NO: 14918 - DNA, 15 bp, Homo sapiens
aattcacatctaagg

SEQ ID NO: 14919 - DNA, 15 bp, Homo sapiens
caattcacatctaag

SEQ ID NO: 14920 - DNA, 15 bp, Homo sapiens
acaattcacatctaa

SEQ ID NO: 14921 - DNA, 15 bp, Homo sapiens
aacaattcacatcta

SEQ ID NO: 14922 - DNA, 15 bp, Homo sapiens
aaacaattcacatct

SEQ ID NO: 14923 - DNA, 15 bp, Homo sapiens
taaacaattcacatc

SEQ ID NO: 14924 - DNA, 15 bp, Homo sapiens
ctaaacaattcacat

SEQ ID NO: 14925 - DNA, 15 bp, Homo sapiens
actaaacaattcaca

SEQ ID NO: 14926 - DNA, 15 bp, Homo sapiens
tactaaacaattcac

SEQ ID NO: 14927 - DNA, 15 bp, Homo sapiens
gtactaaacaattca

SEQ ID NO: 14928 - DNA, 15 bp, Homo sapiens
tgtactaaacaattc

SEQ ID NO: 14929 - DNA, 15 bp, Homo sapiens
ttgtactaaacaatt

SEQ ID NO: 14930 - DNA, 15 bp, Homo sapiens
tttgtactaaacaat

SEQ ID NO: 14931 - DNA, 15 bp, Homo sapiens
atttgtactaaacaa

SEQ ID NO: 14932 - DNA, 15 bp, Homo sapiens
catttgtactaaaca

SEQ ID NO: 14933 - DNA, 15 bp, Homo sapiens
acatttgtactaaac

SEQ ID NO: 14934 - DNA, 15 bp, Homo sapiens
aacatttgtactaaa

SEQ ID NO: 14935 - DNA, 15 bp, Homo sapiens
taacatttgtactaa

SEQ ID NO: 14936 - DNA, 15 bp, Homo sapiens
gtaacatttgtacta

SEQ ID NO: 14937 - DNA, 15 bp, Homo sapiens
agtaacatttgtact

SEQ ID NO: 14938 - DNA, 15 bp, Homo sapiens
cagtaacatttgtac

SEQ ID NO: 14939 - DNA, 15 bp, Homo sapiens
ccagtaacatttgta

SEQ ID NO: 14940 - DNA, 15 bp, Homo sapiens
accagtaacatttgt

SEQ ID NO: 14941 - DNA, 15 bp, Homo sapiens
caccagtaacatttg

SEQ ID NO: 14942 - DNA, 15 bp, Homo sapiens
ccaccagtaacattt

SEQ ID NO: 14943 - DNA, 15 bp, Homo sapiens
cccaccagtaacatt

SEQ ID NO: 14944 - DNA, 15 bp, Homo sapiens
gcccaccagtaacat

SEQ ID NO: 14945 - DNA, 15 bp, Homo sapiens
agcccaccagtaaca

SEQ ID NO: 14946 - DNA, 15 bp, Homo sapiens
aagcccaccagtaac

SEQ ID NO: 14947 - DNA, 15 bp, Homo sapiens
gaagcccaccagtaa

SEQ ID NO: 14948 - DNA, 15 bp, Homo sapiens
ggaagcccaccagta

SEQ ID NO: 14949 - DNA, 15 bp, Homo sapiens
aggaagcccaccagt

SEQ ID NO: 14950 - DNA, 15 bp, Homo sapiens
aaggaagcccaccag

SEQ ID NO: 14951 - DNA, 15 bp, Homo sapiens
aaaggaagcccacca

SEQ ID NO: 14952 - DNA, 15 bp, Homo sapiens
gaaaggaagcccacc

SEQ ID NO: 14953 - DNA, 15 bp, Homo sapiens
agaaaggaagcccac

SEQ ID NO: 14954 - DNA, 15 bp, Homo sapiens
aagaaaggaagccca

SEQ ID NO: 14955 - DNA, 15 bp, Homo sapiens
aaagaaaggaagccc

SEQ ID NO: 14956 - DNA, 15 bp, Homo sapiens
aaaagaaaggaagcc

SEQ ID NO: 14957 - DNA, 15 bp, Homo sapiens
aaaaagaaaggaagc

SEQ ID NO: 14958 - DNA, 15 bp, Homo sapiens
taaaaagaaaggaag

SEQ ID NO: 14959 - DNA, 15 bp, Homo sapiens
ttaaaaagaaaggaa

SEQ ID NO: 14960 - DNA, 15 bp, Homo sapiens
tttaaaaagaaagga

SEQ ID NO: 14961 - DNA, 15 bp, Homo sapiens
ctttaaaaagaaagg

SEQ ID NO: 14962 - DNA, 15 bp, Homo sapiens
tctttaaaaagaaag

SEQ ID NO: 14963 - DNA, 15 bp, Homo sapiens
atctttaaaaagaaa

SEQ ID NO: 14964 - DNA, 15 bp, Homo sapiens
aatctttaaaaagaa

SEQ ID NO: 14965 - DNA, 15 bp, Homo sapiens
taatctttaaaaaga

SEQ ID NO: 14966 - DNA, 15 bp, Homo sapiens
ctaatctttaaaaag

SEQ ID NO: 14967 - DNA, 15 bp, Homo sapiens
tctaatctttaaaaa

SEQ ID NO: 14968 - DNA, 15 bp, Homo sapiens
gtctaatctttaaaa

SEQ ID NO: 14969 - DNA, 15 bp, Homo sapiens
ggtctaatctttaaa

SEQ ID NO: 14970 - DNA, 15 bp, Homo sapiens
aggtctaatctttaa

SEQ ID NO: 14971 - DNA, 15 bp, Homo sapiens
gaggtctaatcttta

SEQ ID NO: 14972 - DNA, 15 bp, Homo sapiens
agaggtctaatcttt

SEQ ID NO: 14973 - DNA, 15 bp, Homo sapiens
tagaggtctaatctt

SEQ ID NO: 14974 - DNA, 15 bp, Homo sapiens
ttagaggtctaatct

SEQ ID NO: 14975 - DNA, 15 bp, Homo sapiens
gttagaggtctaatc

SEQ ID NO: 14976 - DNA, 15 bp, Homo sapiens
tgttagaggtctaat

SEQ ID NO: 14977 - DNA, 15 bp, Homo sapiens
atgttagaggtctaa

SEQ ID NO: 14978 - DNA, 15 bp, Homo sapiens
aatgttagaggtcta

SEQ ID NO: 14979 - DNA, 15 bp, Homo sapiens
aaatgttagaggtct

SEQ ID NO: 14980 - DNA, 15 bp, Homo sapiens
aaaatgttagaggtc

SEQ ID NO: 14981 - DNA, 15 bp, Homo sapiens
taaaatgttagaggt

SEQ ID NO: 14982 - DNA, 15 bp, Homo sapiens
ataaaatgttagagg

SEQ ID NO: 14983 - DNA, 15 bp, Homo sapiens
aataaaatgttagag

SEQ ID NO: 14984 - DNA, 15 bp, Homo sapiens
gaataaaatgttaga

SEQ ID NO: 14985 - DNA, 15 bp, Homo sapiens
ggaataaaatgttag

SEQ ID NO: 14986 - DNA, 15 bp, Homo sapiens
aggaataaaatgtta

SEQ ID NO: 14987 - DNA, 15 bp, Homo sapiens
aaggaataaaatgtt

SEQ ID NO: 14988 - DNA, 15 bp, Homo sapiens
caaggaataaaatgt

SEQ ID NO: 14989 - DNA, 15 bp, Homo sapiens
ccaaggaataaaatg

SEQ ID NO: 14990 - DNA, 15 bp, Homo sapiens
cccaaggaataaaat

SEQ ID NO: 14991 - DNA, 15 bp, Homo sapiens
acccaaggaataaaa

SEQ ID NO: 14992 - DNA, 15 bp, Homo sapiens
aacccaaggaataaa

SEQ ID NO: 14993 - DNA, 15 bp, Homo sapiens
taacccaaggaataa

SEQ ID NO: 14994 - DNA, 15 bp, Homo sapiens
ctaacccaaggaata

SEQ ID NO: 14995 - DNA, 15 bp, Homo sapiens
tctaacccaaggaat

SEQ ID NO: 14996 - DNA, 15 bp, Homo sapiens
ttctaacccaaggaa

SEQ ID NO: 14997 - DNA, 15 bp, Homo sapiens
tttctaacccaagga

SEQ ID NO: 14998 - DNA, 15 bp, Homo sapiens
atttctaacccaagg

SEQ ID NO: 14999 - DNA, 15 bp, Homo sapiens
tatttctaacccaag

SEQ ID NO: 15000 - DNA, 15 bp, Homo sapiens
ttatttctaacccaa

SEQ ID NO: 15001 - DNA, 15 bp, Homo sapiens
attatttctaaccca

SEQ ID NO: 15002 - DNA, 15 bp, Homo sapiens
aattatttctaaccc

SEQ ID NO: 15003 - DNA, 15 bp, Homo sapiens
caattatttctaacc

SEQ ID NO: 15004 - DNA, 15 bp, Homo sapiens
gcaattatttctaac

SEQ ID NO: 15005 - DNA, 15 bp, Homo sapiens
tgcaattatttctaa

SEQ ID NO: 15006 - DNA, 15 bp, Homo sapiens
ctgcaattatttcta

SEQ ID NO: 15007 - DNA, 15 bp, Homo sapiens
actgcaattatttct

SEQ ID NO: 15008 - DNA, 15 bp, Homo sapiens
cactgcaattatttc

SEQ ID NO: 15009 - DNA, 15 bp, Homo sapiens
acactgcaattattt

SEQ ID NO: 15010 - DNA, 15 bp, Homo sapiens
gacactgcaattatt

SEQ ID NO: 15011 - DNA, 15 bp, Homo sapiens
tgacactgcaattat

SEQ ID NO: 15012 - DNA, 15 bp, Homo sapiens
ctgacactgcaatta

SEQ ID NO: 15013 - DNA, 15 bp, Homo sapiens
cctgacactgcaatt

SEQ ID NO: 15014 - DNA, 15 bp, Homo sapiens
gcctgacactgcaat

SEQ ID NO: 15015 - DNA, 15 bp, Homo sapiens
tgcctgacactgcaa

SEQ ID NO: 15016 - DNA, 15 bp, Homo sapiens
ctgcctgacactgca

SEQ ID NO: 15017 - DNA, 15 bp, Homo sapiens
cctgcctgacactgc

SEQ ID NO: 15018 - DNA, 15 bp, Homo sapiens
acctgcctgacactg

SEQ ID NO: 15019 - DNA, 15 bp, Homo sapiens
gacctgcctgacact

SEQ ID NO: 15020 - DNA, 15 bp, Homo sapiens
agacctgcctgacac

SEQ ID NO: 15021 - DNA, 15 bp, Homo sapiens
aagacctgcctgaca

SEQ ID NO: 15022 - DNA, 15 bp, Homo sapiens
aaagacctgcctgac

SEQ ID NO: 15023 - DNA, 15 bp, Homo sapiens
taaagacctgcctga

SEQ ID NO: 15024 - DNA, 15 bp, Homo sapiens
gtaaagacctgcctg

SEQ ID NO: 15025 - DNA, 15 bp, Homo sapiens
agtaaagacctgcct

SEQ ID NO: 15026 - DNA, 15 bp, Homo sapiens
tagtaaagacctgcc

SEQ ID NO: 15027 - DNA, 15 bp, Homo sapiens
gtagtaaagacctgc

SEQ ID NO: 15028 - DNA, 15 bp, Homo sapiens
agtagtaaagacctg

SEQ ID NO: 15029 - DNA, 15 bp, Homo sapiens
gagtagtaaagacct

SEQ ID NO: 15030 - DNA, 15 bp, Homo sapiens
agagtagtaaagacc

SEQ ID NO: 15031 - DNA, 15 bp, Homo sapiens
aagagtagtaaagac

SEQ ID NO: 15032 - DNA, 15 bp, Homo sapiens
gaagagtagtaaaga

SEQ ID NO: 15033 - DNA, 15 bp, Homo sapiens
agaagagtagtaaag

SEQ ID NO: 15034 - DNA, 15 bp, Homo sapiens
cagaagagtagtaaa

SEQ ID NO: 15035 - DNA, 15 bp, Homo sapiens
acagaagagtagtaa

SEQ ID NO: 15036 - DNA, 15 bp, Homo sapiens
aacagaagagtagta

SEQ ID NO: 15037 - DNA, 15 bp, Homo sapiens
aaacagaagagtagt

SEQ ID NO: 15038 - DNA, 15 bp, Homo sapiens
aaaacagaagagtag

SEQ ID NO: 15039 - DNA, 15 bp, Homo sapiens
gaaaacagaagagta

SEQ ID NO: 15040 - DNA, 15 bp, Homo sapiens
agaaaacagaagagt

SEQ ID NO: 15041 - DNA, 15 bp, Homo sapiens
aagaaaacagaagag

SEQ ID NO: 15042 - DNA, 15 bp, Homo sapiens
aaagaaaacagaaga

SEQ ID NO: 15043 - DNA, 15 bp, Homo sapiens
aaaagaaaacagaag

SEQ ID NO: 15044 - DNA, 15 bp, Homo sapiens
taaaagaaaacagaa

SEQ ID NO: 15045 - DNA, 15 bp, Homo sapiens
ataaaagaaaacaga

SEQ ID NO: 15046 - DNA, 15 bp, Homo sapiens
tataaaagaaaacag

SEQ ID NO: 15047 - DNA, 15 bp, Homo sapiens
gtataaaagaaaaca

SEQ ID NO: 15048 - DNA, 15 bp, Homo sapiens
tgtataaaagaaaac

SEQ ID NO: 15049 - DNA, 15 bp, Homo sapiens
ctgtataaaagaaaa

SEQ ID NO: 15050 - DNA, 15 bp, Homo sapiens
cctgtataaaagaaa

SEQ ID NO: 15051 - DNA, 15 bp, Homo sapiens
tcctgtataaaagaa

SEQ ID NO: 15052 - DNA, 15 bp, Homo sapiens
ttcctgtataaaaga

SEQ ID NO: 15053 - DNA, 15 bp, Homo sapiens
tttcctgtataaaag

SEQ ID NO: 15054 - DNA, 15 bp, Homo sapiens
ctttcctgtataaaa

SEQ ID NO: 15055 - DNA, 15 bp, Homo sapiens
tctttcctgtataaa

SEQ ID NO: 15056 - DNA, 15 bp, Homo sapiens
ttctttcctgtataa

SEQ ID NO: 15057 - DNA, 15 bp, Homo sapiens
tttctttcctgtata

SEQ ID NO: 15058 - DNA, 15 bp, Homo sapiens
atttctttcctgtat

SEQ ID NO: 15059 - DNA, 15 bp, Homo sapiens
catttctttcctgta

SEQ ID NO: 15060 - DNA, 15 bp, Homo sapiens
gcatttctttcctgt

SEQ ID NO: 15061 - DNA, 15 bp, Homo sapiens
agcatttctttcctg

SEQ ID NO: 15062 - DNA, 15 bp, Homo sapiens
cagcatttctttcct

SEQ ID NO: 15063 - DNA, 15 bp, Homo sapiens
tcagcatttctttcc

SEQ ID NO: 15064 - DNA, 15 bp, Homo sapiens
ttcagcatttctttc

SEQ ID NO: 15065 - DNA, 15 bp, Homo sapiens
tttcagcatttcttt

SEQ ID NO: 15066 - DNA, 15 bp, Homo sapiens
ttttcagcatttctt

SEQ ID NO: 15067 - DNA, 15 bp, Homo sapiens
attttcagcatttct

SEQ ID NO: 15068 - DNA, 15 bp, Homo sapiens
cattttcagcatttc

SEQ ID NO: 15069 - DNA, 15 bp, Homo sapiens
gcattttcagcattt

SEQ ID NO: 15070 - DNA, 15 bp, Homo sapiens
ggcattttcagcatt

SEQ ID NO: 15071 - DNA, 15 bp, Homo sapiens
tggcattttcagcat

SEQ ID NO: 15072 - DNA, 15 bp, Homo sapiens
atggcattttcagca

SEQ ID NO: 15073 - DNA, 15 bp, Homo sapiens
gatggcattttcagc

SEQ ID NO: 15074 - DNA, 15 bp, Homo sapiens
cgatggcattttcag

SEQ ID NO: 15075 - DNA, 15 bp, Homo sapiens
tcgatggcattttca

SEQ ID NO: 15076 - DNA, 15 bp, Homo sapiens
ttcgatggcattttc

SEQ ID NO: 15077 - DNA, 15 bp, Homo sapiens
cttcgatggcatttt

SEQ ID NO: 15078 - DNA, 15 bp, Homo sapiens
gcttcgatggcattt

SEQ ID NO: 15079 - DNA, 15 bp, Homo sapiens
ggcttcgatggcatt

SEQ ID NO: 15080 - DNA, 15 bp, Homo sapiens
gggcttcgatggcat

SEQ ID NO: 15081 - DNA, 15 bp, Homo sapiens
agggcttcgatggca

SEQ ID NO: 15082 - DNA, 15 bp, Homo sapiens
aagggcttcgatggc

SEQ ID NO: 15083 - DNA, 15 bp, Homo sapiens
taagggcttcgatgg

SEQ ID NO: 15084 - DNA, 15 bp, Homo sapiens
ttaagggcttcgatg

SEQ ID NO: 15085 - DNA, 15 bp, Homo sapiens
cttaagggcttcgat

SEQ ID NO: 15086 - DNA, 15 bp, Homo sapiens
ccttaagggcttcga

SEQ ID NO: 15087 - DNA, 15 bp, Homo sapiens
tccttaagggcttcg

SEQ ID NO: 15088 - DNA, 15 bp, Homo sapiens
ttccttaagggcttc

SEQ ID NO: 15089 - DNA, 15 bp, Homo sapiens
attccttaagggctt

SEQ ID NO: 15090 - DNA, 15 bp, Homo sapiens
tattccttaagggct

SEQ ID NO: 15091 - DNA, 15 bp, Homo sapiens
atattccttaagggc

SEQ ID NO: 15092 - DNA, 15 bp, Homo sapiens
catattccttaaggg

SEQ ID NO: 15093 - DNA, 15 bp, Homo sapiens
tcatattccttaagg

SEQ ID NO: 15094 - DNA, 15 bp, Homo sapiens
ctcatattccttaag

SEQ ID NO: 15095 - DNA, 15 bp, Homo sapiens
gctcatattccttaa

SEQ ID NO: 15096 - DNA, 15 bp, Homo sapiens
ggctcatattcctta

SEQ ID NO: 15097 - DNA, 15 bp, Homo sapiens
aggctcatattcctt

SEQ ID NO: 15098 - DNA, 15 bp, Homo sapiens
caggctcatattcct

SEQ ID NO: 15099 - DNA, 15 bp, Homo sapiens
tcaggctcatattcc

SEQ ID NO: 15100 - DNA, 15 bp, Homo sapiens
ttcaggctcatattc

SEQ ID NO: 15101 - DNA, 15 bp, Homo sapiens
tttcaggctcatatt

SEQ ID NO: 15102 - DNA, 15 bp, Homo sapiens
atttcaggctcatat

SEQ ID NO: 15103 - DNA, 15 bp, Homo sapiens
catttcaggctcata

SEQ ID NO: 15104 - DNA, 15 bp, Homo sapiens
ccatttcaggctcat

SEQ ID NO: 15105 - DNA, 15 bp, Homo sapiens
cccatttcaggctca

SEQ ID NO: 15106 - DNA, 15 bp, Homo sapiens
gcccatttcaggctc

SEQ ID NO: 15107 - DNA, 15 bp, Homo sapiens
tgcccatttcaggct

SEQ ID NO: 15108 - DNA, 15 bp, Homo sapiens
ttgcccatttcaggc

SEQ ID NO: 15109 - DNA, 15 bp, Homo sapiens
tttgcccatttcagg

SEQ ID NO: 15110 - DNA, 15 bp, Homo sapiens
ctttgcccatttcag

SEQ ID NO: 15111 - DNA, 15 bp, Homo sapiens
actttgcccatttca

SEQ ID NO: 15112 - DNA, 15 bp, Homo sapiens
cactttgcccatttc

SEQ ID NO: 15113 - DNA, 15 bp, Homo sapiens
acactttgcccattt

SEQ ID NO: 15114 - DNA, 15 bp, Homo sapiens
tacactttgcccatt

SEQ ID NO: 15115 - DNA, 15 bp, Homo sapiens
atacactttgcccat

SEQ ID NO: 15116 - DNA, 15 bp, Homo sapiens
gatacactttgccca

SEQ ID NO: 15117 - DNA, 15 bp, Homo sapiens
cgatacactttgccc

SEQ ID NO: 15118 - DNA, 15 bp, Homo sapiens
tcgatacactttgcc

SEQ ID NO: 15119 - DNA, 15 bp, Homo sapiens
gtcgatacactttgc

SEQ ID NO: 15120 - DNA, 15 bp, Homo sapiens
tgtcgatacactttg

SEQ ID NO: 15121 - DNA, 15 bp, Homo sapiens
ctgtcgatacacttt

SEQ ID NO: 15122 - DNA, 15 bp, Homo sapiens
cctgtcgatacactt

SEQ ID NO: 15123 - DNA, 15 bp, Homo sapiens
tcctgtcgatacact

SEQ ID NO: 15124 - DNA, 15 bp, Homo sapiens
gtcctgtcgatacac

SEQ ID NO: 15125 - DNA, 15 bp, Homo sapiens
tgtcctgtcgataca

SEQ ID NO: 15126 - DNA, 15 bp, Homo sapiens
ctgtcctgtcgatac

SEQ ID NO: 15127 - DNA, 15 bp, Homo sapiens
tctgtcctgtcgata

SEQ ID NO: 15128 - DNA, 15 bp, Homo sapiens
ttctgtcctgtcgat

SEQ ID NO: 15129 - DNA, 15 bp, Homo sapiens
tttctgtcctgtcga

SEQ ID NO: 15130 - DNA, 15 bp, Homo sapiens
ctttctgtcctgtcg

SEQ ID NO: 15131 - DNA, 15 bp, Homo sapiens
tctttctgtcctgtc

SEQ ID NO: 15132 - DNA, 15 bp, Homo sapiens
ctctttctgtcctgt

SEQ ID NO: 15133 - DNA, 15 bp, Homo sapiens
actctttctgtcctg

SEQ ID NO: 15134 - DNA, 15 bp, Homo sapiens
cactctttctgtcct

SEQ ID NO: 15135 - DNA, 15 bp, Homo sapiens
acactctttctgtcc

SEQ ID NO: 15136 - DNA, 15 bp, Homo sapiens
cacactctttctgtc

SEQ ID NO: 15137 - DNA, 15 bp, Homo sapiens
gcacactctttctgt

SEQ ID NO: 15138 - DNA, 15 bp, Homo sapiens
tgcacactctttctg

SEQ ID NO: 15139 - DNA, 15 bp, Homo sapiens
ctgcacactctttct

SEQ ID NO: 15140 - DNA, 15 bp, Homo sapiens
gctgcacactctttc

SEQ ID NO: 15141 - DNA, 15 bp, Homo sapiens
cgctgcacactcttt

SEQ ID NO: 15142 - DNA, 15 bp, Homo sapiens
ccgctgcacactctt

SEQ ID NO: 15143 - DNA, 15 bp, Homo sapiens
tccgctgcacactct

SEQ ID NO: 15144 - DNA, 15 bp, Homo sapiens
atccgctgcacactc

SEQ ID NO: 15145 - DNA, 15 bp, Homo sapiens
aatccgctgcacact

SEQ ID NO: 15146 - DNA, 15 bp, Homo sapiens
taatccgctgcacac

SEQ ID NO: 15147 - DNA, 15 bp, Homo sapiens
ttaatccgctgcaca

SEQ ID NO: 15148 - DNA, 15 bp, Homo sapiens
tttaatccgctgcac

SEQ ID NO: 15149 - DNA, 15 bp, Homo sapiens
ctttaatccgctgca

SEQ ID NO: 15150 - DNA, 15 bp, Homo sapiens
gctttaatccgctgc

SEQ ID NO: 15151 - DNA, 15 bp, Homo sapiens
agctttaatccgctg

SEQ ID NO: 15152 - DNA, 15 bp, Homo sapiens
tagctttaatccgct

SEQ ID NO: 15153 - DNA, 15 bp, Homo sapiens
ttagctttaatccgc

SEQ ID NO: 15154 - DNA, 15 bp, Homo sapiens
tttagctttaatccg

SEQ ID NO: 15155 - DNA, 15 bp, Homo sapiens
ctttagctttaatcc

SEQ ID NO: 15156 - DNA, 15 bp, Homo sapiens
tctttagctttaatc

SEQ ID NO: 15157 - DNA, 15 bp, Homo sapiens
gtctttagctttaat

SEQ ID NO: 15158 - DNA, 15 bp, Homo sapiens
tgtctttagctttaa

SEQ ID NO: 15159 - DNA, 15 bp, Homo sapiens
atgtctttagcttta

SEQ ID NO: 15160 - DNA, 15 bp, Homo sapiens
tatgtctttagcttt

SEQ ID NO: 15161 - DNA, 15 bp, Homo sapiens
ctatgtctttagctt

SEQ ID NO: 15162 - DNA, 15 bp, Homo sapiens
actatgtctttagct

SEQ ID NO: 15163 - DNA, 15 bp, Homo sapiens
aactatgtctttagc

SEQ ID NO: 15164 - DNA, 15 bp, Homo sapiens
gaactatgtctttag

SEQ ID NO: 15165 - DNA, 15 bp, Homo sapiens
ggaactatgtcttta

SEQ ID NO: 15166 - DNA, 15 bp, Homo sapiens
aggaactatgtcttt

SEQ ID NO: 15167 - DNA, 15 bp, Homo sapiens
caggaactatgtctt

SEQ ID NO: 15168 - DNA, 15 bp, Homo sapiens
ccaggaactatgtct

SEQ ID NO: 15169 - DNA, 15 bp, Homo sapiens
accaggaactatgtc

SEQ ID NO: 15170 - DNA, 15 bp, Homo sapiens
caccaggaactatgt

SEQ ID NO: 15171 - DNA, 15 bp, Homo sapiens
tcaccaggaactatg

SEQ ID NO: 15172 - DNA, 15 bp, Homo sapiens
atcaccaggaactat

SEQ ID NO: 15173 - DNA, 15 bp, Homo sapiens
tatcaccaggaacta

SEQ ID NO: 15174 - DNA, 15 bp, Homo sapiens
atatcaccaggaact

SEQ ID NO: 15175 - DNA, 15 bp, Homo sapiens
aatatcaccaggaac

SEQ ID NO: 15176 - DNA, 15 bp, Homo sapiens
caatatcaccaggaa

SEQ ID NO: 15177 - DNA, 15 bp, Homo sapiens
acaatatcaccagga

SEQ ID NO: 15178 - DNA, 15 bp, Homo sapiens
tacaatatcaccagg

SEQ ID NO: 15179 - DNA, 15 bp, Homo sapiens
ctacaatatcaccag

SEQ ID NO: 15180 - DNA, 15 bp, Homo sapiens
tctacaatatcacca

SEQ ID NO: 15181 - DNA, 15 bp, Homo sapiens
ttctacaatatcacc

SEQ ID NO: 15182 - DNA, 15 bp, Homo sapiens
tttctacaatatcac

SEQ ID NO: 15183 - DNA, 15 bp, Homo sapiens
atttctacaatatca

SEQ ID NO: 15184 - DNA, 15 bp, Homo sapiens
aatttctacaatatc

SEQ ID NO: 15185 - DNA, 15 bp, Homo sapiens
caatttctacaatat

SEQ ID NO: 15186 - DNA, 15 bp, Homo sapiens
gcaatttctacaata

SEQ ID NO: 15187 - DNA, 15 bp, Homo sapiens
agcaatttctacaat

SEQ ID NO: 15188 - DNA, 15 bp, Homo sapiens
cagcaatttctacaa

SEQ ID NO: 15189 - DNA, 15 bp, Homo sapiens
ccagcaatttctaca

SEQ ID NO: 15190 - DNA, 15 bp, Homo sapiens
accagcaatttctac

SEQ ID NO: 15191 - DNA, 15 bp, Homo sapiens
caccagcaatttcta

SEQ ID NO: 15192 - DNA, 15 bp, Homo sapiens
tcaccagcaatttct

SEQ ID NO: 15193 - DNA, 15 bp, Homo sapiens
ctcaccagcaatttc

SEQ ID NO: 15194 - DNA, 15 bp, Homo sapiens
actcaccagcaattt

SEQ ID NO: 15195 - DNA, 15 bp, Homo sapiens
aactcaccagcaatt

SEQ ID NO: 15196 - DNA, 15 bp, Homo sapiens
caactcaccagcaat

SEQ ID NO: 15197 - DNA, 15 bp, Homo sapiens
tcaactcaccagcaa

SEQ ID NO: 15198 - DNA, 15 bp, Homo sapiens
ctcaactcaccagca

SEQ ID NO: 15199 - DNA, 15 bp, Homo sapiens
actcaactcaccagc

SEQ ID NO: 15200 - DNA, 15 bp, Homo sapiens
aactcaactcaccag

SEQ ID NO: 15201 - DNA, 15 bp, Homo sapiens
aaactcaactcacca

SEQ ID NO: 15202 - DNA, 15 bp, Homo sapiens
caaactcaactcacc

SEQ ID NO: 15203 - DNA, 15 bp, Homo sapiens
acaaactcaactcac

SEQ ID NO: 15204 - DNA, 15 bp, Homo sapiens
gacaaactcaactca

SEQ ID NO: 15205 - DNA, 15 bp, Homo sapiens
tgacaaactcaactc

SEQ ID NO: 15206 - DNA, 15 bp, Homo sapiens
atgacaaactcaact

SEQ ID NO: 15207 - DNA, 15 bp, Homo sapiens
aatgacaaactcaac

SEQ ID NO: 15208 - DNA, 15 bp, Homo sapiens
aaatgacaaactcaa

SEQ ID NO: 15209 - DNA, 15 bp, Homo sapiens
aaaatgacaaactca

SEQ ID NO: 15210 - DNA, 15 bp, Homo sapiens
aaaaatgacaaactc

SEQ ID NO: 15211 - DNA, 15 bp, Homo sapiens
gaaaaatgacaaact

SEQ ID NO: 15212 - DNA, 15 bp, Homo sapiens
agaaaaatgacaaac

SEQ ID NO: 15213 - DNA, 15 bp, Homo sapiens
aagaaaaatgacaaa

SEQ ID NO: 15214 - DNA, 15 bp, Homo sapiens
aaagaaaaatgacaa

SEQ ID NO: 15215 - DNA, 15 bp, Homo sapiens
aaaagaaaaatgaca

SEQ ID NO: 15216 - DNA, 15 bp, Homo sapiens
taaaagaaaaatgac

SEQ ID NO: 15217 - DNA, 15 bp, Homo sapiens
ataaaagaaaaatga

SEQ ID NO: 15218 - DNA, 15 bp, Homo sapiens
aataaaagaaaaatg

SEQ ID NO: 15219 - DNA, 15 bp, Homo sapiens
gaataaaagaaaaat

SEQ ID NO: 15220 - DNA, 15 bp, Homo sapiens
agaataaaagaaaaa

SEQ ID NO: 15221 - DNA, 15 bp, Homo sapiens
tagaataaaagaaaa

SEQ ID NO: 15222 - DNA, 15 bp, Homo sapiens
ctagaataaaagaaa

SEQ ID NO: 15223 - DNA, 15 bp, Homo sapiens
tctagaataaaagaa

SEQ ID NO: 15224 - DNA, 15 bp, Homo sapiens
atctagaataaaaga

SEQ ID NO: 15225 - DNA, 15 bp, Homo sapiens
tatctagaataaaag

SEQ ID NO: 15226 - DNA, 15 bp, Homo sapiens
ctatctagaataaaa

SEQ ID NO: 15227 - DNA, 15 bp, Homo sapiens
actatctagaataaa

SEQ ID NO: 15228 - DNA, 15 bp, Homo sapiens
tactatctagaataa

SEQ ID NO: 15229 - DNA, 15 bp, Homo sapiens
atactatctagaata

SEQ ID NO: 15230 - DNA, 15 bp, Homo sapiens
aatactatctagaat

SEQ ID NO: 15231 - DNA, 15 bp, Homo sapiens
aaatactatctagaa

SEQ ID NO: 15232 - DNA, 15 bp, Homo sapiens
gaaatactatctaga

SEQ ID NO: 15233 - DNA, 15 bp, Homo sapiens
agaaatactatctag

SEQ ID NO: 15234 - DNA, 15 bp, Homo sapiens
cagaaatactatcta

SEQ ID NO: 15235 - DNA, 15 bp, Homo sapiens
tcagaaatactatct

SEQ ID NO: 15236 - DNA, 15 bp, Homo sapiens
ttcagaaatactatc

SEQ ID NO: 15237 - DNA, 15 bp, Homo sapiens
attcagaaatactat

SEQ ID NO: 15238 - DNA, 15 bp, Homo sapiens
cattcagaaatacta

SEQ ID NO: 15239 - DNA, 15 bp, Homo sapiens
acattcagaaatact

SEQ ID NO: 15240 - DNA, 15 bp, Homo sapiens
tacattcagaaatac

SEQ ID NO: 15241 - DNA, 15 bp, Homo sapiens
ctacattcagaaata

SEQ ID NO: 15242 - DNA, 15 bp, Homo sapiens
actacattcagaaat

SEQ ID NO: 15243 - DNA, 15 bp, Homo sapiens
gactacattcagaaa

SEQ ID NO: 15244 - DNA, 15 bp, Homo sapiens
ggactacattcagaa

SEQ ID NO: 15245 - DNA, 15 bp, Homo sapiens
aggactacattcaga

SEQ ID NO: 15246 - DNA, 15 bp, Homo sapiens
aaggactacattcag

SEQ ID NO: 15247 - DNA, 15 bp, Homo sapiens
aaaggactacattca

SEQ ID NO: 15248 - DNA, 15 bp, Homo sapiens
aaaaggactacattc

SEQ ID NO: 15249 - DNA, 15 bp, Homo sapiens
gaaaaggactacatt

SEQ ID NO: 15250 - DNA, 15 bp, Homo sapiens
agaaaaggactacat

SEQ ID NO: 15251 - DNA, 15 bp, Homo sapiens
gagaaaaggactaca

SEQ ID NO: 15252 - DNA, 15 bp, Homo sapiens
tgagaaaaggactac

SEQ ID NO: 15253 - DNA, 15 bp, Homo sapiens
ttgagaaaaggacta

SEQ ID NO: 15254 - DNA, 15 bp, Homo sapiens
cttgagaaaaggact

SEQ ID NO: 15255 - DNA, 15 bp, Homo sapiens
ccttgagaaaaggac

SEQ ID NO: 15256 - DNA, 15 bp, Homo sapiens
gccttgagaaaagga

SEQ ID NO: 15257 - DNA, 15 bp, Homo sapiens
agccttgagaaaagg

SEQ ID NO: 15258 - DNA, 15 bp, Homo sapiens
gagccttgagaaaag

SEQ ID NO: 15259 - DNA, 15 bp, Homo sapiens
tgagccttgagaaaa

SEQ ID NO: 15260 - DNA, 15 bp, Homo sapiens
atgagccttgagaaa

SEQ ID NO: 15261 - DNA, 15 bp, Homo sapiens
tatgagccttgagaa

SEQ ID NO: 15262 - DNA, 15 bp, Homo sapiens
ttatgagccttgaga

SEQ ID NO: 15263 - DNA, 15 bp, Homo sapiens
attatgagccttgag

SEQ ID NO: 15264 - DNA, 15 bp, Homo sapiens
aattatgagccttga

SEQ ID NO: 15265 - DNA, 15 bp, Homo sapiens
taattatgagccttg

SEQ ID NO: 15266 - DNA, 15 bp, Homo sapiens
ataattatgagcctt

SEQ ID NO: 15267 - DNA, 15 bp, Homo sapiens
tataattatgagcct

SEQ ID NO: 15268 - DNA, 15 bp, Homo sapiens
atataattatgagcc

SEQ ID NO: 15269 - DNA, 15 bp, Homo sapiens
aatataattatgagc

SEQ ID NO: 15270 - DNA, 15 bp, Homo sapiens
aaatataattatgag

SEQ ID NO: 15271 - DNA, 15 bp, Homo sapiens
taaatataattatga

SEQ ID NO: 15272 - DNA, 15 bp, Homo sapiens
ttaaatataattatg

SEQ ID NO: 15273 - DNA, 15 bp, Homo sapiens
tttaaatataattat

SEQ ID NO: 15274 - DNA, 15 bp, Homo sapiens
ttttaaatataatta

SEQ ID NO: 15275 - DNA, 15 bp, Homo sapiens
attttaaatataatt

SEQ ID NO: 15276 - DNA, 15 bp, Homo sapiens
tattttaaatataat

SEQ ID NO: 15277 - DNA, 15 bp, Homo sapiens
ttattttaaatataa

SEQ ID NO: 15278 - DNA, 15 bp, Homo sapiens
attattttaaatata

SEQ ID NO: 15279 - DNA, 15 bp, Homo sapiens
aattattttaaatat

SEQ ID NO: 15280 - DNA, 15 bp, Homo sapiens
caattattttaaata

SEQ ID NO: 15281 - DNA, 15 bp, Homo sapiens
acaattattttaaat

SEQ ID NO: 15282 - DNA, 15 bp, Homo sapiens
aacaattattttaaa

SEQ ID NO: 15283 - DNA, 15 bp, Homo sapiens
aaacaattattttaa

SEQ ID NO: 15284 - DNA, 15 bp, Homo sapiens
aaaacaattatttta

SEQ ID NO: 15285 - DNA, 15 bp, Homo sapiens
gaaaacaattatttt

SEQ ID NO: 15286 - DNA, 15 bp, Homo sapiens
tgaaaacaattattt

SEQ ID NO: 15287 - DNA, 15 bp, Homo sapiens
atgaaaacaattatt

SEQ ID NO: 15288 - DNA, 15 bp, Homo sapiens
catgaaaacaattat

SEQ ID NO: 15289 - DNA, 15 bp, Homo sapiens
acatgaaaacaatta

SEQ ID NO: 15290 - DNA, 15 bp, Homo sapiens
tacatgaaaacaatt

SEQ ID NO: 15291 - DNA, 15 bp, Homo sapiens
atacatgaaaacaat

SEQ ID NO: 15292 - DNA, 15 bp, Homo sapiens
gatacatgaaaacaa

SEQ ID NO: 15293 - DNA, 15 bp, Homo sapiens
tgatacatgaaaaca

SEQ ID NO: 15294 - DNA, 15 bp, Homo sapiens
ttgatacatgaaaac

SEQ ID NO: 15295 - DNA, 15 bp, Homo sapiens
attgatacatgaaaa

SEQ ID NO: 15296 - DNA, 15 bp, Homo sapiens
aattgatacatgaaa

SEQ ID NO: 15297 - DNA, 15 bp, Homo sapiens
taattgatacatgaa

SEQ ID NO: 15298 - DNA, 15 bp, Homo sapiens
ttaattgatacatga

SEQ ID NO: 15299 - DNA, 15 bp, Homo sapiens
gttaattgatacatg

SEQ ID NO: 15300 - DNA, 15 bp, Homo sapiens
tgttaattgatacat

SEQ ID NO: 15301 - DNA, 15 bp, Homo sapiens
gtgttaattgataca

SEQ ID NO: 15302 - DNA, 15 bp, Homo sapiens
tgtgttaattgatac

SEQ ID NO: 15303 - DNA, 15 bp, Homo sapiens
atgtgttaattgata

SEQ ID NO: 15304 - DNA, 15 bp, Homo sapiens
aatgtgttaattgat

SEQ ID NO: 15305 - DNA, 15 bp, Homo sapiens
aaatgtgttaattga

SEQ ID NO: 15306 - DNA, 15 bp, Homo sapiens
aaaatgtgttaattg

SEQ ID NO: 15307 - DNA, 15 bp, Homo sapiens
taaaatgtgttaatt

SEQ ID NO: 15308 - DNA, 15 bp, Homo sapiens
ataaaatgtgttaat

SEQ ID NO: 15309 - DNA, 15 bp, Homo sapiens
aataaaatgtgttaa

SEQ ID NO: 15310 - DNA, 15 bp, Homo sapiens
caataaaatgtgtta

SEQ ID NO: 15311 - DNA, 15 bp, Homo sapiens
gcaataaaatgtgtt

SEQ ID NO: 15312 - DNA, 15 bp, Homo sapiens
ggcaataaaatgtgt

SEQ ID NO: 15313 - DNA, 15 bp, Homo sapiens
tggcaataaaatgtg

SEQ ID NO: 15314 - DNA, 15 bp, Homo sapiens
atggcaataaaatgt

SEQ ID NO: 15315 - DNA, 15 bp, Homo sapiens
aatggcaataaaatg

SEQ ID NO: 15316 - DNA, 15 bp, Homo sapiens
gaatggcaataaaat

SEQ ID NO: 15317 - DNA, 15 bp, Homo sapiens
tgaatggcaataaaa

SEQ ID NO: 15318 - DNA, 15 bp, Homo sapiens
atgaatggcaataaa

SEQ ID NO: 15319 - DNA, 15 bp, Homo sapiens
tatgaatggcaataa

SEQ ID NO: 15320 - DNA, 15 bp, Homo sapiens
gtatgaatggcaata

SEQ ID NO: 15321 - DNA, 15 bp, Homo sapiens
tgtatgaatggcaat

SEQ ID NO: 15322 - DNA, 15 bp, Homo sapiens
ttgtatgaatggcaa

SEQ ID NO: 15323 - DNA, 15 bp, Homo sapiens
tttgtatgaatggca

SEQ ID NO: 15324 - DNA, 15 bp, Homo sapiens
atttgtatgaatggc

SEQ ID NO: 15325 - DNA, 15 bp, Homo sapiens
gatttgtatgaatgg

SEQ ID NO: 15326 - DNA, 15 bp, Homo sapiens
ggatttgtatgaatg

SEQ ID NO: 15327 - DNA, 15 bp, Homo sapiens
aggatttgtatgaat

SEQ ID NO: 15328 - DNA, 15 bp, Homo sapiens
taggatttgtatgaa

SEQ ID NO: 15329 - DNA, 15 bp, Homo sapiens
gtaggatttgtatga

SEQ ID NO: 15330 - DNA, 15 bp, Homo sapiens
tgtaggatttgtatg

SEQ ID NO: 15331 - DNA, 15 bp, Homo sapiens
atgtaggatttgtat

SEQ ID NO: 15332 - DNA, 15 bp, Homo sapiens
aatgtaggatttgta

SEQ ID NO: 15333 - DNA, 15 bp, Homo sapiens
gaatgtaggatttgt

SEQ ID NO: 15334 - DNA, 15 bp, Homo sapiens
agaatgtaggatttg

SEQ ID NO: 15335 - DNA, 15 bp, Homo sapiens
gagaatgtaggattt

SEQ ID NO: 15336 - DNA, 15 bp, Homo sapiens
agagaatgtaggatt

SEQ ID NO: 15337 - DNA, 15 bp, Homo sapiens
tagagaatgtaggat

SEQ ID NO: 15338 - DNA, 15 bp, Homo sapiens
ttagagaatgtagga

SEQ ID NO: 15339 - DNA, 15 bp, Homo sapiens
tttagagaatgtagg

SEQ ID NO: 15340 - DNA, 15 bp, Homo sapiens
ttttagagaatgtag

SEQ ID NO: 15341 - DNA, 15 bp, Homo sapiens
attttagagaatgta

SEQ ID NO: 15342 - DNA, 15 bp, Homo sapiens
aattttagagaatgt

SEQ ID NO: 15343 - DNA, 15 bp, Homo sapiens
taattttagagaatg

SEQ ID NO: 15344 - DNA, 15 bp, Homo sapiens
ataattttagagaat

SEQ ID NO: 15345 - DNA, 15 bp, Homo sapiens
aataattttagagaa

SEQ ID NO: 15346 - DNA, 15 bp, Homo sapiens
aaataattttagaga

SEQ ID NO: 15347 - DNA, 15 bp, Homo sapiens
aaaataattttagag

SEQ ID NO: 15348 - DNA, 15 bp, Homo sapiens
caaaataattttaga

SEQ ID NO: 15349 - DNA, 15 bp, Homo sapiens
tcaaaataattttag

SEQ ID NO: 15350 - DNA, 15 bp, Homo sapiens
ttcaaaataatttta

SEQ ID NO: 15351 - DNA, 15 bp, Homo sapiens
tttcaaaataatttt

SEQ ID NO: 15352 - DNA, 15 bp, Homo sapiens
atttcaaaataattt

SEQ ID NO: 15353 - DNA, 15 bp, Homo sapiens
catttcaaaataatt

SEQ ID NO: 15354 - DNA, 15 bp, Homo sapiens
acatttcaaaataat

SEQ ID NO: 15355 - DNA, 15 bp, Homo sapiens
aacatttcaaaataa

SEQ ID NO: 15356 - DNA, 15 bp, Homo sapiens
aaacatttcaaaata

SEQ ID NO: 15357 - DNA, 15 bp, Homo sapiens
aaaacatttcaaaat

SEQ ID NO: 15358 - DNA, 15 bp, Homo sapiens
taaaacatttcaaaa

SEQ ID NO: 15359 - DNA, 15 bp, Homo sapiens
ctaaaacatttcaaa

SEQ ID NO: 15360 - DNA, 15 bp, Homo sapiens
gctaaaacatttcaa

SEQ ID NO: 15361 - DNA, 15 bp, Homo sapiens
tgctaaaacatttca

SEQ ID NO: 15362 - DNA, 15 bp, Homo sapiens
gtgctaaaacatttc

SEQ ID NO: 15363 - DNA, 15 bp, Homo sapiens
ggtgctaaaacattt

SEQ ID NO: 15364 - DNA, 15 bp, Homo sapiens
aggtgctaaaacatt

SEQ ID NO: 15365 - DNA, 15 bp, Homo sapiens
gaggtgctaaaacat

SEQ ID NO: 15366 - DNA, 15 bp, Homo sapiens
ggaggtgctaaaaca

SEQ ID NO: 15367 - DNA, 15 bp, Homo sapiens
gggaggtgctaaaac

SEQ ID NO: 15368 - DNA, 15 bp, Homo sapiens
agggaggtgctaaaa

SEQ ID NO: 15369 - DNA, 15 bp, Homo sapiens
aagggaggtgctaaa

SEQ ID NO: 15370 - DNA, 15 bp, Homo sapiens
gaagggaggtgctaa

SEQ ID NO: 15371 - DNA, 15 bp, Homo sapiens
ggaagggaggtgcta

SEQ ID NO: 15372 - DNA, 15 bp, Homo sapiens
aggaagggaggtgct

SEQ ID NO: 15373 - DNA, 15 bp, Homo sapiens
caggaagggaggtgc

SEQ ID NO: 15374 - DNA, 15 bp, Homo sapiens
acaggaagggaggtg

SEQ ID NO: 15375 - DNA, 15 bp, Homo sapiens
gacaggaagggaggt

SEQ ID NO: 15376 - DNA, 15 bp, Homo sapiens
tgacaggaagggagg

SEQ ID NO: 15377 - DNA, 15 bp, Homo sapiens
atgacaggaagggag

SEQ ID NO: 15378 - DNA, 15 bp, Homo sapiens
aatgacaggaaggga

SEQ ID NO: 15379 - DNA, 15 bp, Homo sapiens
caatgacaggaaggg

SEQ ID NO: 15380 - DNA, 15 bp, Homo sapiens
tcaatgacaggaagg

SEQ ID NO: 15381 - DNA, 15 bp, Homo sapiens
atcaatgacaggaag

SEQ ID NO: 15382 - DNA, 15 bp, Homo sapiens
tatcaatgacaggaa

SEQ ID NO: 15383 - DNA, 15 bp, Homo sapiens
ttatcaatgacagga

SEQ ID NO: 15384 - DNA, 15 bp, Homo sapiens
cttatcaatgacagg

SEQ ID NO: 15385 - DNA, 15 bp, Homo sapiens
ccttatcaatgacag

SEQ ID NO: 15386 - DNA, 15 bp, Homo sapiens
gccttatcaatgaca

SEQ ID NO: 15387 - DNA, 15 bp, Homo sapiens
agccttatcaatgac

SEQ ID NO: 15388 - DNA, 15 bp, Homo sapiens
aagccttatcaatga

SEQ ID NO: 15389 - DNA, 15 bp, Homo sapiens
aaagccttatcaatg

SEQ ID NO: 15390 - DNA, 15 bp, Homo sapiens
aaaagccttatcaat

SEQ ID NO: 15391 - DNA, 15 bp, Homo sapiens
caaaagccttatcaa

SEQ ID NO: 15392 - DNA, 15 bp, Homo sapiens
ccaaaagccttatca

SEQ ID NO: 15393 - DNA, 15 bp, Homo sapiens
accaaaagccttatc

SEQ ID NO: 15394 - DNA, 15 bp, Homo sapiens
aaccaaaagccttat

SEQ ID NO: 15395 - DNA, 15 bp, Homo sapiens
aaaccaaaagcctta

SEQ ID NO: 15396 - DNA, 15 bp, Homo sapiens
aaaaccaaaagcctt

SEQ ID NO: 15397 - DNA, 15 bp, Homo sapiens
aaaaaccaaaagcct

SEQ ID NO: 15398 - DNA, 15 bp, Homo sapiens
caaaaaccaaaagcc

SEQ ID NO: 15399 - DNA, 15 bp, Homo sapiens
acaaaaaccaaaagc

SEQ ID NO: 15400 - DNA, 15 bp, Homo sapiens
aacaaaaaccaaaag

SEQ ID NO: 15401 - DNA, 15 bp, Homo sapiens
aaacaaaaaccaaaa

SEQ ID NO: 15402 - DNA, 15 bp, Homo sapiens
aaaacaaaaaccaaa

SEQ ID NO: 15403 - DNA, 15 bp, Homo sapiens
aaaaacaaaaaccaa

SEQ ID NO: 15404 - DNA, 15 bp, Homo sapiens
taaaaacaaaaacca

SEQ ID NO: 15405 - DNA, 15 bp, Homo sapiens
ttaaaaacaaaaacc

SEQ ID NO: 15406 - DNA, 15 bp, Homo sapiens
tttaaaaacaaaaac

SEQ ID NO: 15407 - DNA, 15 bp, Homo sapiens
gtttaaaaacaaaaa

SEQ ID NO: 15408 - DNA, 15 bp, Homo sapiens
tgtttaaaaacaaaa

SEQ ID NO: 15409 - DNA, 15 bp, Homo sapiens
ttgtttaaaaacaaa

SEQ ID NO: 15410 - DNA, 15 bp, Homo sapiens
cttgtttaaaaacaa

SEQ ID NO: 15411 - DNA, 15 bp, Homo sapiens
ccttgtttaaaaaca

SEQ ID NO: 15412 - DNA, 15 bp, Homo sapiens
accttgtttaaaaac

SEQ ID NO: 15413 - DNA, 15 bp, Homo sapiens
taccttgtttaaaaa

SEQ ID NO: 15414 - DNA, 15 bp, Homo sapiens
ataccttgtttaaaa

SEQ ID NO: 15415 - DNA, 15 bp, Homo sapiens
aataccttgtttaaa

SEQ ID NO: 15416 - DNA, 15 bp, Homo sapiens
aaataccttgtttaa

SEQ ID NO: 15417 - DNA, 15 bp, Homo sapiens
aaaataccttgttta

SEQ ID NO: 15418 - DNA, 15 bp, Homo sapiens
caaaataccttgttt

SEQ ID NO: 15419 - DNA, 15 bp, Homo sapiens
tcaaaataccttgtt

SEQ ID NO: 15420 - DNA, 15 bp, Homo sapiens
ttcaaaataccttgt

SEQ ID NO: 15421 - DNA, 15 bp, Homo sapiens
attcaaaataccttg

SEQ ID NO: 15422 - DNA, 15 bp, Homo sapiens
aattcaaaatacctt

SEQ ID NO: 15423 - DNA, 15 bp, Homo sapiens
gaattcaaaatacct

SEQ ID NO: 15424 - DNA, 15 bp, Homo sapiens
agaattcaaaatacc

SEQ ID NO: 15425 - DNA, 15 bp, Homo sapiens
tagaattcaaaatac

SEQ ID NO: 15426 - DNA, 15 bp, Homo sapiens
gtagaattcaaaata

SEQ ID NO: 15427 - DNA, 15 bp, Homo sapiens
agtagaattcaaaat

SEQ ID NO: 15428 - DNA, 15 bp, Homo sapiens
aagtagaattcaaaa

SEQ ID NO: 15429 - DNA, 15 bp, Homo sapiens
caagtagaattcaaa

SEQ ID NO: 15430 - DNA, 15 bp, Homo sapiens
acaagtagaattcaa

SEQ ID NO: 15431 - DNA, 15 bp, Homo sapiens
aacaagtagaattca

SEQ ID NO: 15432 - DNA, 15 bp, Homo sapiens
aaacaagtagaattc

SEQ ID NO: 15433 - DNA, 15 bp, Homo sapiens
taaacaagtagaatt

SEQ ID NO: 15434 - DNA, 15 bp, Homo sapiens
ttaaacaagtagaat

SEQ ID NO: 15435 - DNA, 15 bp, Homo sapiens
tttaaacaagtagaa

SEQ ID NO: 15436 - DNA, 15 bp, Homo sapiens
atttaaacaagtaga

SEQ ID NO: 15437 - DNA, 15 bp, Homo sapiens
tatttaaacaagtag

SEQ ID NO: 15438 - DNA, 15 bp, Homo sapiens
gtatttaaacaagta

SEQ ID NO: 15439 - DNA, 15 bp, Homo sapiens
tgtatttaaacaagt

SEQ ID NO: 15440 - DNA, 15 bp, Homo sapiens
atgtatttaaacaag

SEQ ID NO: 15441 - DNA, 15 bp, Homo sapiens
aatgtatttaaacaa

SEQ ID NO: 15442 - DNA, 15 bp, Homo sapiens
caatgtatttaaaca

SEQ ID NO: 15443 - DNA, 15 bp, Homo sapiens
acaatgtatttaaac

SEQ ID NO: 15444 - DNA, 15 bp, Homo sapiens
tacaatgtatttaaa

SEQ ID NO: 15445 - DNA, 15 bp, Homo sapiens
ctacaatgtatttaa

SEQ ID NO: 15446 - DNA, 15 bp, Homo sapiens
tctacaatgtattta

SEQ ID NO: 15447 - DNA, 15 bp, Homo sapiens
ttctacaatgtattt

SEQ ID NO: 15448 - DNA, 15 bp, Homo sapiens
gttctacaatgtatt

SEQ ID NO: 15449 - DNA, 15 bp, Homo sapiens
tgttctacaatgtat

SEQ ID NO: 15450 - DNA, 15 bp, Homo sapiens
gtgttctacaatgta

SEQ ID NO: 15451 - DNA, 15 bp, Homo sapiens
tgtgttctacaatgt

SEQ ID NO: 15452 - DNA, 15 bp, Homo sapiens
ttgtgttctacaatg

SEQ ID NO: 15453 - DNA, 15 bp, Homo sapiens
cttgtgttctacaat

SEQ ID NO: 15454 - DNA, 15 bp, Homo sapiens
acttgtgttctacaa

SEQ ID NO: 15455 - DNA, 15 bp, Homo sapiens
cacttgtgttctaca

SEQ ID NO: 15456 - DNA, 15 bp, Homo sapiens
gcacttgtgttctac

SEQ ID NO: 15457 - DNA, 15 bp, Homo sapiens
agcacttgtgttcta

SEQ ID NO: 15458 - DNA, 15 bp, Homo sapiens
tagcacttgtgttct

SEQ ID NO: 15459 - DNA, 15 bp, Homo sapiens
ctagcacttgtgttc

SEQ ID NO: 15460 - DNA, 15 bp, Homo sapiens
tctagcacttgtgtt

SEQ ID NO: 15461 - DNA, 15 bp, Homo sapiens
ctctagcacttgtgt

SEQ ID NO: 15462 - DNA, 15 bp, Homo sapiens
tctctagcacttgtg

SEQ ID NO: 15463 - DNA, 15 bp, Homo sapiens
ctctctagcacttgt

SEQ ID NO: 15464 - DNA, 15 bp, Homo sapiens
cctctctagcacttg

SEQ ID NO: 15465 - DNA, 15 bp, Homo sapiens
acctctctagcactt

SEQ ID NO: 15466 - DNA, 15 bp, Homo sapiens
tacctctctagcact

SEQ ID NO: 15467 - DNA, 15 bp, Homo sapiens
ttacctctctagcac

SEQ ID NO: 15468 - DNA, 15 bp, Homo sapiens
tttacctctctagca

SEQ ID NO: 15469 - DNA, 15 bp, Homo sapiens
ttttacctctctagc

SEQ ID NO: 15470 - DNA, 15 bp, Homo sapiens
gttttacctctctag

SEQ ID NO: 15471 - DNA, 15 bp, Homo sapiens
ggttttacctctcta

SEQ ID NO: 15472 - DNA, 15 bp, Homo sapiens
aggttttacctctct

SEQ ID NO: 15473 - DNA, 15 bp, Homo sapiens
taggttttacctctc

SEQ ID NO: 15474 - DNA, 15 bp, Homo sapiens
ttaggttttacctct

SEQ ID NO: 15475 - DNA, 15 bp, Homo sapiens
attaggttttacctc

SEQ ID NO: 15476 - DNA, 15 bp, Homo sapiens
cattaggttttacct

SEQ ID NO: 15477 - DNA, 15 bp, Homo sapiens
acattaggttttacc

SEQ ID NO: 15478 - DNA, 15 bp, Homo sapiens
aacattaggttttac

SEQ ID NO: 15479 - DNA, 15 bp, Homo sapiens
caacattaggtttta

SEQ ID NO: 15480 - DNA, 15 bp, Homo sapiens
tcaacattaggtttt

SEQ ID NO: 15481 - DNA, 15 bp, Homo sapiens
atcaacattaggttt

SEQ ID NO: 15482 - DNA, 15 bp, Homo sapiens
aatcaacattaggtt

SEQ ID NO: 15483 - DNA, 15 bp, Homo sapiens
aaatcaacattaggt

SEQ ID NO: 15484 - DNA, 15 bp, Homo sapiens
caaatcaacattagg

SEQ ID NO: 15485 - DNA, 15 bp, Homo sapiens
tcaaatcaacattag

SEQ ID NO: 15486 - DNA, 15 bp, Homo sapiens
gtcaaatcaacatta

SEQ ID NO: 15487 - DNA, 15 bp, Homo sapiens
tgtcaaatcaacatt

SEQ ID NO: 15488 - DNA, 15 bp, Homo sapiens
ctgtcaaatcaacat

SEQ ID NO: 15489 - DNA, 15 bp, Homo sapiens
actgtcaaatcaaca

SEQ ID NO: 15490 - DNA, 15 bp, Homo sapiens
aactgtcaaatcaac

SEQ ID NO: 15491 - DNA, 15 bp, Homo sapiens
taactgtcaaatcaa

SEQ ID NO: 15492 - DNA, 15 bp, Homo sapiens
ctaactgtcaaatca

SEQ ID NO: 15493 - DNA, 15 bp, Homo sapiens
actaactgtcaaatc

SEQ ID NO: 15494 - DNA, 15 bp, Homo sapiens
aactaactgtcaaat

SEQ ID NO: 15495 - DNA, 15 bp, Homo sapiens
taactaactgtcaaa

SEQ ID NO: 15496 - DNA, 15 bp, Homo sapiens
ataactaactgtcaa

SEQ ID NO: 15497 - DNA, 15 bp, Homo sapiens
tataactaactgtca

SEQ ID NO: 15498 - DNA, 15 bp, Homo sapiens
ctataactaactgtc

SEQ ID NO: 15499 - DNA, 15 bp, Homo sapiens
actataactaactgt

SEQ ID NO: 15500 - DNA, 15 bp, Homo sapiens
cactataactaactg

SEQ ID NO: 15501 - DNA, 15 bp, Homo sapiens
tcactataactaact

SEQ ID NO: 15502 - DNA, 15 bp, Homo sapiens
ttcactataactaac

SEQ ID NO: 15503 - DNA, 15 bp, Homo sapiens
gttcactataactaa

SEQ ID NO: 15504 - DNA, 15 bp, Homo sapiens
tgttcactataacta

SEQ ID NO: 15505 - DNA, 15 bp, Homo sapiens
ttgttcactataact

SEQ ID NO: 15506 - DNA, 15 bp, Homo sapiens
attgttcactataac

SEQ ID NO: 15507 - DNA, 15 bp, Homo sapiens
aattgttcactataa

SEQ ID NO: 15508 - DNA, 15 bp, Homo sapiens
aaattgttcactata

SEQ ID NO: 15509 - DNA, 15 bp, Homo sapiens
caaattgttcactat

SEQ ID NO: 15510 - DNA, 15 bp, Homo sapiens
acaaattgttcacta

SEQ ID NO: 15511 - DNA, 15 bp, Homo sapiens
aacaaattgttcact

SEQ ID NO: 15512 - DNA, 15 bp, Homo sapiens
taacaaattgttcac

SEQ ID NO: 15513 - DNA, 15 bp, Homo sapiens
ctaacaaattgttca

SEQ ID NO: 15514 - DNA, 15 bp, Homo sapiens
tctaacaaattgttc

SEQ ID NO: 15515 - DNA, 15 bp, Homo sapiens
ttctaacaaattgtt

SEQ ID NO: 15516 - DNA, 15 bp, Homo sapiens
attctaacaaattgt

SEQ ID NO: 15517 - DNA, 15 bp, Homo sapiens
tattctaacaaattg

SEQ ID NO: 15518 - DNA, 15 bp, Homo sapiens
gtattctaacaaatt

SEQ ID NO: 15519 - DNA, 15 bp, Homo sapiens
agtattctaacaaat

SEQ ID NO: 15520 - DNA, 15 bp, Homo sapiens
cagtattctaacaaa

SEQ ID NO: 15521 - DNA, 15 bp, Homo sapiens
ccagtattctaacaa

SEQ ID NO: 15522 - DNA, 15 bp, Homo sapiens
gccagtattctaaca

SEQ ID NO: 15523 - DNA, 15 bp, Homo sapiens
agccagtattctaac

SEQ ID NO: 15524 - DNA, 15 bp, Homo sapiens
tagccagtattctaa

SEQ ID NO: 15525 - DNA, 15 bp, Homo sapiens
ttagccagtattcta

SEQ ID NO: 15526 - DNA, 15 bp, Homo sapiens
attagccagtattct

SEQ ID NO: 15527 - DNA, 15 bp, Homo sapiens
cattagccagtattc

SEQ ID NO: 15528 - DNA, 15 bp, Homo sapiens
tcattagccagtatt

SEQ ID NO: 15529 - DNA, 15 bp, Homo sapiens
gtcattagccagtat

SEQ ID NO: 15530 - DNA, 15 bp, Homo sapiens
cgtcattagccagta

SEQ ID NO: 15531 - DNA, 15 bp, Homo sapiens
tcgtcattagccagt

SEQ ID NO: 15532 - DNA, 15 bp, Homo sapiens
gtcgtcattagccag

SEQ ID NO: 15533 - DNA, 15 bp, Homo sapiens
tgtcgtcattagcca

SEQ ID NO: 15534 - DNA, 15 bp, Homo sapiens
gtgtcgtcattagcc

SEQ ID NO: 15535 - DNA, 15 bp, Homo sapiens
tgtgtcgtcattagc

SEQ ID NO: 15536 - DNA, 15 bp, Homo sapiens
ctgtgtcgtcattag

SEQ ID NO: 15537 - DNA, 15 bp, Homo sapiens
actgtgtcgtcatta

SEQ ID NO: 15538 - DNA, 15 bp, Homo sapiens
aactgtgtcgtcatt

SEQ ID NO: 15539 - DNA, 15 bp, Homo sapiens
aaactgtgtcgtcat

SEQ ID NO: 15540 - DNA, 15 bp, Homo sapiens
aaaactgtgtcgtca

SEQ ID NO: 15541 - DNA, 15 bp, Homo sapiens
aaaaactgtgtcgtc

SEQ ID NO: 15542 - DNA, 15 bp, Homo sapiens
gaaaaactgtgtcgt

SEQ ID NO: 15543 - DNA, 15 bp, Homo sapiens
ggaaaaactgtgtcg

SEQ ID NO: 15544 - DNA, 15 bp, Homo sapiens
aggaaaaactgtgtc

SEQ ID NO: 15545 - DNA, 15 bp, Homo sapiens
caggaaaaactgtgt

SEQ ID NO: 15546 - DNA, 15 bp, Homo sapiens
acaggaaaaactgtg

SEQ ID NO: 15547 - DNA, 15 bp, Homo sapiens
aacaggaaaaactgt

SEQ ID NO: 15548 - DNA, 15 bp, Homo sapiens
aaacaggaaaaactg

SEQ ID NO: 15549 - DNA, 15 bp, Homo sapiens
aaaacaggaaaaact

SEQ ID NO: 15550 - DNA, 15 bp, Homo sapiens
caaaacaggaaaaac

SEQ ID NO: 15551 - DNA, 15 bp, Homo sapiens
acaaaacaggaaaaa

SEQ ID NO: 15552 - DNA, 15 bp, Homo sapiens
aacaaaacaggaaaa

SEQ ID NO: 15553 - DNA, 15 bp, Homo sapiens
aaacaaaacaggaaa

SEQ ID NO: 15554 - DNA, 15 bp, Homo sapiens
gaaacaaaacaggaa

SEQ ID NO: 15555 - DNA, 15 bp, Homo sapiens
agaaacaaaacagga

SEQ ID NO: 15556 - DNA, 15 bp, Homo sapiens
aagaaacaaaacagg

SEQ ID NO: 15557 - DNA, 15 bp, Homo sapiens
caagaaacaaaacag

SEQ ID NO: 15558 - DNA, 15 bp, Homo sapiens
ccaagaaacaaaaca

SEQ ID NO: 15559 - DNA, 15 bp, Homo sapiens
gccaagaaacaaaac

SEQ ID NO: 15560 - DNA, 15 bp, Homo sapiens
tgccaagaaacaaaa

SEQ ID NO: 15561 - DNA, 15 bp, Homo sapiens
gtgccaagaaacaaa

SEQ ID NO: 15562 - DNA, 15 bp, Homo sapiens
ggtgccaagaaacaa

SEQ ID NO: 15563 - DNA, 15 bp, Homo sapiens
tggtgccaagaaaca

SEQ ID NO: 15564 - DNA, 15 bp, Homo sapiens
ttggtgccaagaaac

SEQ ID NO: 15565 - DNA, 15 bp, Homo sapiens
tttggtgccaagaaa

SEQ ID NO: 15566 - DNA, 15 bp, Homo sapiens
ctttggtgccaagaa

SEQ ID NO: 15567 - DNA, 15 bp, Homo sapiens
actttggtgccaaga

SEQ ID NO: 15568 - DNA, 15 bp, Homo sapiens
aactttggtgccaag

SEQ ID NO: 15569 - DNA, 15 bp, Homo sapiens
gaactttggtgccaa

SEQ ID NO: 15570 - DNA, 15 bp, Homo sapiens
tgaactttggtgcca

SEQ ID NO: 15571 - DNA, 15 bp, Homo sapiens
atgaactttggtgcc

SEQ ID NO: 15572 - DNA, 15 bp, Homo sapiens
catgaactttggtgc

SEQ ID NO: 15573 - DNA, 15 bp, Homo sapiens
ccatgaactttggtg

SEQ ID NO: 15574 - DNA, 15 bp, Homo sapiens
accatgaactttggt

SEQ ID NO: 15575 - DNA, 15 bp, Homo sapiens
gaccatgaactttgg

SEQ ID NO: 15576 - DNA, 15 bp, Homo sapiens
tgaccatgaactttg

SEQ ID NO: 15577 - DNA, 15 bp, Homo sapiens
ttgaccatgaacttt

SEQ ID NO: 15578 - DNA, 15 bp, Homo sapiens
cttgaccatgaactt

SEQ ID NO: 15579 - DNA, 15 bp, Homo sapiens
ccttgaccatgaact

SEQ ID NO: 15580 - DNA, 15 bp, Homo sapiens
cccttgaccatgaac

SEQ ID NO: 15581 - DNA, 15 bp, Homo sapiens
acccttgaccatgaa

SEQ ID NO: 15582 - DNA, 15 bp, Homo sapiens
tacccttgaccatga

SEQ ID NO: 15583 - DNA, 15 bp, Homo sapiens
ttacccttgaccatg

SEQ ID NO: 15584 - DNA, 15 bp, Homo sapiens
attacccttgaccat

SEQ ID NO: 15585 - DNA, 15 bp, Homo sapiens
aattacccttgacca

SEQ ID NO: 15586 - DNA, 15 bp, Homo sapiens
aaattacccttgacc

SEQ ID NO: 15587 - DNA, 15 bp, Homo sapiens
gaaattacccttgac

SEQ ID NO: 15588 - DNA, 15 bp, Homo sapiens
agaaattacccttga

SEQ ID NO: 15589 - DNA, 15 bp, Homo sapiens
aagaaattacccttg

SEQ ID NO: 15590 - DNA, 15 bp, Homo sapiens
caagaaattaccctt

SEQ ID NO: 15591 - DNA, 15 bp, Homo sapiens
tcaagaaattaccct

SEQ ID NO: 15592 - DNA, 15 bp, Homo sapiens
gtcaagaaattaccc

SEQ ID NO: 15593 - DNA, 15 bp, Homo sapiens
agtcaagaaattacc

SEQ ID NO: 15594 - DNA, 15 bp, Homo sapiens
gagtcaagaaattac

SEQ ID NO: 15595 - DNA, 15 bp, Homo sapiens
agagtcaagaaatta

SEQ ID NO: 15596 - DNA, 15 bp, Homo sapiens
cagagtcaagaaatt

SEQ ID NO: 15597 - DNA, 15 bp, Homo sapiens
tcagagtcaagaaat

SEQ ID NO: 15598 - DNA, 15 bp, Homo sapiens
ttcagagtcaagaaa

SEQ ID NO: 15599 - DNA, 15 bp, Homo sapiens
tttcagagtcaagaa

SEQ ID NO: 15600 - DNA, 15 bp, Homo sapiens
ctttcagagtcaaga

SEQ ID NO: 15601 - DNA, 15 bp, Homo sapiens
gctttcagagtcaag

SEQ ID NO: 15602 - DNA, 15 bp, Homo sapiens
agctttcagagtcaa

SEQ ID NO: 15603 - DNA, 15 bp, Homo sapiens
tagctttcagagtca

SEQ ID NO: 15604 - DNA, 15 bp, Homo sapiens
atagctttcagagtc

SEQ ID NO: 15605 - DNA, 15 bp, Homo sapiens
catagctttcagagt

SEQ ID NO: 15606 - DNA, 15 bp, Homo sapiens
gcatagctttcagag

SEQ ID NO: 15607 - DNA, 15 bp, Homo sapiens
agcatagctttcaga

SEQ ID NO: 15608 - DNA, 15 bp, Homo sapiens
aagcatagctttcag

SEQ ID NO: 15609 - DNA, 15 bp, Homo sapiens
caagcatagctttca

SEQ ID NO: 15610 - DNA, 15 bp, Homo sapiens
ccaagcatagctttc

SEQ ID NO: 15611 - DNA, 15 bp, Homo sapiens
gccaagcatagcttt

SEQ ID NO: 15612 - DNA, 15 bp, Homo sapiens
ggccaagcatagctt

SEQ ID NO: 15613 - DNA, 15 bp, Homo sapiens
tggccaagcatagct

SEQ ID NO: 15614 - DNA, 15 bp, Homo sapiens
ctggccaagcatagc

SEQ ID NO: 15615 - DNA, 15 bp, Homo sapiens
cctggccaagcatag

SEQ ID NO: 15616 - DNA, 15 bp, Homo sapiens
gcctggccaagcata

SEQ ID NO: 15617 - DNA, 15 bp, Homo sapiens
agcctggccaagcat

SEQ ID NO: 15618 - DNA, 15 bp, Homo sapiens
aagcctggccaagca

SEQ ID NO: 15619 - DNA, 15 bp, Homo sapiens
caagcctggccaagc

SEQ ID NO: 15620 - DNA, 15 bp, Homo sapiens
ccaagcctggccaag

SEQ ID NO: 15621 - DNA, 15 bp, Homo sapiens
accaagcctggccaa

SEQ ID NO: 15622 - DNA, 15 bp, Homo sapiens
taccaagcctggcca

SEQ ID NO: 15623 - DNA, 15 bp, Homo sapiens
ctaccaagcctggcc

SEQ ID NO: 15624 - DNA, 15 bp, Homo sapiens
gctaccaagcctggc

SEQ ID NO: 15625 - DNA, 15 bp, Homo sapiens
agctaccaagcctgg

SEQ ID NO: 15626 - DNA, 15 bp, Homo sapiens
gagctaccaagcctg

SEQ ID NO: 15627 - DNA, 15 bp, Homo sapiens
tgagctaccaagcct

SEQ ID NO: 15628 - DNA, 15 bp, Homo sapiens
gtgagctaccaagcc

SEQ ID NO: 15629 - DNA, 15 bp, Homo sapiens
cgtgagctaccaagc

SEQ ID NO: 15630 - DNA, 15 bp, Homo sapiens
gcgtgagctaccaag

SEQ ID NO: 15631 - DNA, 15 bp, Homo sapiens
ggcgtgagctaccaa

SEQ ID NO: 15632 - DNA, 15 bp, Homo sapiens
aggcgtgagctacca

SEQ ID NO: 15633 - DNA, 15 bp, Homo sapiens
caggcgtgagctacc

SEQ ID NO: 15634 - DNA, 15 bp, Homo sapiens
acaggcgtgagctac

SEQ ID NO: 15635 - DNA, 15 bp, Homo sapiens
tacaggcgtgagcta

SEQ ID NO: 15636 - DNA, 15 bp, Homo sapiens
ttacaggcgtgagct

SEQ ID NO: 15637 - DNA, 15 bp, Homo sapiens
attacaggcgtgagc

SEQ ID NO: 15638 - DNA, 15 bp, Homo sapiens
gattacaggcgtgag

SEQ ID NO: 15639 - DNA, 15 bp, Homo sapiens
ggattacaggcgtga

SEQ ID NO: 15640 - DNA, 15 bp, Homo sapiens
gggattacaggcgtg

SEQ ID NO: 15641 - DNA, 15 bp, Homo sapiens
tgggattacaggcgt

SEQ ID NO: 15642 - DNA, 15 bp, Homo sapiens
ctgggattacaggcg

SEQ ID NO: 15643 - DNA, 15 bp, Homo sapiens
atcccaaagtgctgg

SEQ ID NO: 15644 - DNA, 15 bp, Homo sapiens
catcccaaagtgctg

SEQ ID NO: 15645 - DNA, 15 bp, Homo sapiens
gcatcccaaagtgct

SEQ ID NO: 15646 - DNA, 15 bp, Homo sapiens
ggcatcccaaagtgc

SEQ ID NO: 15647 - DNA, 15 bp, Homo sapiens
cggcatcccaaagtg

SEQ ID NO: 15648 - DNA, 15 bp, Homo sapiens
tcggcatcccaaagt

SEQ ID NO: 15649 - DNA, 15 bp, Homo sapiens
ctcggcatcccaaag

SEQ ID NO: 15650 - DNA, 15 bp, Homo sapiens
cctcggcatcccaaa

SEQ ID NO: 15651 - DNA, 15 bp, Homo sapiens
gcctcggcatcccaa

SEQ ID NO: 15652 - DNA, 15 bp, Homo sapiens
tgcctcggcatccca

SEQ ID NO: 15653 - DNA, 15 bp, Homo sapiens
ctgcctcggcatccc

SEQ ID NO: 15654 - DNA, 15 bp, Homo sapiens
cctgcctcggcatcc

SEQ ID NO: 15655 - DNA, 15 bp, Homo sapiens
gcctgcctcggcatc

SEQ ID NO: 15656 - DNA, 15 bp, Homo sapiens
tgcctgcctcggcat

SEQ ID NO: 15657 - DNA, 15 bp, Homo sapiens
ctgcctgcctcggca

SEQ ID NO: 15658 - DNA, 15 bp, Homo sapiens
gatctgcctgcctcg

SEQ ID NO: 15659 - DNA, 15 bp, Homo sapiens
tgatctgcctgcctc

SEQ ID NO: 15660 - DNA, 15 bp, Homo sapiens
gtgatctgcctgcct

SEQ ID NO: 15661 - DNA, 15 bp, Homo sapiens
cgtgatctgcctgcc

SEQ ID NO: 15662 - DNA, 15 bp, Homo sapiens
tcgtgatctgcctgc

SEQ ID NO: 15663 - DNA, 15 bp, Homo sapiens
ctcgtgatctgcctg

SEQ ID NO: 15664 - DNA, 15 bp, Homo sapiens
cctcgtgatctgcct

SEQ ID NO: 15665 - DNA, 15 bp, Homo sapiens
acctcgtgatctgcc

SEQ ID NO: 15666 - DNA, 15 bp, Homo sapiens
gacctcgtgatctgc

SEQ ID NO: 15667 - DNA, 15 bp, Homo sapiens
tgacctcgtgatctg

SEQ ID NO: 15668 - DNA, 15 bp, Homo sapiens
ttgacctcgtgatct

SEQ ID NO: 15669 - DNA, 15 bp, Homo sapiens
cttgacctcgtgatc

SEQ ID NO: 15670 - DNA, 15 bp, Homo sapiens
tcttgacctcgtgat

SEQ ID NO: 15671 - DNA, 15 bp, Homo sapiens
ctcttgacctcgtga

SEQ ID NO: 15672 - DNA, 15 bp, Homo sapiens
tctcttgacctcgtg

SEQ ID NO: 15673 - DNA, 15 bp, Homo sapiens
atctcttgacctcgt

SEQ ID NO: 15674 - DNA, 15 bp, Homo sapiens
aatctcttgacctcg

SEQ ID NO: 15675 - DNA, 15 bp, Homo sapiens
caatctcttgacctc

SEQ ID NO: 15676 - DNA, 15 bp, Homo sapiens
tcaatctcttgacct

SEQ ID NO: 15677 - DNA, 15 bp, Homo sapiens
ctcaatctcttgacc

SEQ ID NO: 15678 - DNA, 15 bp, Homo sapiens
tctcaatctcttgac

SEQ ID NO: 15679 - DNA, 15 bp, Homo sapiens
gtctcaatctcttga

SEQ ID NO: 15680 - DNA, 15 bp, Homo sapiens
ggtctcaatctcttg

SEQ ID NO: 15681 - DNA, 15 bp, Homo sapiens
tggtctcaatctctt

SEQ ID NO: 15682 - DNA, 15 bp, Homo sapiens
gtggtctcaatctct

SEQ ID NO: 15683 - DNA, 15 bp, Homo sapiens
ggtggtctcaatctc

SEQ ID NO: 15684 - DNA, 15 bp, Homo sapiens
gggtggtctcaatct

SEQ ID NO: 15685 - DNA, 15 bp, Homo sapiens
agggtggtctcaatc

SEQ ID NO: 15686 - DNA, 15 bp, Homo sapiens
cagggtggtctcaat

SEQ ID NO: 15687 - DNA, 15 bp, Homo sapiens
ccagggtggtctcaa

SEQ ID NO: 15688 - DNA, 15 bp, Homo sapiens
gccagggtggtctca

SEQ ID NO: 15689 - DNA, 15 bp, Homo sapiens
ggccagggtggtctc

SEQ ID NO: 15690 - DNA, 15 bp, Homo sapiens
tggccagggtggtct

SEQ ID NO: 15691 - DNA, 15 bp, Homo sapiens
ttggccagggtggtc

SEQ ID NO: 15692 - DNA, 15 bp, Homo sapiens
gttggccagggtggt

SEQ ID NO: 15693 - DNA, 15 bp, Homo sapiens
tgttggccagggtgg

SEQ ID NO: 15694 - DNA, 15 bp, Homo sapiens
atgttggccagggtg

SEQ ID NO: 15695 - DNA, 15 bp, Homo sapiens
catgttggccagggt

SEQ ID NO: 15696 - DNA, 15 bp, Homo sapiens
tcatgttggccaggg

SEQ ID NO: 15697 - DNA, 15 bp, Homo sapiens
ttcatgttggccagg

SEQ ID NO: 15698 - DNA, 15 bp, Homo sapiens
tttcatgttggccag

SEQ ID NO: 15699 - DNA, 15 bp, Homo sapiens
gtttcatgttggcca

SEQ ID NO: 15700 - DNA, 15 bp, Homo sapiens
ggtttcatgttggcc

SEQ ID NO: 15701 - DNA, 15 bp, Homo sapiens
aggtttcatgttggc

SEQ ID NO: 15702 - DNA, 15 bp, Homo sapiens
gaggtttcatgttgg

SEQ ID NO: 15703 - DNA, 15 bp, Homo sapiens
tgaggtttcatgttg

SEQ ID NO: 15704 - DNA, 15 bp, Homo sapiens
atgaggtttcatgtt

SEQ ID NO: 15705 - DNA, 15 bp, Homo sapiens
gatgaggtttcatgt

SEQ ID NO: 15706 - DNA, 15 bp, Homo sapiens
agatgaggtttcatg

SEQ ID NO: 15707 - DNA, 15 bp, Homo sapiens
gagatgaggtttcat

SEQ ID NO: 15708 - DNA, 15 bp, Homo sapiens
agagatgaggtttca

SEQ ID NO: 15709 - DNA, 15 bp, Homo sapiens
tagagatgaggtttc

SEQ ID NO: 15710 - DNA, 15 bp, Homo sapiens
gtagagatgaggttt

SEQ ID NO: 15711 - DNA, 15 bp, Homo sapiens
agtagagatgaggtt

SEQ ID NO: 15712 - DNA, 15 bp, Homo sapiens
tagtagagatgaggt

SEQ ID NO: 15713 - DNA, 15 bp, Homo sapiens
ttagtagagatgagg

SEQ ID NO: 15714 - DNA, 15 bp, Homo sapiens
tttagtagagatgag

SEQ ID NO: 15715 - DNA, 15 bp, Homo sapiens
ttttagtagagatga

SEQ ID NO: 15716 - DNA, 15 bp, Homo sapiens
catttttagtagaga

SEQ ID NO: 15717 - DNA, 15 bp, Homo sapiens
gcatttttagtagag

SEQ ID NO: 15718 - DNA, 15 bp, Homo sapiens
tgcatttttagtaga

SEQ ID NO: 15719 - DNA, 15 bp, Homo sapiens
ttgcatttttagtag

SEQ ID NO: 15720 - DNA, 15 bp, Homo sapiens
tttgcatttttagta

SEQ ID NO: 15721 - DNA, 15 bp, Homo sapiens
ttttgcatttttagt

SEQ ID NO: 15722 - DNA, 15 bp, Homo sapiens
tttttgcatttttag

SEQ ID NO: 15723 - DNA, 15 bp, Homo sapiens
atttttgcattttta

SEQ ID NO: 15724 - DNA, 15 bp, Homo sapiens
aatttttgcattttt

SEQ ID NO: 15725 - DNA, 15 bp, Homo sapiens
taatttttgcatttt

SEQ ID NO: 15726 - DNA, 15 bp, Homo sapiens
ctaatttttgcattt

SEQ ID NO: 15727 - DNA, 15 bp, Homo sapiens
gctaatttttgcatt

SEQ ID NO: 15728 - DNA, 15 bp, Homo sapiens
ggctaatttttgcat

SEQ ID NO: 15729 - DNA, 15 bp, Homo sapiens
cggctaatttttgca

SEQ ID NO: 15730 - DNA, 15 bp, Homo sapiens
ccggctaatttttgc

SEQ ID NO: 15731 - DNA, 15 bp, Homo sapiens
cccggctaatttttg

SEQ ID NO: 15732 - DNA, 15 bp, Homo sapiens
gcccggctaattttt

SEQ ID NO: 15733 - DNA, 15 bp, Homo sapiens
tgcccggctaatttt

SEQ ID NO: 15734 - DNA, 15 bp, Homo sapiens
atgcccggctaattt

SEQ ID NO: 15735 - DNA, 15 bp, Homo sapiens
catgcccggctaatt

SEQ ID NO: 15736 - DNA, 15 bp, Homo sapiens
tcatgcccggctaat

SEQ ID NO: 15737 - DNA, 15 bp, Homo sapiens
atcatgcccggctaa

SEQ ID NO: 15738 - DNA, 15 bp, Homo sapiens
catcatgcccggcta

SEQ ID NO: 15739 - DNA, 15 bp, Homo sapiens
ccatcatgcccggct

SEQ ID NO: 15740 - DNA, 15 bp, Homo sapiens
accatcatgcccggc

SEQ ID NO: 15741 - DNA, 15 bp, Homo sapiens
caccatcatgcccgg

SEQ ID NO: 15742 - DNA, 15 bp, Homo sapiens
acaccatcatgcccg

SEQ ID NO: 15743 - DNA, 15 bp, Homo sapiens
cacaccatcatgccc

SEQ ID NO: 15744 - DNA, 15 bp, Homo sapiens
acacaccatcatgcc

SEQ ID NO: 15745 - DNA, 15 bp, Homo sapiens
cacacaccatcatgc

SEQ ID NO: 15746 - DNA, 15 bp, Homo sapiens
gcacacaccatcatg

SEQ ID NO: 15747 - DNA, 15 bp, Homo sapiens
ggcacacaccatcat

SEQ ID NO: 15748 - DNA, 15 bp, Homo sapiens
aggcacacaccatca

SEQ ID NO: 15749 - DNA, 15 bp, Homo sapiens
caggcacacaccatc

SEQ ID NO: 15750 - DNA, 15 bp, Homo sapiens
acaggcacacaccat

SEQ ID NO: 15751 - DNA, 15 bp, Homo sapiens
tacaggcacacacca

SEQ ID NO: 15752 - DNA, 15 bp, Homo sapiens
ctacaggcacacacc

SEQ ID NO: 15753 - DNA, 15 bp, Homo sapiens
actacaggcacacac

SEQ ID NO: 15754 - DNA, 15 bp, Homo sapiens
gactacaggcacaca

SEQ ID NO: 15755 - DNA, 15 bp, Homo sapiens
ggactacaggcacac

SEQ ID NO: 15756 - DNA, 15 bp, Homo sapiens
gggactacaggcaca

SEQ ID NO: 15757 - DNA, 15 bp, Homo sapiens
tgggactacaggcac

SEQ ID NO: 15758 - DNA, 15 bp, Homo sapiens
ggctgggactacagg

SEQ ID NO: 15759 - DNA, 15 bp, Homo sapiens
tggctgggactacag

SEQ ID NO: 15760 - DNA, 15 bp, Homo sapiens
gtggctgggactaca

SEQ ID NO: 15761 - DNA, 15 bp, Homo sapiens
agtggctgggactac

SEQ ID NO: 15762 - DNA, 15 bp, Homo sapiens
aagtggctgggacta

SEQ ID NO: 15763 - DNA, 15 bp, Homo sapiens
caagtggctgggact

SEQ ID NO: 15764 - DNA, 15 bp, Homo sapiens
acaagtggctgggac

SEQ ID NO: 15765 - DNA, 15 bp, Homo sapiens
cacaagtggctggga

SEQ ID NO: 15766 - DNA, 15 bp, Homo sapiens
tcacaagtggctggg

SEQ ID NO: 15767 - DNA, 15 bp, Homo sapiens
ctcacaagtggctgg

SEQ ID NO: 15768 - DNA, 15 bp, Homo sapiens
cctcacaagtggctg

SEQ ID NO: 15769 - DNA, 15 bp, Homo sapiens
gcctcacaagtggct

SEQ ID NO: 15770 - DNA, 15 bp, Homo sapiens
agcctcacaagtggc

SEQ ID NO: 15771 - DNA, 15 bp, Homo sapiens
cagcctcacaagtgg

SEQ ID NO: 15772 - DNA, 15 bp, Homo sapiens
gcagcctcacaagtg

SEQ ID NO: 15773 - DNA, 15 bp, Homo sapiens
tgcagcctcacaagt

SEQ ID NO: 15774 - DNA, 15 bp, Homo sapiens
ctgcagcctcacaag

SEQ ID NO: 15775 - DNA, 15 bp, Homo sapiens
gctgcagcctcacaa

SEQ ID NO: 15776 - DNA, 15 bp, Homo sapiens
tgctgcagcctcaca

SEQ ID NO: 15777 - DNA, 15 bp, Homo sapiens
ctgctgcagcctcac

SEQ ID NO: 15778 - DNA, 15 bp, Homo sapiens
cctgctgcagcctca

SEQ ID NO: 15779 - DNA, 15 bp, Homo sapiens
tcctgctgcagcctc

SEQ ID NO: 15780 - DNA, 15 bp, Homo sapiens
ttcctgctgcagcct

SEQ ID NO: 15781 - DNA, 15 bp, Homo sapiens
cttcctgctgcagcc

SEQ ID NO: 15782 - DNA, 15 bp, Homo sapiens
tcttcctgctgcagc

SEQ ID NO: 15783 - DNA, 15 bp, Homo sapiens
ttcttcctgctgcag

SEQ ID NO: 15784 - DNA, 15 bp, Homo sapiens
attcttcctgctgca

SEQ ID NO: 15785 - DNA, 15 bp, Homo sapiens
gattcttcctgctgc

SEQ ID NO: 15786 - DNA, 15 bp, Homo sapiens
cgattcttcctgctg

SEQ ID NO: 15787 - DNA, 15 bp, Homo sapiens
gcgattcttcctgct

SEQ ID NO: 15788 - DNA, 15 bp, Homo sapiens
agcgattcttcctgc

SEQ ID NO: 15789 - DNA, 15 bp, Homo sapiens
aagcgattcttcctg

SEQ ID NO: 15790 - DNA, 15 bp, Homo sapiens
caagcgattcttcct

SEQ ID NO: 15791 - DNA, 15 bp, Homo sapiens
tcaagcgattcttcc

SEQ ID NO: 15792 - DNA, 15 bp, Homo sapiens
ttcaagcgattcttc

SEQ ID NO: 15793 - DNA, 15 bp, Homo sapiens
gttcaagcgattctt

SEQ ID NO: 15794 - DNA, 15 bp, Homo sapiens
aggttcaagcgattc

SEQ ID NO: 15795 - DNA, 15 bp, Homo sapiens
caggttcaagcgatt

SEQ ID NO: 15796 - DNA, 15 bp, Homo sapiens
ccaggttcaagcgat

SEQ ID NO: 15797 - DNA, 15 bp, Homo sapiens
cccaggttcaagcga

SEQ ID NO: 15798 - DNA, 15 bp, Homo sapiens
tcccaggttcaagcg

SEQ ID NO: 15799 - DNA, 15 bp, Homo sapiens
ctcccaggttcaagc

SEQ ID NO: 15800 - DNA, 15 bp, Homo sapiens
cctcccaggttcaag

SEQ ID NO: 15801 - DNA, 15 bp, Homo sapiens
gcctcccaggttcaa

SEQ ID NO: 15802 - DNA, 15 bp, Homo sapiens
cgcctcccaggttca

SEQ ID NO: 15803 - DNA, 15 bp, Homo sapiens
ccgcctcccaggttc

SEQ ID NO: 15804 - DNA, 15 bp, Homo sapiens
tccgcctcccaggtt

SEQ ID NO: 15805 - DNA, 15 bp, Homo sapiens
ctccgcctcccaggt

SEQ ID NO: 15806 - DNA, 15 bp, Homo sapiens
cctccgcctcccagg

SEQ ID NO: 15807 - DNA, 15 bp, Homo sapiens
acctccgcctcccag

SEQ ID NO: 15808 - DNA, 15 bp, Homo sapiens
aacctccgcctccca

SEQ ID NO: 15809 - DNA, 15 bp, Homo sapiens
caacctccgcctccc

SEQ ID NO: 15810 - DNA, 15 bp, Homo sapiens
gcgatctcagctcac

SEQ ID NO: 15811 - DNA, 15 bp, Homo sapiens
tgcgatctcagctca

SEQ ID NO: 15812 - DNA, 15 bp, Homo sapiens
gtgcgatctcagctc

SEQ ID NO: 15813 - DNA, 15 bp, Homo sapiens
ggtgcgatctcagct

SEQ ID NO: 15814 - DNA, 15 bp, Homo sapiens
tggtgcgatctcagc

SEQ ID NO: 15815 - DNA, 15 bp, Homo sapiens
gtggtgcgatctcag

SEQ ID NO: 15816 - DNA, 15 bp, Homo sapiens
agtggtgcgatctca

SEQ ID NO: 15817 - DNA, 15 bp, Homo sapiens
cagtggtgcgatctc

SEQ ID NO: 15818 - DNA, 15 bp, Homo sapiens
gcagtggtgcgatct

SEQ ID NO: 15819 - DNA, 15 bp, Homo sapiens
tgcagtggtgcgatc

SEQ ID NO: 15820 - DNA, 15 bp, Homo sapiens
gtgcagtggtgcgat

SEQ ID NO: 15821 - DNA, 15 bp, Homo sapiens
agtgcagtggtgcga

SEQ ID NO: 15822 - DNA, 15 bp, Homo sapiens
gagtgcagtggtgcg

SEQ ID NO: 15823 - DNA, 15 bp, Homo sapiens
ggagtgcagtggtgc

SEQ ID NO: 15824 - DNA, 15 bp, Homo sapiens
tggagtgcagtggtg

SEQ ID NO: 15825 - DNA, 15 bp, Homo sapiens
atggagtgcagtggt

SEQ ID NO: 15826 - DNA, 15 bp, Homo sapiens
gatggagtgcagtgg

SEQ ID NO: 15827 - DNA, 15 bp, Homo sapiens
agatggagtgcagtg

SEQ ID NO: 15828 - DNA, 15 bp, Homo sapiens
aagatggagtgcagt

SEQ ID NO: 15829 - DNA, 15 bp, Homo sapiens
caagatggagtgcag

SEQ ID NO: 15830 - DNA, 15 bp, Homo sapiens
tcaagatggagtgca

SEQ ID NO: 15831 - DNA, 15 bp, Homo sapiens
atcaagatggagtgc

SEQ ID NO: 15832 - DNA, 15 bp, Homo sapiens
catcaagatggagtg

SEQ ID NO: 15833 - DNA, 15 bp, Homo sapiens
tcatcaagatggagt

SEQ ID NO: 15834 - DNA, 15 bp, Homo sapiens
gtcatcaagatggag

SEQ ID NO: 15835 - DNA, 15 bp, Homo sapiens
tgtcatcaagatgga

SEQ ID NO: 15836 - DNA, 15 bp, Homo sapiens
ctgtcatcaagatgg

SEQ ID NO: 15837 - DNA, 15 bp, Homo sapiens
tctgtcatcaagatg

SEQ ID NO: 15838 - DNA, 15 bp, Homo sapiens
ctctgtcatcaagat

SEQ ID NO: 15839 - DNA, 15 bp, Homo sapiens
actctgtcatcaaga

SEQ ID NO: 15840 - DNA, 15 bp, Homo sapiens
cactctgtcatcaag

SEQ ID NO: 15841 - DNA, 15 bp, Homo sapiens
tcactctgtcatcaa

SEQ ID NO: 15842 - DNA, 15 bp, Homo sapiens
ctcactctgtcatca

SEQ ID NO: 15843 - DNA, 15 bp, Homo sapiens
tctcactctgtcatc

SEQ ID NO: 15844 - DNA, 15 bp, Homo sapiens
gtctcactctgtcat

SEQ ID NO: 15845 - DNA, 15 bp, Homo sapiens
agtctcactctgtca

SEQ ID NO: 15846 - DNA, 15 bp, Homo sapiens
aagtctcactctgtc

SEQ ID NO: 15847 - DNA, 15 bp, Homo sapiens
gaagtctcactctgt

SEQ ID NO: 15848 - DNA, 15 bp, Homo sapiens
tgaagtctcactctg

SEQ ID NO: 15849 - DNA, 15 bp, Homo sapiens
atgaagtctcactct

SEQ ID NO: 15850 - DNA, 15 bp, Homo sapiens
gatgaagtctcactc

SEQ ID NO: 15851 - DNA, 15 bp, Homo sapiens
agatgaagtctcact

SEQ ID NO: 15852 - DNA, 15 bp, Homo sapiens
gagatgaagtctcac

SEQ ID NO: 15853 - DNA, 15 bp, Homo sapiens
tgagatgaagtctca

SEQ ID NO: 15854 - DNA, 15 bp, Homo sapiens
ttgagatgaagtctc

SEQ ID NO: 15855 - DNA, 15 bp, Homo sapiens
tttgagatgaagtct

SEQ ID NO: 15856 - DNA, 15 bp, Homo sapiens
ttttgagatgaagtc

SEQ ID NO: 15857 - DNA, 15 bp, Homo sapiens
tttttgagatgaagt

SEQ ID NO: 15858 - DNA, 15 bp, Homo sapiens
ttttttgagatgaag

SEQ ID NO: 15859 - DNA, 15 bp, Homo sapiens
tttttttgagatgaa

SEQ ID NO: 15860 - DNA, 15 bp, Homo sapiens
ttttttttgagatga

SEQ ID NO: 15861 - DNA, 15 bp, Homo sapiens
tttttttttgagatg

SEQ ID NO: 15862 - DNA, 15 bp, Homo sapiens
ttttttttttgagat

SEQ ID NO: 15863 - DNA, 15 bp, Homo sapiens
tttttttttttgaga

SEQ ID NO: 15864 - DNA, 15 bp, Homo sapiens
ttttttttttttgag

SEQ ID NO: 15865 - DNA, 15 bp, Homo sapiens
tttttttttttttga

SEQ ID NO: 15866 - DNA, 15 bp, Homo sapiens
ttttttttttttttg

SEQ ID NO: 15867 - DNA, 15 bp, Homo sapiens
tgttttttttttttt

SEQ ID NO: 15868 - DNA, 15 bp, Homo sapiens
ctgtttttttttttt

SEQ ID NO: 15869 - DNA, 15 bp, Homo sapiens
actgttttttttttt

SEQ ID NO: 15870 - DNA, 15 bp, Homo sapiens
tactgtttttttttt

SEQ ID NO: 15871 - DNA, 15 bp, Homo sapiens
atactgttttttttt

SEQ ID NO: 15872 - DNA, 15 bp, Homo sapiens
catactgtttttttt

SEQ ID NO: 15873 - DNA, 15 bp, Homo sapiens
gcatactgttttttt

SEQ ID NO: 15874 - DNA, 15 bp, Homo sapiens
agcatactgtttttt

SEQ ID NO: 15875 - DNA, 15 bp, Homo sapiens
aagcatactgttttt

SEQ ID NO: 15876 - DNA, 15 bp, Homo sapiens
taagcatactgtttt

SEQ ID NO: 15877 - DNA, 15 bp, Homo sapiens
ttaagcatactgttt

SEQ ID NO: 15878 - DNA, 15 bp, Homo sapiens
tttaagcatactgtt

SEQ ID NO: 15879 - DNA, 15 bp, Homo sapiens
ttttaagcatactgt

SEQ ID NO: 15880 - DNA, 15 bp, Homo sapiens
tttttaagcatactg

SEQ ID NO: 15881 - DNA, 15 bp, Homo sapiens
atttttaagcatact

SEQ ID NO: 15882 - DNA, 15 bp, Homo sapiens
tatttttaagcatac

SEQ ID NO: 15883 - DNA, 15 bp, Homo sapiens
gtatttttaagcata

SEQ ID NO: 15884 - DNA, 15 bp, Homo sapiens
agtatttttaagcat

SEQ ID NO: 15885 - DNA, 15 bp, Homo sapiens
aagtatttttaagca

SEQ ID NO: 15886 - DNA, 15 bp, Homo sapiens
taagtatttttaagc

SEQ ID NO: 15887 - DNA, 15 bp, Homo sapiens
ataagtatttttaag

SEQ ID NO: 15888 - DNA, 15 bp, Homo sapiens
cataagtatttttaa

SEQ ID NO: 15889 - DNA, 15 bp, Homo sapiens
acataagtattttta

SEQ ID NO: 15890 - DNA, 15 bp, Homo sapiens
cacataagtattttt

SEQ ID NO: 15891 - DNA, 15 bp, Homo sapiens
acacataagtatttt

SEQ ID NO: 15892 - DNA, 15 bp, Homo sapiens
aacacataagtattt

SEQ ID NO: 15893 - DNA, 15 bp, Homo sapiens
taacacataagtatt

SEQ ID NO: 15894 - DNA, 15 bp, Homo sapiens
gtaacacataagtat

SEQ ID NO: 15895 - DNA, 15 bp, Homo sapiens
tgtaacacataagta

SEQ ID NO: 15896 - DNA, 15 bp, Homo sapiens
gtgtaacacataagt

SEQ ID NO: 15897 - DNA, 15 bp, Homo sapiens
agtgtaacacataag

SEQ ID NO: 15898 - DNA, 15 bp, Homo sapiens
cagtgtaacacataa

SEQ ID NO: 15899 - DNA, 15 bp, Homo sapiens
tcagtgtaacacata

SEQ ID NO: 15900 - DNA, 15 bp, Homo sapiens
ctcagtgtaacacat

SEQ ID NO: 15901 - DNA, 15 bp, Homo sapiens
gctcagtgtaacaca

SEQ ID NO: 15902 - DNA, 15 bp, Homo sapiens
ggctcagtgtaacac

SEQ ID NO: 15903 - DNA, 15 bp, Homo sapiens
tggctcagtgtaaca

SEQ ID NO: 15904 - DNA, 15 bp, Homo sapiens
ctggctcagtgtaac

SEQ ID NO: 15905 - DNA, 15 bp, Homo sapiens
cctggctcagtgtaa

SEQ ID NO: 15906 - DNA, 15 bp, Homo sapiens
tcctggctcagtgta

SEQ ID NO: 15907 - DNA, 15 bp, Homo sapiens
ctcctggctcagtgt

SEQ ID NO: 15908 - DNA, 15 bp, Homo sapiens
actcctggctcagtg

SEQ ID NO: 15909 - DNA, 15 bp, Homo sapiens
gactcctggctcagt

SEQ ID NO: 15910 - DNA, 15 bp, Homo sapiens
agactcctggctcag

SEQ ID NO: 15911 - DNA, 15 bp, Homo sapiens
gagactcctggctca

SEQ ID NO: 15912 - DNA, 15 bp, Homo sapiens
agagactcctggctc

SEQ ID NO: 15913 - DNA, 15 bp, Homo sapiens
cagagactcctggct

SEQ ID NO: 15914 - DNA, 15 bp, Homo sapiens
gcagagactcctggc

SEQ ID NO: 15915 - DNA, 15 bp, Homo sapiens
ggcagagactcctgg

SEQ ID NO: 15916 - DNA, 15 bp, Homo sapiens
aggcagagactcctg

SEQ ID NO: 15917 - DNA, 15 bp, Homo sapiens
caggcagagactcct

SEQ ID NO: 15918 - DNA, 15 bp, Homo sapiens
tcaggcagagactcc

SEQ ID NO: 15919 - DNA, 15 bp, Homo sapiens
ttcaggcagagactc

SEQ ID NO: 15920 - DNA, 15 bp, Homo sapiens
attcaggcagagact

SEQ ID NO: 15921 - DNA, 15 bp, Homo sapiens
aattcaggcagagac

SEQ ID NO: 15922 - DNA, 15 bp, Homo sapiens
gaattcaggcagaga

SEQ ID NO: 15923 - DNA, 15 bp, Homo sapiens
ggaattcaggcagag

SEQ ID NO: 15924 - DNA, 15 bp, Homo sapiens
tggaattcaggcaga

SEQ ID NO: 15925 - DNA, 15 bp, Homo sapiens
ctggaattcaggcag

SEQ ID NO: 15926 - DNA, 15 bp, Homo sapiens
tctggaattcaggca

SEQ ID NO: 15927 - DNA, 15 bp, Homo sapiens
ctctggaattcaggc

SEQ ID NO: 15928 - DNA, 15 bp, Homo sapiens
tctctggaattcagg

SEQ ID NO: 15929 - DNA, 15 bp, Homo sapiens
atctctggaattcag

SEQ ID NO: 15930 - DNA, 15 bp, Homo sapiens
tatctctggaattca

SEQ ID NO: 15931 - DNA, 15 bp, Homo sapiens
ctatctctggaattc

SEQ ID NO: 15932 - DNA, 15 bp, Homo sapiens
gctatctctggaatt

SEQ ID NO: 15933 - DNA, 15 bp, Homo sapiens
agctatctctggaat

SEQ ID NO: 15934 - DNA, 15 bp, Homo sapiens
aagctatctctggaa

SEQ ID NO: 15935 - DNA, 15 bp, Homo sapiens
gaagctatctctgga

SEQ ID NO: 15936 - DNA, 15 bp, Homo sapiens
tgaagctatctctgg

SEQ ID NO: 15937 - DNA, 15 bp, Homo sapiens
ttgaagctatctctg

SEQ ID NO: 15938 - DNA, 15 bp, Homo sapiens
tttgaagctatctct

SEQ ID NO: 15939 - DNA, 15 bp, Homo sapiens
ctttgaagctatctc

SEQ ID NO: 15940 - DNA, 15 bp, Homo sapiens
tctttgaagctatct

SEQ ID NO: 15941 - DNA, 15 bp, Homo sapiens
ctctttgaagctatc

SEQ ID NO: 15942 - DNA, 15 bp, Homo sapiens
actctttgaagctat

SEQ ID NO: 15943 - DNA, 15 bp, Homo sapiens
gactctttgaagcta

SEQ ID NO: 15944 - DNA, 15 bp, Homo sapiens
ggactctttgaagct

SEQ ID NO: 15945 - DNA, 15 bp, Homo sapiens
tggactctttgaagc

SEQ ID NO: 15946 - DNA, 15 bp, Homo sapiens
atggactctttgaag

SEQ ID NO: 15947 - DNA, 15 bp, Homo sapiens
catggactctttgaa

SEQ ID NO: 15948 - DNA, 15 bp, Homo sapiens
tcatggactctttga

SEQ ID NO: 15949 - DNA, 15 bp, Homo sapiens
ttcatggactctttg

SEQ ID NO: 15950 - DNA, 15 bp, Homo sapiens
attcatggactcttt

SEQ ID NO: 15951 - DNA, 15 bp, Homo sapiens
gattcatggactctt

SEQ ID NO: 15952 - DNA, 15 bp, Homo sapiens
ggattcatggactct

SEQ ID NO: 15953 - DNA, 15 bp, Homo sapiens
tggattcatggactc

SEQ ID NO: 15954 - DNA, 15 bp, Homo sapiens
gtggattcatggact

SEQ ID NO: 15955 - DNA, 15 bp, Homo sapiens
agtggattcatggac

SEQ ID NO: 15956 - DNA, 15 bp, Homo sapiens
cagtggattcatgga

SEQ ID NO: 15957 - DNA, 15 bp, Homo sapiens
acagtggattcatgg

SEQ ID NO: 15958 - DNA, 15 bp, Homo sapiens
cacagtggattcatg

SEQ ID NO: 15959 - DNA, 15 bp, Homo sapiens
tcacagtggattcat

SEQ ID NO: 15960 - DNA, 15 bp, Homo sapiens
ctcacagtggattca

SEQ ID NO: 15961 - DNA, 15 bp, Homo sapiens
actcacagtggattc

SEQ ID NO: 15962 - DNA, 15 bp, Homo sapiens
gactcacagtggatt

SEQ ID NO: 15963 - DNA, 15 bp, Homo sapiens
ggactcacagtggat

SEQ ID NO: 15964 - DNA, 15 bp, Homo sapiens
tggactcacagtgga

SEQ ID NO: 15965 - DNA, 15 bp, Homo sapiens
ctggactcacagtgg

SEQ ID NO: 15966 - DNA, 15 bp, Homo sapiens
tctggactcacagtg

SEQ ID NO: 15967 - DNA, 15 bp, Homo sapiens
ttctggactcacagt

SEQ ID NO: 15968 - DNA, 15 bp, Homo sapiens
attctggactcacag

SEQ ID NO: 15969 - DNA, 15 bp, Homo sapiens
cattctggactcaca

SEQ ID NO: 15970 - DNA, 15 bp, Homo sapiens
gcattctggactcac

SEQ ID NO: 15971 - DNA, 15 bp, Homo sapiens
agcattctggactca

SEQ ID NO: 15972 - DNA, 15 bp, Homo sapiens
gagcattctggactc

SEQ ID NO: 15973 - DNA, 15 bp, Homo sapiens
ggagcattctggact

SEQ ID NO: 15974 - DNA, 15 bp, Homo sapiens
tggagcattctggac

SEQ ID NO: 15975 - DNA, 15 bp, Homo sapiens
gtggagcattctgga

SEQ ID NO: 15976 - DNA, 15 bp, Homo sapiens
tgtggagcattctgg

SEQ ID NO: 15977 - DNA, 15 bp, Homo sapiens
ctgtggagcattctg

SEQ ID NO: 15978 - DNA, 15 bp, Homo sapiens
tctgtggagcattct

SEQ ID NO: 15979 - DNA, 15 bp, Homo sapiens
gtctgtggagcattc

SEQ ID NO: 15980 - DNA, 15 bp, Homo sapiens
ggtctgtggagcatt

SEQ ID NO: 15981 - DNA, 15 bp, Homo sapiens
aggtctgtggagcat

SEQ ID NO: 15982 - DNA, 15 bp, Homo sapiens
gaggtctgtggagca

SEQ ID NO: 15983 - DNA, 15 bp, Homo sapiens
ggaggtctgtggagc

SEQ ID NO: 15984 - DNA, 15 bp, Homo sapiens
tggaggtctgtggag

SEQ ID NO: 15985 - DNA, 15 bp, Homo sapiens
ttggaggtctgtgga

SEQ ID NO: 15986 - DNA, 15 bp, Homo sapiens
cttggaggtctgtgg

SEQ ID NO: 15987 - DNA, 15 bp, Homo sapiens
ccttggaggtctgtg

SEQ ID NO: 15988 - DNA, 15 bp, Homo sapiens
cccttggaggtctgt

SEQ ID NO: 15989 - DNA, 15 bp, Homo sapiens
acccttggaggtctg

SEQ ID NO: 15990 - DNA, 15 bp, Homo sapiens
gacccttggaggtct

SEQ ID NO: 15991 - DNA, 15 bp, Homo sapiens
tgacccttggaggtc

SEQ ID NO: 15992 - DNA, 15 bp, Homo sapiens
ctgacccttggaggt

SEQ ID NO: 15993 - DNA, 15 bp, Homo sapiens
actgacccttggagg

SEQ ID NO: 15994 - DNA, 15 bp, Homo sapiens
tactgacccttggag

SEQ ID NO: 15995 - DNA, 15 bp, Homo sapiens
atactgacccttgga

SEQ ID NO: 15996 - DNA, 15 bp, Homo sapiens
gatactgacccttgg

SEQ ID NO: 15997 - DNA, 15 bp, Homo sapiens
ggatactgacccttg

SEQ ID NO: 15998 - DNA, 15 bp, Homo sapiens
aggatactgaccctt

SEQ ID NO: 15999 - DNA, 15 bp, Homo sapiens
gaggatactgaccct

SEQ ID NO: 16000 - DNA, 15 bp, Homo sapiens
tgaggatactgaccc

SEQ ID NO: 16001 - DNA, 15 bp, Homo sapiens
gtgaggatactgacc

SEQ ID NO: 16002 - DNA, 15 bp, Homo sapiens
agtgaggatactgac

SEQ ID NO: 16003 - DNA, 15 bp, Homo sapiens
cagtgaggatactga

SEQ ID NO: 16004 - DNA, 15 bp, Homo sapiens
gcagtgaggatactg

SEQ ID NO: 16005 - DNA, 15 bp, Homo sapiens
agcagtgaggatact

SEQ ID NO: 16006 - DNA, 15 bp, Homo sapiens
cagcagtgaggatac

SEQ ID NO: 16007 - DNA, 15 bp, Homo sapiens
acagcagtgaggata

SEQ ID NO: 16008 - DNA, 15 bp, Homo sapiens
tacagcagtgaggat

SEQ ID NO: 16009 - DNA, 15 bp, Homo sapiens
ctacagcagtgagga

SEQ ID NO: 16010 - DNA, 15 bp, Homo sapiens
tctacagcagtgagg

SEQ ID NO: 16011 - DNA, 15 bp, Homo sapiens
atctacagcagtgag

SEQ ID NO: 16012 - DNA, 15 bp, Homo sapiens
aatctacagcagtga

SEQ ID NO: 16013 - DNA, 15 bp, Homo sapiens
taatctacagcagtg

SEQ ID NO: 16014 - DNA, 15 bp, Homo sapiens
ctaatctacagcagt

SEQ ID NO: 16015 - DNA, 15 bp, Homo sapiens
actaatctacagcag

SEQ ID NO: 16016 - DNA, 15 bp, Homo sapiens
cactaatctacagca

SEQ ID NO: 16017 - DNA, 15 bp, Homo sapiens
gcactaatctacagc

SEQ ID NO: 16018 - DNA, 15 bp, Homo sapiens
agcactaatctacag

SEQ ID NO: 16019 - DNA, 15 bp, Homo sapiens
cagcactaatctaca

SEQ ID NO: 16020 - DNA, 15 bp, Homo sapiens
acagcactaatctac

SEQ ID NO: 16021 - DNA, 15 bp, Homo sapiens
aacagcactaatcta

SEQ ID NO: 16022 - DNA, 15 bp, Homo sapiens
aaacagcactaatct

SEQ ID NO: 16023 - DNA, 15 bp, Homo sapiens
aaaacagcactaatc

SEQ ID NO: 16024 - DNA, 15 bp, Homo sapiens
aaaaacagcactaat

SEQ ID NO: 16025 - DNA, 15 bp, Homo sapiens
aaaaaacagcactaa

SEQ ID NO: 16026 - DNA, 15 bp, Homo sapiens
aaaaaaacagcacta

SEQ ID NO: 16027 - DNA, 15 bp, Homo sapiens
caaaaaaacagcact

SEQ ID NO: 16028 - DNA, 15 bp, Homo sapiens
acaaaaaaacagcac

SEQ ID NO: 16029 - DNA, 15 bp, Homo sapiens
aacaaaaaaacagca

SEQ ID NO: 16030 - DNA, 15 bp, Homo sapiens
aaacaaaaaaacagc

SEQ ID NO: 16031 - DNA, 15 bp, Homo sapiens
aaaacaaaaaaacag

SEQ ID NO: 16032 - DNA, 15 bp, Homo sapiens
caaaacaaaaaaaca

SEQ ID NO: 16033 - DNA, 15 bp, Homo sapiens
acaaaacaaaaaaac

SEQ ID NO: 16034 - DNA, 15 bp, Homo sapiens
caaaaaacaaaacaa

SEQ ID NO: 16035 - DNA, 15 bp, Homo sapiens
tcaaaaaacaaaaca

SEQ ID NO: 16036 - DNA, 15 bp, Homo sapiens
ctcaaaaaacaaaac

SEQ ID NO: 16037 - DNA, 15 bp, Homo sapiens
tctcaaaaaacaaaa

SEQ ID NO: 16038 - DNA, 15 bp, Homo sapiens
atctcaaaaaacaaa

SEQ ID NO: 16039 - DNA, 15 bp, Homo sapiens
catctcaaaaaacaa

SEQ ID NO: 16040 - DNA, 15 bp, Homo sapiens
ccatctcaaaaaaca

SEQ ID NO: 16041 - DNA, 15 bp, Homo sapiens
cccatctcaaaaaac

SEQ ID NO: 16042 - DNA, 15 bp, Homo sapiens
tcccatctcaaaaaa

SEQ ID NO: 16043 - DNA, 15 bp, Homo sapiens
ctcccatctcaaaaa

SEQ ID NO: 16044 - DNA, 15 bp, Homo sapiens
actcccatctcaaaa

SEQ ID NO: 16045 - DNA, 15 bp, Homo sapiens
gactcccatctcaaa

SEQ ID NO: 16046 - DNA, 15 bp, Homo sapiens
agactcccatctcaa

SEQ ID NO: 16047 - DNA, 15 bp, Homo sapiens
gagactcccatctca

SEQ ID NO: 16048 - DNA, 15 bp, Homo sapiens
tgagactcccatctc

SEQ ID NO: 16049 - DNA, 15 bp, Homo sapiens
gtgagactcccatct

SEQ ID NO: 16050 - DNA, 15 bp, Homo sapiens
agtgagactcccatc

SEQ ID NO: 16051 - DNA, 15 bp, Homo sapiens
gagtgagactcccat

SEQ ID NO: 16052 - DNA, 15 bp, Homo sapiens
agagtgagactccca

SEQ ID NO: 16053 - DNA, 15 bp, Homo sapiens
cagagtgagactccc

SEQ ID NO: 16054 - DNA, 15 bp, Homo sapiens
acagagtgagactcc

SEQ ID NO: 16055 - DNA, 15 bp, Homo sapiens
aacagagtgagactc

SEQ ID NO: 16056 - DNA, 15 bp, Homo sapiens
taacagagtgagact

SEQ ID NO: 16057 - DNA, 15 bp, Homo sapiens
gtaacagagtgagac

SEQ ID NO: 16058 - DNA, 15 bp, Homo sapiens
ggtaacagagtgaga

SEQ ID NO: 16059 - DNA, 15 bp, Homo sapiens
gggtaacagagtgag

SEQ ID NO: 16060 - DNA, 15 bp, Homo sapiens
cgggtaacagagtga

SEQ ID NO: 16061 - DNA, 15 bp, Homo sapiens
ccgggtaacagagtg

SEQ ID NO: 16062 - DNA, 15 bp, Homo sapiens
cccgggtaacagagt

SEQ ID NO: 16063 - DNA, 15 bp, Homo sapiens
gcccgggtaacagag

SEQ ID NO: 16064 - DNA, 15 bp, Homo sapiens
agcccgggtaacaga

SEQ ID NO: 16065 - DNA, 15 bp, Homo sapiens
cagcccgggtaacag

SEQ ID NO: 16066 - DNA, 15 bp, Homo sapiens
ccagcccgggtaaca

SEQ ID NO: 16067 - DNA, 15 bp, Homo sapiens
tccagcccgggtaac

SEQ ID NO: 16068 - DNA, 15 bp, Homo sapiens
ctccagcccgggtaa

SEQ ID NO: 16069 - DNA, 15 bp, Homo sapiens
actccagcccgggta

SEQ ID NO: 16070 - DNA, 15 bp, Homo sapiens
cactccagcccgggt

SEQ ID NO: 16071 - DNA, 15 bp, Homo sapiens
gcactccagcccggg

SEQ ID NO: 16072 - DNA, 15 bp, Homo sapiens
tgcactccagcccgg

SEQ ID NO: 16073 - DNA, 15 bp, Homo sapiens
ctgcactccagcccg

SEQ ID NO: 16074 - DNA, 15 bp, Homo sapiens
actgcactccagccc

SEQ ID NO: 16075 - DNA, 15 bp, Homo sapiens
gagatcatgccactg

SEQ ID NO: 16076 - DNA, 15 bp, Homo sapiens
tgagatcatgccact

SEQ ID NO: 16077 - DNA, 15 bp, Homo sapiens
ctgagatcatgccac

SEQ ID NO: 16078 - DNA, 15 bp, Homo sapiens
gctgagatcatgcca

SEQ ID NO: 16079 - DNA, 15 bp, Homo sapiens
agctgagatcatgcc

SEQ ID NO: 16080 - DNA, 15 bp, Homo sapiens
gagctgagatcatgc

SEQ ID NO: 16081 - DNA, 15 bp, Homo sapiens
tgagctgagatcatg

SEQ ID NO: 16082 - DNA, 15 bp, Homo sapiens
gtgagctgagatcat

SEQ ID NO: 16083 - DNA, 15 bp, Homo sapiens
agtgagctgagatca

SEQ ID NO: 16084 - DNA, 15 bp, Homo sapiens
ttgggaggtggaggt

SEQ ID NO: 16085 - DNA, 15 bp, Homo sapiens
cttgggaggtggagg

SEQ ID NO: 16086 - DNA, 15 bp, Homo sapiens
gcttgggaggtggag

SEQ ID NO: 16087 - DNA, 15 bp, Homo sapiens
agcttgggaggtgga

SEQ ID NO: 16088 - DNA, 15 bp, Homo sapiens
gagcttgggaggtgg

SEQ ID NO: 16089 - DNA, 15 bp, Homo sapiens
tgagcttgggaggtg

SEQ ID NO: 16090 - DNA, 15 bp, Homo sapiens
ttgagcttgggaggt

SEQ ID NO: 16091 - DNA, 15 bp, Homo sapiens
cttgagcttgggagg

SEQ ID NO: 16092 - DNA, 15 bp, Homo sapiens
gcttgagcttgggag

SEQ ID NO: 16093 - DNA, 15 bp, Homo sapiens
cgcttgagcttggga

SEQ ID NO: 16094 - DNA, 15 bp, Homo sapiens
tcgcttgagcttggg

SEQ ID NO: 16095 - DNA, 15 bp, Homo sapiens
atcgcttgagcttgg

SEQ ID NO: 16096 - DNA, 15 bp, Homo sapiens
gatcgcttgagcttg

SEQ ID NO: 16097 - DNA, 15 bp, Homo sapiens
ggatcgcttgagctt

SEQ ID NO: 16098 - DNA, 15 bp, Homo sapiens
aggatcgcttgagct

SEQ ID NO: 16099 - DNA, 15 bp, Homo sapiens
gaggatcgcttgagc

SEQ ID NO: 16100 - DNA, 15 bp, Homo sapiens
ggaggatcgcttgag

SEQ ID NO: 16101 - DNA, 15 bp, Homo sapiens
gggaggatcgcttga

SEQ ID NO: 16102 - DNA, 15 bp, Homo sapiens
tgggaggatcgcttg

SEQ ID NO: 16103 - DNA, 15 bp, Homo sapiens
gtgggaggatcgctt

SEQ ID NO: 16104 - DNA, 15 bp, Homo sapiens
agtgggaggatcgct

SEQ ID NO: 16105 - DNA, 15 bp, Homo sapiens
aagtgggaggatcgc

SEQ ID NO: 16106 - DNA, 15 bp, Homo sapiens
aaagtgggaggatcg

SEQ ID NO: 16107 - DNA, 15 bp, Homo sapiens
caaagtgggaggatc

SEQ ID NO: 16108 - DNA, 15 bp, Homo sapiens
gcaaagtgggaggat

SEQ ID NO: 16109 - DNA, 15 bp, Homo sapiens
ggcaaagtgggagga

SEQ ID NO: 16110 - DNA, 15 bp, Homo sapiens
gggcaaagtgggagg

SEQ ID NO: 16111 - DNA, 15 bp, Homo sapiens
ggggcaaagtgggag

SEQ ID NO: 16112 - DNA, 15 bp, Homo sapiens
gggggcaaagtggga

SEQ ID NO: 16113 - DNA, 15 bp, Homo sapiens
ggggggcaaagtggg

SEQ ID NO: 16114 - DNA, 15 bp, Homo sapiens
tggggggcaaagtgg

SEQ ID NO: 16115 - DNA, 15 bp, Homo sapiens
ttggggggcaaagtg

SEQ ID NO: 16116 - DNA, 15 bp, Homo sapiens
tttggggggcaaagt

SEQ ID NO: 16117 - DNA, 15 bp, Homo sapiens
atttggggggcaaag

SEQ ID NO: 16118 - DNA, 15 bp, Homo sapiens
tatttggggggcaaa

SEQ ID NO: 16119 - DNA, 15 bp, Homo sapiens
ctatttggggggcaa

SEQ ID NO: 16120 - DNA, 15 bp, Homo sapiens
gctatttggggggca

SEQ ID NO: 16121 - DNA, 15 bp, Homo sapiens
agctatttggggggc

SEQ ID NO: 16122 - DNA, 15 bp, Homo sapiens
cagctatttgggggg

SEQ ID NO: 16123 - DNA, 15 bp, Homo sapiens
ccagctatttggggg

SEQ ID NO: 16124 - DNA, 15 bp, Homo sapiens
accagctatttgggg

SEQ ID NO: 16125 - DNA, 15 bp, Homo sapiens
taccagctatttggg

SEQ ID NO: 16126 - DNA, 15 bp, Homo sapiens
gtaccagctatttgg

SEQ ID NO: 16127 - DNA, 15 bp, Homo sapiens
ggtaccagctatttg

SEQ ID NO: 16128 - DNA, 15 bp, Homo sapiens
tggtaccagctattt

SEQ ID NO: 16129 - DNA, 15 bp, Homo sapiens
gtggtaccagctatt

SEQ ID NO: 16130 - DNA, 15 bp, Homo sapiens
tgtggtaccagctat

SEQ ID NO: 16131 - DNA, 15 bp, Homo sapiens
ctgtggtaccagcta

SEQ ID NO: 16132 - DNA, 15 bp, Homo sapiens
tctgtggtaccagct

SEQ ID NO: 16133 - DNA, 15 bp, Homo sapiens
atctgtggtaccagc

SEQ ID NO: 16134 - DNA, 15 bp, Homo sapiens
catctgtggtaccag

SEQ ID NO: 16135 - DNA, 15 bp, Homo sapiens
gcatctgtggtacca

SEQ ID NO: 16136 - DNA, 15 bp, Homo sapiens
tgcatctgtggtacc

SEQ ID NO: 16137 - DNA, 15 bp, Homo sapiens
atgcatctgtggtac

SEQ ID NO: 16138 - DNA, 15 bp, Homo sapiens
catgcatctgtggta

SEQ ID NO: 16139 - DNA, 15 bp, Homo sapiens
gcatgcatctgtggt

SEQ ID NO: 16140 - DNA, 15 bp, Homo sapiens
ggcatgcatctgtgg

SEQ ID NO: 16141 - DNA, 15 bp, Homo sapiens
tggcatgcatctgtg

SEQ ID NO: 16142 - DNA, 15 bp, Homo sapiens
gtggcatgcatctgt

SEQ ID NO: 16143 - DNA, 15 bp, Homo sapiens
agtggcatgcatctg

SEQ ID NO: 16144 - DNA, 15 bp, Homo sapiens
tagtggcatgcatct

SEQ ID NO: 16145 - DNA, 15 bp, Homo sapiens
gtagtggcatgcatc

SEQ ID NO: 16146 - DNA, 15 bp, Homo sapiens
tgtagtggcatgcat

SEQ ID NO: 16147 - DNA, 15 bp, Homo sapiens
gtgtagtggcatgca

SEQ ID NO: 16148 - DNA, 15 bp, Homo sapiens
agtgtagtggcatgc

SEQ ID NO: 16149 - DNA, 15 bp, Homo sapiens
gagtgtagtggcatg

SEQ ID NO: 16150 - DNA, 15 bp, Homo sapiens
cgagtgtagtggcat

SEQ ID NO: 16151 - DNA, 15 bp, Homo sapiens
gcgagtgtagtggca

SEQ ID NO: 16152 - DNA, 15 bp, Homo sapiens
ggcgagtgtagtggc

SEQ ID NO: 16153 - DNA, 15 bp, Homo sapiens
aggcgagtgtagtgg

SEQ ID NO: 16154 - DNA, 15 bp, Homo sapiens
taggcgagtgtagtg

SEQ ID NO: 16155 - DNA, 15 bp, Homo sapiens
ttaggcgagtgtagt

SEQ ID NO: 16156 - DNA, 15 bp, Homo sapiens
attaggcgagtgtag

SEQ ID NO: 16157 - DNA, 15 bp, Homo sapiens
aattaggcgagtgta

SEQ ID NO: 16158 - DNA, 15 bp, Homo sapiens
aaattaggcgagtgt

SEQ ID NO: 16159 - DNA, 15 bp, Homo sapiens
aaaattaggcgagtg

SEQ ID NO: 16160 - DNA, 15 bp, Homo sapiens
aaaaattaggcgagt

SEQ ID NO: 16161 - DNA, 15 bp, Homo sapiens
taaaaattaggcgag

SEQ ID NO: 16162 - DNA, 15 bp, Homo sapiens
ataaaaattaggcga

SEQ ID NO: 16163 - DNA, 15 bp, Homo sapiens
tataaaaattaggcg

SEQ ID NO: 16164 - DNA, 15 bp, Homo sapiens
atataaaaattaggc

SEQ ID NO: 16165 - DNA, 15 bp, Homo sapiens
aatataaaaattagg

SEQ ID NO: 16166 - DNA, 15 bp, Homo sapiens
aaatataaaaattag

SEQ ID NO: 16167 - DNA, 15 bp, Homo sapiens
aaaatataaaaatta

SEQ ID NO: 16168 - DNA, 15 bp, Homo sapiens
aaaaatataaaaatt

SEQ ID NO: 16169 - DNA, 15 bp, Homo sapiens
aaaaaatataaaaat

SEQ ID NO: 16170 - DNA, 15 bp, Homo sapiens
caaaaaatataaaaa

SEQ ID NO: 16171 - DNA, 15 bp, Homo sapiens
acaaaaaatataaaa

SEQ ID NO: 16172 - DNA, 15 bp, Homo sapiens
tacaaaaaatataaa

SEQ ID NO: 16173 - DNA, 15 bp, Homo sapiens
ctacaaaaaatataa

SEQ ID NO: 16174 - DNA, 15 bp, Homo sapiens
tctacaaaaaatata

SEQ ID NO: 16175 - DNA, 15 bp, Homo sapiens
ctctacaaaaaatat

SEQ ID NO: 16176 - DNA, 15 bp, Homo sapiens
tctctacaaaaaata

SEQ ID NO: 16177 - DNA, 15 bp, Homo sapiens
ctctctacaaaaaat

SEQ ID NO: 16178 - DNA, 15 bp, Homo sapiens
cctctctacaaaaaa

SEQ ID NO: 16179 - DNA, 15 bp, Homo sapiens
ccctctctacaaaaa

SEQ ID NO: 16180 - DNA, 15 bp, Homo sapiens
tccctctctacaaaa

SEQ ID NO: 16181 - DNA, 15 bp, Homo sapiens
ctccctctctacaaa

SEQ ID NO: 16182 - DNA, 15 bp, Homo sapiens
actccctctctacaa

SEQ ID NO: 16183 - DNA, 15 bp, Homo sapiens
aactccctctctaca

SEQ ID NO: 16184 - DNA, 15 bp, Homo sapiens
aaactccctctctac

SEQ ID NO: 16185 - DNA, 15 bp, Homo sapiens
aaaactccctctcta

SEQ ID NO: 16186 - DNA, 15 bp, Homo sapiens
caaaactccctctct

SEQ ID NO: 16187 - DNA, 15 bp, Homo sapiens
gcaaaactccctctc

SEQ ID NO: 16188 - DNA, 15 bp, Homo sapiens
ggcaaaactccctct

SEQ ID NO: 16189 - DNA, 15 bp, Homo sapiens
tggcaaaactccctc

SEQ ID NO: 16190 - DNA, 15 bp, Homo sapiens
atggcaaaactccct

SEQ ID NO: 16191 - DNA, 15 bp, Homo sapiens
catggcaaaactccc

SEQ ID NO: 16192 - DNA, 15 bp, Homo sapiens
acatggcaaaactcc

SEQ ID NO: 16193 - DNA, 15 bp, Homo sapiens
aacatggcaaaactc

SEQ ID NO: 16194 - DNA, 15 bp, Homo sapiens
caacatggcaaaact

SEQ ID NO: 16195 - DNA, 15 bp, Homo sapiens
gcaacatggcaaaac

SEQ ID NO: 16196 - DNA, 15 bp, Homo sapiens
agcaacatggcaaaa

SEQ ID NO: 16197 - DNA, 15 bp, Homo sapiens
gagcaacatggcaaa

SEQ ID NO: 16198 - DNA, 15 bp, Homo sapiens
tgagcaacatggcaa

SEQ ID NO: 16199 - DNA, 15 bp, Homo sapiens
ctgagcaacatggca

SEQ ID NO: 16200 - DNA, 15 bp, Homo sapiens
cctgagcaacatggc

SEQ ID NO: 16201 - DNA, 15 bp, Homo sapiens
gcctgagcaacatgg

SEQ ID NO: 16202 - DNA, 15 bp, Homo sapiens
agcctgagcaacatg

SEQ ID NO: 16203 - DNA, 15 bp, Homo sapiens
tagcctgagcaacat

SEQ ID NO: 16204 - DNA, 15 bp, Homo sapiens
ctagcctgagcaaca

SEQ ID NO: 16205 - DNA, 15 bp, Homo sapiens
actagcctgagcaac

SEQ ID NO: 16206 - DNA, 15 bp, Homo sapiens
gactagcctgagcaa

SEQ ID NO: 16207 - DNA, 15 bp, Homo sapiens
agactagcctgagca

SEQ ID NO: 16208 - DNA, 15 bp, Homo sapiens
gagactagcctgagc

SEQ ID NO: 16209 - DNA, 15 bp, Homo sapiens
tgagactagcctgag

SEQ ID NO: 16210 - DNA, 15 bp, Homo sapiens
ttgagactagcctga

SEQ ID NO: 16211 - DNA, 15 bp, Homo sapiens
tttgagactagcctg

SEQ ID NO: 16212 - DNA, 15 bp, Homo sapiens
gtttgagactagcct

SEQ ID NO: 16213 - DNA, 15 bp, Homo sapiens
agtttgagactagcc

SEQ ID NO: 16214 - DNA, 15 bp, Homo sapiens
gagtttgagactagc

SEQ ID NO: 16215 - DNA, 15 bp, Homo sapiens
ggagtttgagactag

SEQ ID NO: 16216 - DNA, 15 bp, Homo sapiens
aggagtttgagacta

SEQ ID NO: 16217 - DNA, 15 bp, Homo sapiens
caggagtttgagact

SEQ ID NO: 16218 - DNA, 15 bp, Homo sapiens
ctcaggagtttgaga

SEQ ID NO: 16219 - DNA, 15 bp, Homo sapiens
gctcaggagtttgag

SEQ ID NO: 16220 - DNA, 15 bp, Homo sapiens
agctcaggagtttga

SEQ ID NO: 16221 - DNA, 15 bp, Homo sapiens
gagctcaggagtttg

SEQ ID NO: 16222 - DNA, 15 bp, Homo sapiens
tgagctcaggagttt

SEQ ID NO: 16223 - DNA, 15 bp, Homo sapiens
ttgagctcaggagtt

SEQ ID NO: 16224 - DNA, 15 bp, Homo sapiens
cttgagctcaggagt

SEQ ID NO: 16225 - DNA, 15 bp, Homo sapiens
acttgagctcaggag

SEQ ID NO: 16226 - DNA, 15 bp, Homo sapiens
cacttgagctcagga

SEQ ID NO: 16227 - DNA, 15 bp, Homo sapiens
tcacttgagctcagg

SEQ ID NO: 16228 - DNA, 15 bp, Homo sapiens
atcacttgagctcag

SEQ ID NO: 16229 - DNA, 15 bp, Homo sapiens
gatcacttgagctca

SEQ ID NO: 16230 - DNA, 15 bp, Homo sapiens
ggatcacttgagctc

SEQ ID NO: 16231 - DNA, 15 bp, Homo sapiens
aggatcacttgagct

SEQ ID NO: 16232 - DNA, 15 bp, Homo sapiens
caggatcacttgagc

SEQ ID NO: 16233 - DNA, 15 bp, Homo sapiens
gcaggatcacttgag

SEQ ID NO: 16234 - DNA, 15 bp, Homo sapiens
ggcaggatcacttga

SEQ ID NO: 16235 - DNA, 15 bp, Homo sapiens
aggcaggatcacttg

SEQ ID NO: 16236 - DNA, 15 bp, Homo sapiens
aaggcaggatcactt

SEQ ID NO: 16237 - DNA, 15 bp, Homo sapiens
taaggcaggatcact

SEQ ID NO: 16238 - DNA, 15 bp, Homo sapiens
ctaaggcaggatcac

SEQ ID NO: 16239 - DNA, 15 bp, Homo sapiens
gctaaggcaggatca

SEQ ID NO: 16240 - DNA, 15 bp, Homo sapiens
cgctaaggcaggatc

SEQ ID NO: 16241 - DNA, 15 bp, Homo sapiens
acgctaaggcaggat

SEQ ID NO: 16242 - DNA, 15 bp, Homo sapiens
gacgctaaggcagga

SEQ ID NO: 16243 - DNA, 15 bp, Homo sapiens
ggacgctaaggcagg

SEQ ID NO: 16244 - DNA, 15 bp, Homo sapiens
gggacgctaaggcag

SEQ ID NO: 16245 - DNA, 15 bp, Homo sapiens
tgggacgctaaggca

SEQ ID NO: 16246 - DNA, 15 bp, Homo sapiens
ttgggacgctaaggc

SEQ ID NO: 16247 - DNA, 15 bp, Homo sapiens
tttgggacgctaagg

SEQ ID NO: 16248 - DNA, 15 bp, Homo sapiens
ctttgggacgctaag

SEQ ID NO: 16249 - DNA, 15 bp, Homo sapiens
actttgggacgctaa

SEQ ID NO: 16250 - DNA, 15 bp, Homo sapiens
cactttgggacgcta

SEQ ID NO: 16251 - DNA, 15 bp, Homo sapiens
gcactttgggacgct

SEQ ID NO: 16252 - DNA, 15 bp, Homo sapiens
agcactttgggacgc

SEQ ID NO: 16253 - DNA, 15 bp, Homo sapiens
cagcactttgggacg

SEQ ID NO: 16254 - DNA, 15 bp, Homo sapiens
ccagcactttgggac

SEQ ID NO: 16255 - DNA, 15 bp, Homo sapiens
gcacacctgtaatcc

SEQ ID NO: 16256 - DNA, 15 bp, Homo sapiens
ggcacacctgtaatc

SEQ ID NO: 16257 - DNA, 15 bp, Homo sapiens
gggcacacctgtaat

SEQ ID NO: 16258 - DNA, 15 bp, Homo sapiens
tgggcacacctgtaa

SEQ ID NO: 16259 - DNA, 15 bp, Homo sapiens
ctgggcacacctgta

SEQ ID NO: 16260 - DNA, 15 bp, Homo sapiens
gctgggcacacctgt

SEQ ID NO: 16261 - DNA, 15 bp, Homo sapiens
tgctgggcacacctg

SEQ ID NO: 16262 - DNA, 15 bp, Homo sapiens
ctgctgggcacacct

SEQ ID NO: 16263 - DNA, 15 bp, Homo sapiens
gctgctgggcacacc

SEQ ID NO: 16264 - DNA, 15 bp, Homo sapiens
ggctgctgggcacac

SEQ ID NO: 16265 - DNA, 15 bp, Homo sapiens
tggctgctgggcaca

SEQ ID NO: 16266 - DNA, 15 bp, Homo sapiens
atggctgctgggcac

SEQ ID NO: 16267 - DNA, 15 bp, Homo sapiens
tatggctgctgggca

SEQ ID NO: 16268 - DNA, 15 bp, Homo sapiens
atatggctgctgggc

SEQ ID NO: 16269 - DNA, 15 bp, Homo sapiens
aatatggctgctggg

SEQ ID NO: 16270 - DNA, 15 bp, Homo sapiens
aaatatggctgctgg

SEQ ID NO: 16271 - DNA, 15 bp, Homo sapiens
gaaatatggctgctg

SEQ ID NO: 16272 - DNA, 15 bp, Homo sapiens
agaaatatggctgct

SEQ ID NO: 16273 - DNA, 15 bp, Homo sapiens
cagaaatatggctgc

SEQ ID NO: 16274 - DNA, 15 bp, Homo sapiens
tcagaaatatggctg

SEQ ID NO: 16275 - DNA, 15 bp, Homo sapiens
gtcagaaatatggct

SEQ ID NO: 16276 - DNA, 15 bp, Homo sapiens
tgtcagaaatatggc

SEQ ID NO: 16277 - DNA, 15 bp, Homo sapiens
ctgtcagaaatatgg

SEQ ID NO: 16278 - DNA, 15 bp, Homo sapiens
actgtcagaaatatg

SEQ ID NO: 16279 - DNA, 15 bp, Homo sapiens
gactgtcagaaatat

SEQ ID NO: 16280 - DNA, 15 bp, Homo sapiens
ggactgtcagaaata

SEQ ID NO: 16281 - DNA, 15 bp, Homo sapiens
tggactgtcagaaat

SEQ ID NO: 16282 - DNA, 15 bp, Homo sapiens
ttggactgtcagaaa

SEQ ID NO: 16283 - DNA, 15 bp, Homo sapiens
tttggactgtcagaa

SEQ ID NO: 16284 - DNA, 15 bp, Homo sapiens
ttttggactgtcaga

SEQ ID NO: 16285 - DNA, 15 bp, Homo sapiens
attttggactgtcag

SEQ ID NO: 16286 - DNA, 15 bp, Homo sapiens
gattttggactgtca

SEQ ID NO: 16287 - DNA, 15 bp, Homo sapiens
tgattttggactgtc

SEQ ID NO: 16288 - DNA, 15 bp, Homo sapiens
gtgattttggactgt

SEQ ID NO: 16289 - DNA, 15 bp, Homo sapiens
tgtgattttggactg

SEQ ID NO: 16290 - DNA, 15 bp, Homo sapiens
ttgtgattttggact

SEQ ID NO: 16291 - DNA, 15 bp, Homo sapiens
gttgtgattttggac

SEQ ID NO: 16292 - DNA, 15 bp, Homo sapiens
tgttgtgattttgga

SEQ ID NO: 16293 - DNA, 15 bp, Homo sapiens
gtgttgtgattttgg

SEQ ID NO: 16294 - DNA, 15 bp, Homo sapiens
ggtgttgtgattttg

SEQ ID NO: 16295 - DNA, 15 bp, Homo sapiens
gggtgttgtgatttt

SEQ ID NO: 16296 - DNA, 15 bp, Homo sapiens
ggggtgttgtgattt

SEQ ID NO: 16297 - DNA, 15 bp, Homo sapiens
aggggtgttgtgatt

SEQ ID NO: 16298 - DNA, 15 bp, Homo sapiens
caggggtgttgtgat

SEQ ID NO: 16299 - DNA, 15 bp, Homo sapiens
ccaggggtgttgtga

SEQ ID NO: 16300 - DNA, 15 bp, Homo sapiens
cccaggggtgttgtg

SEQ ID NO: 16301 - DNA, 15 bp, Homo sapiens
tcccaggggtgttgt

SEQ ID NO: 16302 - DNA, 15 bp, Homo sapiens
gtcccaggggtgttg

SEQ ID NO: 16303 - DNA, 15 bp, Homo sapiens
ggtcccaggggtgtt

SEQ ID NO: 16304 - DNA, 15 bp, Homo sapiens
tggtcccaggggtgt

SEQ ID NO: 16305 - DNA, 15 bp, Homo sapiens
ttggtcccaggggtg

SEQ ID NO: 16306 - DNA, 15 bp, Homo sapiens
gttggtcccaggggt

SEQ ID NO: 16307 - DNA, 15 bp, Homo sapiens
ggttggtcccagggg

SEQ ID NO: 16308 - DNA, 15 bp, Homo sapiens
tggttggtcccaggg

SEQ ID NO: 16309 - DNA, 15 bp, Homo sapiens
ctggttggtcccagg

SEQ ID NO: 16310 - DNA, 15 bp, Homo sapiens
cctggttggtcccag

SEQ ID NO: 16311 - DNA, 15 bp, Homo sapiens
tcctggttggtccca

SEQ ID NO: 16312 - DNA, 15 bp, Homo sapiens
atcctggttggtccc

SEQ ID NO: 16313 - DNA, 15 bp, Homo sapiens
tatcctggttggtcc

SEQ ID NO: 16314 - DNA, 15 bp, Homo sapiens
ctatcctggttggtc

SEQ ID NO: 16315 - DNA, 15 bp, Homo sapiens
actatcctggttggt

SEQ ID NO: 16316 - DNA, 15 bp, Homo sapiens
gactatcctggttgg

SEQ ID NO: 16317 - DNA, 15 bp, Homo sapiens
agactatcctggttg

SEQ ID NO: 16318 - DNA, 15 bp, Homo sapiens
tagactatcctggtt

SEQ ID NO: 16319 - DNA, 15 bp, Homo sapiens
ctagactatcctggt

SEQ ID NO: 16320 - DNA, 15 bp, Homo sapiens
cctagactatcctgg

SEQ ID NO: 16321 - DNA, 15 bp, Homo sapiens
acctagactatcctg

SEQ ID NO: 16322 - DNA, 15 bp, Homo sapiens
cacctagactatcct

SEQ ID NO: 16323 - DNA, 15 bp, Homo sapiens
ccacctagactatcc

SEQ ID NO: 16324 - DNA, 15 bp, Homo sapiens
cccacctagactatc

SEQ ID NO: 16325 - DNA, 15 bp, Homo sapiens
acccacctagactat

SEQ ID NO: 16326 - DNA, 15 bp, Homo sapiens
aacccacctagacta

SEQ ID NO: 16327 - DNA, 15 bp, Homo sapiens
caacccacctagact

SEQ ID NO: 16328 - DNA, 15 bp, Homo sapiens
acaacccacctagac

SEQ ID NO: 16329 - DNA, 15 bp, Homo sapiens
aacaacccacctaga

SEQ ID NO: 16330 - DNA, 15 bp, Homo sapiens
aaacaacccacctag

SEQ ID NO: 16331 - DNA, 15 bp, Homo sapiens
caaacaacccaccta

SEQ ID NO: 16332 - DNA, 15 bp, Homo sapiens
acaaacaacccacct

SEQ ID NO: 16333 - DNA, 15 bp, Homo sapiens
aacaaacaacccacc

SEQ ID NO: 16334 - DNA, 15 bp, Homo sapiens
aaacaaacaacccac

SEQ ID NO: 16335 - DNA, 15 bp, Homo sapiens
aaaacaaacaaccca

SEQ ID NO: 16336 - DNA, 15 bp, Homo sapiens
caaaacaaacaaccc

SEQ ID NO: 16337 - DNA, 15 bp, Homo sapiens
ccaaaacaaacaacc

SEQ ID NO: 16338 - DNA, 15 bp, Homo sapiens
gccaaaacaaacaac

SEQ ID NO: 16339 - DNA, 15 bp, Homo sapiens
agccaaaacaaacaa

SEQ ID NO: 16340 - DNA, 15 bp, Homo sapiens
tagccaaaacaaaca

SEQ ID NO: 16341 - DNA, 15 bp, Homo sapiens
atagccaaaacaaac

SEQ ID NO: 16342 - DNA, 15 bp, Homo sapiens
aatagccaaaacaaa

SEQ ID NO: 16343 - DNA, 15 bp, Homo sapiens
aaatagccaaaacaa

SEQ ID NO: 16344 - DNA, 15 bp, Homo sapiens
gaaatagccaaaaca

SEQ ID NO: 16345 - DNA, 15 bp, Homo sapiens
tgaaatagccaaaac

SEQ ID NO: 16346 - DNA, 15 bp, Homo sapiens
gtgaaatagccaaaa

SEQ ID NO: 16347 - DNA, 15 bp, Homo sapiens
agtgaaatagccaaa

SEQ ID NO: 16348 - DNA, 15 bp, Homo sapiens
aagtgaaatagccaa

SEQ ID NO: 16349 - DNA, 15 bp, Homo sapiens
taagtgaaatagcca

SEQ ID NO: 16350 - DNA, 15 bp, Homo sapiens
ctaagtgaaatagcc

SEQ ID NO: 16351 - DNA, 15 bp, Homo sapiens
tctaagtgaaatagc

SEQ ID NO: 16352 - DNA, 15 bp, Homo sapiens
ctctaagtgaaatag

SEQ ID NO: 16353 - DNA, 15 bp, Homo sapiens
tctctaagtgaaata

SEQ ID NO: 16354 - DNA, 15 bp, Homo sapiens
ctctctaagtgaaat

SEQ ID NO: 16355 - DNA, 15 bp, Homo sapiens
actctctaagtgaaa

SEQ ID NO: 16356 - DNA, 15 bp, Homo sapiens
gactctctaagtgaa

SEQ ID NO: 16357 - DNA, 15 bp, Homo sapiens
tgactctctaagtga

SEQ ID NO: 16358 - DNA, 15 bp, Homo sapiens
atgactctctaagtg

SEQ ID NO: 16359 - DNA, 15 bp, Homo sapiens
aatgactctctaagt

SEQ ID NO: 16360 - DNA, 15 bp, Homo sapiens
caatgactctctaag

SEQ ID NO: 16361 - DNA, 15 bp, Homo sapiens
gcaatgactctctaa

SEQ ID NO: 16362 - DNA, 15 bp, Homo sapiens
tgcaatgactctcta

SEQ ID NO: 16363 - DNA, 15 bp, Homo sapiens
atgcaatgactctct

SEQ ID NO: 16364 - DNA, 15 bp, Homo sapiens
tatgcaatgactctc

SEQ ID NO: 16365 - DNA, 15 bp, Homo sapiens
gtatgcaatgactct

SEQ ID NO: 16366 - DNA, 15 bp, Homo sapiens
agtatgcaatgactc

SEQ ID NO: 16367 - DNA, 15 bp, Homo sapiens
cagtatgcaatgact

SEQ ID NO: 16368 - DNA, 15 bp, Homo sapiens
acagtatgcaatgac

SEQ ID NO: 16369 - DNA, 15 bp, Homo sapiens
aacagtatgcaatga

SEQ ID NO: 16370 - DNA, 15 bp, Homo sapiens
taacagtatgcaatg

SEQ ID NO: 16371 - DNA, 15 bp, Homo sapiens
ataacagtatgcaat

SEQ ID NO: 16372 - DNA, 15 bp, Homo sapiens
aataacagtatgcaa

SEQ ID NO: 16373 - DNA, 15 bp, Homo sapiens
gaataacagtatgca

SEQ ID NO: 16374 - DNA, 15 bp, Homo sapiens
tgaataacagtatgc

SEQ ID NO: 16375 - DNA, 15 bp, Homo sapiens
ctgaataacagtatg

SEQ ID NO: 16376 - DNA, 15 bp, Homo sapiens
tctgaataacagtat

SEQ ID NO: 16377 - DNA, 15 bp, Homo sapiens
atctgaataacagta

SEQ ID NO: 16378 - DNA, 15 bp, Homo sapiens
aatctgaataacagt

SEQ ID NO: 16379 - DNA, 15 bp, Homo sapiens
taatctgaataacag

SEQ ID NO: 16380 - DNA, 15 bp, Homo sapiens
ataatctgaataaca

SEQ ID NO: 16381 - DNA, 15 bp, Homo sapiens
gataatctgaataac

SEQ ID NO: 16382 - DNA, 15 bp, Homo sapiens
agataatctgaataa

SEQ ID NO: 16383 - DNA, 15 bp, Homo sapiens
cagataatctgaata

SEQ ID NO: 16384 - DNA, 15 bp, Homo sapiens
ccagataatctgaat

SEQ ID NO: 16385 - DNA, 15 bp, Homo sapiens
gccagataatctgaa

SEQ ID NO: 16386 - DNA, 15 bp, Homo sapiens
agccagataatctga

SEQ ID NO: 16387 - DNA, 15 bp, Homo sapiens
aagccagataatctg

SEQ ID NO: 16388 - DNA, 15 bp, Homo sapiens
aaagccagataatct

SEQ ID NO: 16389 - DNA, 15 bp, Homo sapiens
aaaagccagataatc

SEQ ID NO: 16390 - DNA, 15 bp, Homo sapiens
gaaaagccagataat

SEQ ID NO: 16391 - DNA, 15 bp, Homo sapiens
tgaaaagccagataa

SEQ ID NO: 16392 - DNA, 15 bp, Homo sapiens
atgaaaagccagata

SEQ ID NO: 16393 - DNA, 15 bp, Homo sapiens
tatgaaaagccagat

SEQ ID NO: 16394 - DNA, 15 bp, Homo sapiens
gtatgaaaagccaga

SEQ ID NO: 16395 - DNA, 15 bp, Homo sapiens
ggtatgaaaagccag

SEQ ID NO: 16396 - DNA, 15 bp, Homo sapiens
gggtatgaaaagcca

SEQ ID NO: 16397 - DNA, 15 bp, Homo sapiens
agggtatgaaaagcc

SEQ ID NO: 16398 - DNA, 15 bp, Homo sapiens
aagggtatgaaaagc

SEQ ID NO: 16399 - DNA, 15 bp, Homo sapiens
gaagggtatgaaaag

SEQ ID NO: 16400 - DNA, 15 bp, Homo sapiens
agaagggtatgaaaa

SEQ ID NO: 16401 - DNA, 15 bp, Homo sapiens
cagaagggtatgaaa

SEQ ID NO: 16402 - DNA, 15 bp, Homo sapiens
tcagaagggtatgaa

SEQ ID NO: 16403 - DNA, 15 bp, Homo sapiens
ctcagaagggtatga

SEQ ID NO: 16404 - DNA, 15 bp, Homo sapiens
actcagaagggtatg

SEQ ID NO: 16405 - DNA, 15 bp, Homo sapiens
aactcagaagggtat

SEQ ID NO: 16406 - DNA, 15 bp, Homo sapiens
taactcagaagggta

SEQ ID NO: 16407 - DNA, 15 bp, Homo sapiens
ttaactcagaagggt

SEQ ID NO: 16408 - DNA, 15 bp, Homo sapiens
cttaactcagaaggg

SEQ ID NO: 16409 - DNA, 15 bp, Homo sapiens
acttaactcagaagg

SEQ ID NO: 16410 - DNA, 15 bp, Homo sapiens
tacttaactcagaag

SEQ ID NO: 16411 - DNA, 15 bp, Homo sapiens
atacttaactcagaa

SEQ ID NO: 16412 - DNA, 15 bp, Homo sapiens
tatacttaactcaga

SEQ ID NO: 16413 - DNA, 15 bp, Homo sapiens
gtatacttaactcag

SEQ ID NO: 16414 - DNA, 15 bp, Homo sapiens
agtatacttaactca

SEQ ID NO: 16415 - DNA, 15 bp, Homo sapiens
tagtatacttaactc

SEQ ID NO: 16416 - DNA, 15 bp, Homo sapiens
atagtatacttaact

SEQ ID NO: 16417 - DNA, 15 bp, Homo sapiens
aatagtatacttaac

SEQ ID NO: 16418 - DNA, 15 bp, Homo sapiens
aaatagtatacttaa

SEQ ID NO: 16419 - DNA, 15 bp, Homo sapiens
taaatagtatactta

SEQ ID NO: 16420 - DNA, 15 bp, Homo sapiens
gtaaatagtatactt

SEQ ID NO: 16421 - DNA, 15 bp, Homo sapiens
agtaaatagtatact

SEQ ID NO: 16422 - DNA, 15 bp, Homo sapiens
aagtaaatagtatac

SEQ ID NO: 16423 - DNA, 15 bp, Homo sapiens
aaagtaaatagtata

SEQ ID NO: 16424 - DNA, 15 bp, Homo sapiens
caaagtaaatagtat

SEQ ID NO: 16425 - DNA, 15 bp, Homo sapiens
acaaagtaaatagta

SEQ ID NO: 16426 - DNA, 15 bp, Homo sapiens
aacaaagtaaatagt

SEQ ID NO: 16427 - DNA, 15 bp, Homo sapiens
caacaaagtaaatag

SEQ ID NO: 16428 - DNA, 15 bp, Homo sapiens
gcaacaaagtaaata

SEQ ID NO: 16429 - DNA, 15 bp, Homo sapiens
agcaacaaagtaaat

SEQ ID NO: 16430 - DNA, 15 bp, Homo sapiens
tagcaacaaagtaaa

SEQ ID NO: 16431 - DNA, 15 bp, Homo sapiens
atagcaacaaagtaa

SEQ ID NO: 16432 - DNA, 15 bp, Homo sapiens
aatagcaacaaagta

SEQ ID NO: 16433 - DNA, 15 bp, Homo sapiens
aaatagcaacaaagt

SEQ ID NO: 16434 - DNA, 15 bp, Homo sapiens
caaatagcaacaaag

SEQ ID NO: 16435 - DNA, 15 bp, Homo sapiens
acaaatagcaacaaa

SEQ ID NO: 16436 - DNA, 15 bp, Homo sapiens
cacaaatagcaacaa

SEQ ID NO: 16437 - DNA, 15 bp, Homo sapiens
tcacaaatagcaaca

SEQ ID NO: 16438 - DNA, 15 bp, Homo sapiens
ttcacaaatagcaac

SEQ ID NO: 16439 - DNA, 15 bp, Homo sapiens
attcacaaatagcaa

SEQ ID NO: 16440 - DNA, 15 bp, Homo sapiens
aattcacaaatagca

SEQ ID NO: 16441 - DNA, 15 bp, Homo sapiens
taattcacaaatagc

SEQ ID NO: 16442 - DNA, 15 bp, Homo sapiens
ataattcacaaatag

SEQ ID NO: 16443 - DNA, 15 bp, Homo sapiens
gataattcacaaata

SEQ ID NO: 16444 - DNA, 15 bp, Homo sapiens
agataattcacaaat

SEQ ID NO: 16445 - DNA, 15 bp, Homo sapiens
gagataattcacaaa

SEQ ID NO: 16446 - DNA, 15 bp, Homo sapiens
tgagataattcacaa

SEQ ID NO: 16447 - DNA, 15 bp, Homo sapiens
atgagataattcaca

SEQ ID NO: 16448 - DNA, 15 bp, Homo sapiens
tatgagataattcac

SEQ ID NO: 16449 - DNA, 15 bp, Homo sapiens
ctatgagataattca

SEQ ID NO: 16450 - DNA, 15 bp, Homo sapiens
actatgagataattc

SEQ ID NO: 16451 - DNA, 15 bp, Homo sapiens
tactatgagataatt

SEQ ID NO: 16452 - DNA, 15 bp, Homo sapiens
ttactatgagataat

SEQ ID NO: 16453 - DNA, 15 bp, Homo sapiens
attactatgagataa

SEQ ID NO: 16454 - DNA, 15 bp, Homo sapiens
tattactatgagata

SEQ ID NO: 16455 - DNA, 15 bp, Homo sapiens
atattactatgagat

SEQ ID NO: 16456 - DNA, 15 bp, Homo sapiens
catattactatgaga

SEQ ID NO: 16457 - DNA, 15 bp, Homo sapiens
gcatattactatgag

SEQ ID NO: 16458 - DNA, 15 bp, Homo sapiens
agcatattactatga

SEQ ID NO: 16459 - DNA, 15 bp, Homo sapiens
aagcatattactatg

SEQ ID NO: 16460 - DNA, 15 bp, Homo sapiens
aaagcatattactat

SEQ ID NO: 16461 - DNA, 15 bp, Homo sapiens
aaaagcatattacta

SEQ ID NO: 16462 - DNA, 15 bp, Homo sapiens
taaaagcatattact

SEQ ID NO: 16463 - DNA, 15 bp, Homo sapiens
ataaaagcatattac

SEQ ID NO: 16464 - DNA, 15 bp, Homo sapiens
tataaaagcatatta

SEQ ID NO: 16465 - DNA, 15 bp, Homo sapiens
atataaaagcatatt

SEQ ID NO: 16466 - DNA, 15 bp, Homo sapiens
aatataaaagcatat

SEQ ID NO: 16467 - DNA, 15 bp, Homo sapiens
caatataaaagcata

SEQ ID NO: 16468 - DNA, 15 bp, Homo sapiens
tcaatataaaagcat

SEQ ID NO: 16469 - DNA, 15 bp, Homo sapiens
gtcaatataaaagca

SEQ ID NO: 16470 - DNA, 15 bp, Homo sapiens
agtcaatataaaagc

SEQ ID NO: 16471 - DNA, 15 bp, Homo sapiens
aagtcaatataaaag

SEQ ID NO: 16472 - DNA, 15 bp, Homo sapiens
caagtcaatataaaa

SEQ ID NO: 16473 - DNA, 15 bp, Homo sapiens
ccaagtcaatataaa

SEQ ID NO: 16474 - DNA, 15 bp, Homo sapiens
cccaagtcaatataa

SEQ ID NO: 16475 - DNA, 15 bp, Homo sapiens
tcccaagtcaatata

SEQ ID NO: 16476 - DNA, 15 bp, Homo sapiens
ttcccaagtcaatat

SEQ ID NO: 16477 - DNA, 15 bp, Homo sapiens
cttcccaagtcaata

SEQ ID NO: 16478 - DNA, 15 bp, Homo sapiens
ccttcccaagtcaat

SEQ ID NO: 16479 - DNA, 15 bp, Homo sapiens
cccttcccaagtcaa

SEQ ID NO: 16480 - DNA, 15 bp, Homo sapiens
acccttcccaagtca

SEQ ID NO: 16481 - DNA, 15 bp, Homo sapiens
cacccttcccaagtc

SEQ ID NO: 16482 - DNA, 15 bp, Homo sapiens
acacccttcccaagt

SEQ ID NO: 16483 - DNA, 15 bp, Homo sapiens
cacacccttcccaag

SEQ ID NO: 16484 - DNA, 15 bp, Homo sapiens
gcacacccttcccaa

SEQ ID NO: 16485 - DNA, 15 bp, Homo sapiens
agcacacccttccca

SEQ ID NO: 16486 - DNA, 15 bp, Homo sapiens
aagcacacccttccc

SEQ ID NO: 16487 - DNA, 15 bp, Homo sapiens
aaagcacacccttcc

SEQ ID NO: 16488 - DNA, 15 bp, Homo sapiens
caaagcacacccttc

SEQ ID NO: 16489 - DNA, 15 bp, Homo sapiens
acaaagcacaccctt

SEQ ID NO: 16490 - DNA, 15 bp, Homo sapiens
gacaaagcacaccct

SEQ ID NO: 16491 - DNA, 15 bp, Homo sapiens
agacaaagcacaccc

SEQ ID NO: 16492 - DNA, 15 bp, Homo sapiens
aagacaaagcacacc

SEQ ID NO: 16493 - DNA, 15 bp, Homo sapiens
aaagacaaagcacac

SEQ ID NO: 16494 - DNA, 15 bp, Homo sapiens
taaagacaaagcaca

SEQ ID NO: 16495 - DNA, 15 bp, Homo sapiens
ataaagacaaagcac

SEQ ID NO: 16496 - DNA, 15 bp, Homo sapiens
aataaagacaaagca

SEQ ID NO: 16497 - DNA, 15 bp, Homo sapiens
caataaagacaaagc

SEQ ID NO: 16498 - DNA, 15 bp, Homo sapiens
acaataaagacaaag

SEQ ID NO: 16499 - DNA, 15 bp, Homo sapiens
gacaataaagacaaa

SEQ ID NO: 16500 - DNA, 15 bp, Homo sapiens
agacaataaagacaa

SEQ ID NO: 16501 - DNA, 15 bp, Homo sapiens
aagacaataaagaca

SEQ ID NO: 16502 - DNA, 15 bp, Homo sapiens
taagacaataaagac

SEQ ID NO: 16503 - DNA, 15 bp, Homo sapiens
gtaagacaataaaga

SEQ ID NO: 16504 - DNA, 15 bp, Homo sapiens
agtaagacaataaag

SEQ ID NO: 16505 - DNA, 15 bp, Homo sapiens
gagtaagacaataaa

SEQ ID NO: 16506 - DNA, 15 bp, Homo sapiens
tgagtaagacaataa

SEQ ID NO: 16507 - DNA, 15 bp, Homo sapiens
atgagtaagacaata

SEQ ID NO: 16508 - DNA, 15 bp, Homo sapiens
aatgagtaagacaat

SEQ ID NO: 16509 - DNA, 15 bp, Homo sapiens
aaatgagtaagacaa

SEQ ID NO: 16510 - DNA, 15 bp, Homo sapiens
aaaatgagtaagaca

SEQ ID NO: 16511 - DNA, 15 bp, Homo sapiens
taaaatgagtaagac

SEQ ID NO: 16512 - DNA, 15 bp, Homo sapiens
ttaaaatgagtaaga

SEQ ID NO: 16513 - DNA, 15 bp, Homo sapiens
attaaaatgagtaag

SEQ ID NO: 16514 - DNA, 15 bp, Homo sapiens
cattaaaatgagtaa

SEQ ID NO: 16515 - DNA, 15 bp, Homo sapiens
tcattaaaatgagta

SEQ ID NO: 16516 - DNA, 15 bp, Homo sapiens
ttcattaaaatgagt

SEQ ID NO: 16517 - DNA, 15 bp, Homo sapiens
attcattaaaatgag

SEQ ID NO: 16518 - DNA, 15 bp, Homo sapiens
aattcattaaaatga

SEQ ID NO: 16519 - DNA, 15 bp, Homo sapiens
caattcattaaaatg

SEQ ID NO: 16520 - DNA, 15 bp, Homo sapiens
tcaattcattaaaat

SEQ ID NO: 16521 - DNA, 15 bp, Homo sapiens
ttcaattcattaaaa

SEQ ID NO: 16522 - DNA, 15 bp, Homo sapiens
tttcaattcattaaa

SEQ ID NO: 16523 - DNA, 15 bp, Homo sapiens
ctttcaattcattaa

SEQ ID NO: 16524 - DNA, 15 bp, Homo sapiens
tctttcaattcatta

SEQ ID NO: 16525 - DNA, 15 bp, Homo sapiens
ctctttcaattcatt

SEQ ID NO: 16526 - DNA, 15 bp, Homo sapiens
gctctttcaattcat

SEQ ID NO: 16527 - DNA, 15 bp, Homo sapiens
agctctttcaattca

SEQ ID NO: 16528 - DNA, 15 bp, Homo sapiens
cagctctttcaattc

SEQ ID NO: 16529 - DNA, 15 bp, Homo sapiens
gcagctctttcaatt

SEQ ID NO: 16530 - DNA, 15 bp, Homo sapiens
tgcagctctttcaat

SEQ ID NO: 16531 - DNA, 15 bp, Homo sapiens
atgcagctctttcaa

SEQ ID NO: 16532 - DNA, 15 bp, Homo sapiens
aatgcagctctttca

SEQ ID NO: 16533 - DNA, 15 bp, Homo sapiens
gaatgcagctctttc

SEQ ID NO: 16534 - DNA, 15 bp, Homo sapiens
ggaatgcagctcttt

SEQ ID NO: 16535 - DNA, 15 bp, Homo sapiens
aggaatgcagctctt

SEQ ID NO: 16536 - DNA, 15 bp, Homo sapiens
aaggaatgcagctct

SEQ ID NO: 16537 - DNA, 15 bp, Homo sapiens
taaggaatgcagctc

SEQ ID NO: 16538 - DNA, 15 bp, Homo sapiens
ttaaggaatgcagct

SEQ ID NO: 16539 - DNA, 15 bp, Homo sapiens
gttaaggaatgcagc

SEQ ID NO: 16540 - DNA, 15 bp, Homo sapiens
ggttaaggaatgcag

SEQ ID NO: 16541 - DNA, 15 bp, Homo sapiens
gggttaaggaatgca

SEQ ID NO: 16542 - DNA, 15 bp, Homo sapiens
tgggttaaggaatgc

SEQ ID NO: 16543 - DNA, 15 bp, Homo sapiens
atgggttaaggaatg

SEQ ID NO: 16544 - DNA, 15 bp, Homo sapiens
catgggttaaggaat

SEQ ID NO: 16545 - DNA, 15 bp, Homo sapiens
gcatgggttaaggaa

SEQ ID NO: 16546 - DNA, 15 bp, Homo sapiens
agcatgggttaagga

SEQ ID NO: 16547 - DNA, 15 bp, Homo sapiens
gagcatgggttaagg

SEQ ID NO: 16548 - DNA, 15 bp, Homo sapiens
agagcatgggttaag

SEQ ID NO: 16549 - DNA, 15 bp, Homo sapiens
tagagcatgggttaa

SEQ ID NO: 16550 - DNA, 15 bp, Homo sapiens
gtagagcatgggtta

SEQ ID NO: 16551 - DNA, 15 bp, Homo sapiens
tgtagagcatgggtt

SEQ ID NO: 16552 - DNA, 15 bp, Homo sapiens
ttgtagagcatgggt

SEQ ID NO: 16553 - DNA, 15 bp, Homo sapiens
gttgtagagcatggg

SEQ ID NO: 16554 - DNA, 15 bp, Homo sapiens
agttgtagagcatgg

SEQ ID NO: 16555 - DNA, 15 bp, Homo sapiens
aagttgtagagcatg

SEQ ID NO: 16556 - DNA, 15 bp, Homo sapiens
aaagttgtagagcat

SEQ ID NO: 16557 - DNA, 15 bp, Homo sapiens
caaagttgtagagca

SEQ ID NO: 16558 - DNA, 15 bp, Homo sapiens
ccaaagttgtagagc

SEQ ID NO: 16559 - DNA, 15 bp, Homo sapiens
gccaaagttgtagag

SEQ ID NO: 16560 - DNA, 15 bp, Homo sapiens
ggccaaagttgtaga

SEQ ID NO: 16561 - DNA, 15 bp, Homo sapiens
aggccaaagttgtag

SEQ ID NO: 16562 - DNA, 15 bp, Homo sapiens
gaggccaaagttgta

SEQ ID NO: 16563 - DNA, 15 bp, Homo sapiens
agaggccaaagttgt

SEQ ID NO: 16564 - DNA, 15 bp, Homo sapiens
cagaggccaaagttg

SEQ ID NO: 16565 - DNA, 15 bp, Homo sapiens
tcagaggccaaagtt

SEQ ID NO: 16566 - DNA, 15 bp, Homo sapiens
ttcagaggccaaagt

SEQ ID NO: 16567 - DNA, 15 bp, Homo sapiens
tttcagaggccaaag

SEQ ID NO: 16568 - DNA, 15 bp, Homo sapiens
ctttcagaggccaaa

SEQ ID NO: 16569 - DNA, 15 bp, Homo sapiens
cctttcagaggccaa

SEQ ID NO: 16570 - DNA, 15 bp, Homo sapiens
tcctttcagaggcca

SEQ ID NO: 16571 - DNA, 15 bp, Homo sapiens
ttcctttcagaggcc

SEQ ID NO: 16572 - DNA, 15 bp, Homo sapiens
tttcctttcagaggc

SEQ ID NO: 16573 - DNA, 15 bp, Homo sapiens
atttcctttcagagg

SEQ ID NO: 16574 - DNA, 15 bp, Homo sapiens
aatttcctttcagag

SEQ ID NO: 16575 - DNA, 15 bp, Homo sapiens
caatttcctttcaga

SEQ ID NO: 16576 - DNA, 15 bp, Homo sapiens
gcaatttcctttcag

SEQ ID NO: 16577 - DNA, 15 bp, Homo sapiens
ggcaatttcctttca

SEQ ID NO: 16578 - DNA, 15 bp, Homo sapiens
aggcaatttcctttc

SEQ ID NO: 16579 - DNA, 15 bp, Homo sapiens
aaggcaatttccttt

SEQ ID NO: 16580 - DNA, 15 bp, Homo sapiens
caaggcaatttcctt

SEQ ID NO: 16581 - DNA, 15 bp, Homo sapiens
acaaggcaatttcct

SEQ ID NO: 16582 - DNA, 15 bp, Homo sapiens
gacaaggcaatttcc

SEQ ID NO: 16583 - DNA, 15 bp, Homo sapiens
ggacaaggcaatttc

SEQ ID NO: 16584 - DNA, 15 bp, Homo sapiens
aggacaaggcaattt

SEQ ID NO: 16585 - DNA, 15 bp, Homo sapiens
taggacaaggcaatt

SEQ ID NO: 16586 - DNA, 15 bp, Homo sapiens
ataggacaaggcaat

SEQ ID NO: 16587 - DNA, 15 bp, Homo sapiens
aataggacaaggcaa

SEQ ID NO: 16588 - DNA, 15 bp, Homo sapiens
gaataggacaaggca

SEQ ID NO: 16589 - DNA, 15 bp, Homo sapiens
agaataggacaaggc

SEQ ID NO: 16590 - DNA, 15 bp, Homo sapiens
gagaataggacaagg

SEQ ID NO: 16591 - DNA, 15 bp, Homo sapiens
agagaataggacaag

SEQ ID NO: 16592 - DNA, 15 bp, Homo sapiens
gagagaataggacaa

SEQ ID NO: 16593 - DNA, 15 bp, Homo sapiens
tgagagaataggaca

SEQ ID NO: 16594 - DNA, 15 bp, Homo sapiens
atgagagaataggac

SEQ ID NO: 16595 - DNA, 15 bp, Homo sapiens
gatgagagaatagga

SEQ ID NO: 16596 - DNA, 15 bp, Homo sapiens
ggatgagagaatagg

SEQ ID NO: 16597 - DNA, 15 bp, Homo sapiens
tggatgagagaatag

SEQ ID NO: 16598 - DNA, 15 bp, Homo sapiens
ctggatgagagaata

SEQ ID NO: 16599 - DNA, 15 bp, Homo sapiens
tctggatgagagaat

SEQ ID NO: 16600 - DNA, 15 bp, Homo sapiens
ttctggatgagagaa

SEQ ID NO: 16601 - DNA, 15 bp, Homo sapiens
tttctggatgagaga

SEQ ID NO: 16602 - DNA, 15 bp, Homo sapiens
atttctggatgagag

SEQ ID NO: 16603 - DNA, 15 bp, Homo sapiens
aatttctggatgaga

SEQ ID NO: 16604 - DNA, 15 bp, Homo sapiens
aaatttctggatgag

SEQ ID NO: 16605 - DNA, 15 bp, Homo sapiens
aaaatttctggatga

SEQ ID NO: 16606 - DNA, 15 bp, Homo sapiens
aaaaatttctggatg

SEQ ID NO: 16607 - DNA, 15 bp, Homo sapiens
caaaaatttctggat

SEQ ID NO: 16608 - DNA, 15 bp, Homo sapiens
acaaaaatttctgga

SEQ ID NO: 16609 - DNA, 15 bp, Homo sapiens
aacaaaaatttctgg

SEQ ID NO: 16610 - DNA, 15 bp, Homo sapiens
caacaaaaatttctg

SEQ ID NO: 16611 - DNA, 15 bp, Homo sapiens
acaacaaaaatttct

SEQ ID NO: 16612 - DNA, 15 bp, Homo sapiens
aacaacaaaaatttc

SEQ ID NO: 16613 - DNA, 15 bp, Homo sapiens
gaacaacaaaaattt

SEQ ID NO: 16614 - DNA, 15 bp, Homo sapiens
ggaacaacaaaaatt

SEQ ID NO: 16615 - DNA, 15 bp, Homo sapiens
aggaacaacaaaaat

SEQ ID NO: 16616 - DNA, 15 bp, Homo sapiens
gaggaacaacaaaaa

SEQ ID NO: 16617 - DNA, 15 bp, Homo sapiens
ggaggaacaacaaaa

SEQ ID NO: 16618 - DNA, 15 bp, Homo sapiens
tggaggaacaacaaa

SEQ ID NO: 16619 - DNA, 15 bp, Homo sapiens
ctggaggaacaacaa

SEQ ID NO: 16620 - DNA, 15 bp, Homo sapiens
tctggaggaacaaca

SEQ ID NO: 16621 - DNA, 15 bp, Homo sapiens
ttctggaggaacaac

SEQ ID NO: 16622 - DNA, 15 bp, Homo sapiens
tttctggaggaacaa

SEQ ID NO: 16623 - DNA, 15 bp, Homo sapiens
ttttctggaggaaca

SEQ ID NO: 16624 - DNA, 15 bp, Homo sapiens
tttttctggaggaac

SEQ ID NO: 16625 - DNA, 15 bp, Homo sapiens
ttttttctggaggaa

SEQ ID NO: 16626 - DNA, 15 bp, Homo sapiens
tttttttctggagga

SEQ ID NO: 16627 - DNA, 15 bp, Homo sapiens
ctttttttctggagg

SEQ ID NO: 16628 - DNA, 15 bp, Homo sapiens
cctttttttctggag

SEQ ID NO: 16629 - DNA, 15 bp, Homo sapiens
tcctttttttctgga

SEQ ID NO: 16630 - DNA, 15 bp, Homo sapiens
atcctttttttctgg

SEQ ID NO: 16631 - DNA, 15 bp, Homo sapiens
tatcctttttttctg

SEQ ID NO: 16632 - DNA, 15 bp, Homo sapiens
ctatcctttttttct

SEQ ID NO: 16633 - DNA, 15 bp, Homo sapiens
actatcctttttttc

SEQ ID NO: 16634 - DNA, 15 bp, Homo sapiens
cactatccttttttt

SEQ ID NO: 16635 - DNA, 15 bp, Homo sapiens
acactatcctttttt

SEQ ID NO: 16636 - DNA, 15 bp, Homo sapiens
aacactatccttttt

SEQ ID NO: 16637 - DNA, 15 bp, Homo sapiens
taacactatcctttt

SEQ ID NO: 16638 - DNA, 15 bp, Homo sapiens
gtaacactatccttt

SEQ ID NO: 16639 - DNA, 15 bp, Homo sapiens
tgtaacactatcctt

SEQ ID NO: 16640 - DNA, 15 bp, Homo sapiens
atgtaacactatcct

SEQ ID NO: 16641 - DNA, 15 bp, Homo sapiens
tatgtaacactatcc

SEQ ID NO: 16642 - DNA, 15 bp, Homo sapiens
atatgtaacactatc

SEQ ID NO: 16643 - DNA, 15 bp, Homo sapiens
tatatgtaacactat

SEQ ID NO: 16644 - DNA, 15 bp, Homo sapiens
atatatgtaacacta

SEQ ID NO: 16645 - DNA, 15 bp, Homo sapiens
catatatgtaacact

SEQ ID NO: 16646 - DNA, 15 bp, Homo sapiens
gcatatatgtaacac

SEQ ID NO: 16647 - DNA, 15 bp, Homo sapiens
ggcatatatgtaaca

SEQ ID NO: 16648 - DNA, 15 bp, Homo sapiens
tggcatatatgtaac

SEQ ID NO: 16649 - DNA, 15 bp, Homo sapiens
ctggcatatatgtaa

SEQ ID NO: 16650 - DNA, 15 bp, Homo sapiens
actggcatatatgta

SEQ ID NO: 16651 - DNA, 15 bp, Homo sapiens
tactggcatatatgt

SEQ ID NO: 16652 - DNA, 15 bp, Homo sapiens
ttactggcatatatg

SEQ ID NO: 16653 - DNA, 15 bp, Homo sapiens
cttactggcatatat

SEQ ID NO: 16654 - DNA, 15 bp, Homo sapiens
gcttactggcatata

SEQ ID NO: 16655 - DNA, 15 bp, Homo sapiens
ggcttactggcatat

SEQ ID NO: 16656 - DNA, 15 bp, Homo sapiens
tggcttactggcata

SEQ ID NO: 16657 - DNA, 15 bp, Homo sapiens
ttggcttactggcat

SEQ ID NO: 16658 - DNA, 15 bp, Homo sapiens
attggcttactggca

SEQ ID NO: 16659 - DNA, 15 bp, Homo sapiens
aattggcttactggc

SEQ ID NO: 16660 - DNA, 15 bp, Homo sapiens
taattggcttactgg

SEQ ID NO: 16661 - DNA, 15 bp, Homo sapiens
ataattggcttactg

SEQ ID NO: 16662 - DNA, 15 bp, Homo sapiens
aataattggcttact

SEQ ID NO: 16663 - DNA, 15 bp, Homo sapiens
aaataattggcttac

SEQ ID NO: 16664 - DNA, 15 bp, Homo sapiens
caaataattggctta

SEQ ID NO: 16665 - DNA, 15 bp, Homo sapiens
ccaaataattggctt

SEQ ID NO: 16666 - DNA, 15 bp, Homo sapiens
cccaaataattggct

SEQ ID NO: 16667 - DNA, 15 bp, Homo sapiens
tcccaaataattggc

SEQ ID NO: 16668 - DNA, 15 bp, Homo sapiens
gtcccaaataattgg

SEQ ID NO: 16669 - DNA, 15 bp, Homo sapiens
agtcccaaataattg

SEQ ID NO: 16670 - DNA, 15 bp, Homo sapiens
cagtcccaaataatt

SEQ ID NO: 16671 - DNA, 15 bp, Homo sapiens
acagtcccaaataat

SEQ ID NO: 16672 - DNA, 15 bp, Homo sapiens
cacagtcccaaataa

SEQ ID NO: 16673 - DNA, 15 bp, Homo sapiens
acacagtcccaaata

SEQ ID NO: 16674 - DNA, 15 bp, Homo sapiens
tacacagtcccaaat

SEQ ID NO: 16675 - DNA, 15 bp, Homo sapiens
ctacacagtcccaaa

SEQ ID NO: 16676 - DNA, 15 bp, Homo sapiens
actacacagtcccaa

SEQ ID NO: 16677 - DNA, 15 bp, Homo sapiens
cactacacagtccca

SEQ ID NO: 16678 - DNA, 15 bp, Homo sapiens
acactacacagtccc

SEQ ID NO: 16679 - DNA, 15 bp, Homo sapiens
aacactacacagtcc

SEQ ID NO: 16680 - DNA, 15 bp, Homo sapiens
aaacactacacagtc

SEQ ID NO: 16681 - DNA, 15 bp, Homo sapiens
caaacactacacagt

SEQ ID NO: 16682 - DNA, 15 bp, Homo sapiens
acaaacactacacag

SEQ ID NO: 16683 - DNA, 15 bp, Homo sapiens
cacaaacactacaca

SEQ ID NO: 16684 - DNA, 15 bp, Homo sapiens
acacaaacactacac

SEQ ID NO: 16685 - DNA, 15 bp, Homo sapiens
cacacaaacactaca

SEQ ID NO: 16686 - DNA, 15 bp, Homo sapiens
acacacaaacactac

SEQ ID NO: 16687 - DNA, 15 bp, Homo sapiens
tacacacaaacacta

SEQ ID NO: 16688 - DNA, 15 bp, Homo sapiens
ttacacacaaacact

SEQ ID NO: 16689 - DNA, 15 bp, Homo sapiens
tttacacacaaacac

SEQ ID NO: 16690 - DNA, 15 bp, Homo sapiens
atttacacacaaaca

SEQ ID NO: 16691 - DNA, 15 bp, Homo sapiens
catttacacacaaac

SEQ ID NO: 16692 - DNA, 15 bp, Homo sapiens
ccatttacacacaaa

SEQ ID NO: 16693 - DNA, 15 bp, Homo sapiens
accatttacacacaa

SEQ ID NO: 16694 - DNA, 15 bp, Homo sapiens
caccatttacacaca

SEQ ID NO: 16695 - DNA, 15 bp, Homo sapiens
acaccatttacacac

SEQ ID NO: 16696 - DNA, 15 bp, Homo sapiens
cacaccatttacaca

SEQ ID NO: 16697 - DNA, 15 bp, Homo sapiens
acacaccatttacac

SEQ ID NO: 16698 - DNA, 15 bp, Homo sapiens
cacacaccatttaca

SEQ ID NO: 16699 - DNA, 15 bp, Homo sapiens
acacacaccatttac

SEQ ID NO: 16700 - DNA, 15 bp, Homo sapiens
tacacacaccattta

SEQ ID NO: 16701 - DNA, 15 bp, Homo sapiens
ttacacacaccattt

SEQ ID NO: 16702 - DNA, 15 bp, Homo sapiens
tttacacacaccatt

SEQ ID NO: 16703 - DNA, 15 bp, Homo sapiens
atttacacacaccat

SEQ ID NO: 16704 - DNA, 15 bp, Homo sapiens
catttacacacacca

SEQ ID NO: 16705 - DNA, 15 bp, Homo sapiens
tcatttacacacacc

SEQ ID NO: 16706 - DNA, 15 bp, Homo sapiens
atcatttacacacac

SEQ ID NO: 16707 - DNA, 15 bp, Homo sapiens
aatcatttacacaca

SEQ ID NO: 16708 - DNA, 15 bp, Homo sapiens
aaatcatttacacac

SEQ ID NO: 16709 - DNA, 15 bp, Homo sapiens
taaatcatttacaca

SEQ ID NO: 16710 - DNA, 15 bp, Homo sapiens
ttaaatcatttacac

SEQ ID NO: 16711 - DNA, 15 bp, Homo sapiens
gttaaatcatttaca

SEQ ID NO: 16712 - DNA, 15 bp, Homo sapiens
tgttaaatcatttac

SEQ ID NO: 16713 - DNA, 15 bp, Homo sapiens
ctgttaaatcattta

SEQ ID NO: 16714 - DNA, 15 bp, Homo sapiens
gctgttaaatcattt

SEQ ID NO: 16715 - DNA, 15 bp, Homo sapiens
agctgttaaatcatt

SEQ ID NO: 16716 - DNA, 15 bp, Homo sapiens
aagctgttaaatcat

SEQ ID NO: 16717 - DNA, 15 bp, Homo sapiens
gaagctgttaaatca

SEQ ID NO: 16718 - DNA, 15 bp, Homo sapiens
ggaagctgttaaatc

SEQ ID NO: 16719 - DNA, 15 bp, Homo sapiens
aggaagctgttaaat

SEQ ID NO: 16720 - DNA, 15 bp, Homo sapiens
aaggaagctgttaaa

SEQ ID NO: 16721 - DNA, 15 bp, Homo sapiens
taaggaagctgttaa

SEQ ID NO: 16722 - DNA, 15 bp, Homo sapiens
ttaaggaagctgtta

SEQ ID NO: 16723 - DNA, 15 bp, Homo sapiens
cttaaggaagctgtt

SEQ ID NO: 16724 - DNA, 15 bp, Homo sapiens
acttaaggaagctgt

SEQ ID NO: 16725 - DNA, 15 bp, Homo sapiens
tacttaaggaagctg

SEQ ID NO: 16726 - DNA, 15 bp, Homo sapiens
atacttaaggaagct

SEQ ID NO: 16727 - DNA, 15 bp, Homo sapiens
tatacttaaggaagc

SEQ ID NO: 16728 - DNA, 15 bp, Homo sapiens
ctatacttaaggaag

SEQ ID NO: 16729 - DNA, 15 bp, Homo sapiens
actatacttaaggaa

SEQ ID NO: 16730 - DNA, 15 bp, Homo sapiens
cactatacttaagga

SEQ ID NO: 16731 - DNA, 15 bp, Homo sapiens
acactatacttaagg

SEQ ID NO: 16732 - DNA, 15 bp, Homo sapiens
aacactatacttaag

SEQ ID NO: 16733 - DNA, 15 bp, Homo sapiens
taacactatacttaa

SEQ ID NO: 16734 - DNA, 15 bp, Homo sapiens
ttaacactatactta

SEQ ID NO: 16735 - DNA, 15 bp, Homo sapiens
cttaacactatactt

SEQ ID NO: 16736 - DNA, 15 bp, Homo sapiens
tcttaacactatact

SEQ ID NO: 16737 - DNA, 15 bp, Homo sapiens
ttcttaacactatac

SEQ ID NO: 16738 - DNA, 15 bp, Homo sapiens
cttcttaacactata

SEQ ID NO: 16739 - DNA, 15 bp, Homo sapiens
tcttcttaacactat

SEQ ID NO: 16740 - DNA, 15 bp, Homo sapiens
ctcttcttaacacta

SEQ ID NO: 16741 - DNA, 15 bp, Homo sapiens
actcttcttaacact

SEQ ID NO: 16742 - DNA, 15 bp, Homo sapiens
tactcttcttaacac

SEQ ID NO: 16743 - DNA, 15 bp, Homo sapiens
gtactcttcttaaca

SEQ ID NO: 16744 - DNA, 15 bp, Homo sapiens
tgtactcttcttaac

SEQ ID NO: 16745 - DNA, 15 bp, Homo sapiens
ttgtactcttcttaa

SEQ ID NO: 16746 - DNA, 15 bp, Homo sapiens
gttgtactcttctta

SEQ ID NO: 16747 - DNA, 15 bp, Homo sapiens
agttgtactcttctt

SEQ ID NO: 16748 - DNA, 15 bp, Homo sapiens
gagttgtactcttct

SEQ ID NO: 16749 - DNA, 15 bp, Homo sapiens
tgagttgtactcttc

SEQ ID NO: 16750 - DNA, 15 bp, Homo sapiens
ctgagttgtactctt

SEQ ID NO: 16751 - DNA, 15 bp, Homo sapiens
tctgagttgtactct

SEQ ID NO: 16752 - DNA, 15 bp, Homo sapiens
ttctgagttgtactc

SEQ ID NO: 16753 - DNA, 15 bp, Homo sapiens
attctgagttgtact

SEQ ID NO: 16754 - DNA, 15 bp, Homo sapiens
cattctgagttgtac

SEQ ID NO: 16755 - DNA, 15 bp, Homo sapiens
tcattctgagttgta

SEQ ID NO: 16756 - DNA, 15 bp, Homo sapiens
ttcattctgagttgt

SEQ ID NO: 16757 - DNA, 15 bp, Homo sapiens
tttcattctgagttg

SEQ ID NO: 16758 - DNA, 15 bp, Homo sapiens
atttcattctgagtt

SEQ ID NO: 16759 - DNA, 15 bp, Homo sapiens
catttcattctgagt

SEQ ID NO: 16760 - DNA, 15 bp, Homo sapiens
acatttcattctgag

SEQ ID NO: 16761 - DNA, 15 bp, Homo sapiens
gacatttcattctga

SEQ ID NO: 16762 - DNA, 15 bp, Homo sapiens
agacatttcattctg

SEQ ID NO: 16763 - DNA, 15 bp, Homo sapiens
aagacatttcattct

SEQ ID NO: 16764 - DNA, 15 bp, Homo sapiens
caagacatttcattc

SEQ ID NO: 16765 - DNA, 15 bp, Homo sapiens
ccaagacatttcatt

SEQ ID NO: 16766 - DNA, 15 bp, Homo sapiens
gccaagacatttcat

SEQ ID NO: 16767 - DNA, 15 bp, Homo sapiens
agccaagacatttca

SEQ ID NO: 16768 - DNA, 15 bp, Homo sapiens
tagccaagacatttc

SEQ ID NO: 16769 - DNA, 15 bp, Homo sapiens
atagccaagacattt

SEQ ID NO: 16770 - DNA, 15 bp, Homo sapiens
aatagccaagacatt

SEQ ID NO: 16771 - DNA, 15 bp, Homo sapiens
caatagccaagacat

SEQ ID NO: 16772 - DNA, 15 bp, Homo sapiens
ccaatagccaagaca

SEQ ID NO: 16773 - DNA, 15 bp, Homo sapiens
tccaatagccaagac

SEQ ID NO: 16774 - DNA, 15 bp, Homo sapiens
atccaatagccaaga

SEQ ID NO: 16775 - DNA, 15 bp, Homo sapiens
aatccaatagccaag

SEQ ID NO: 16776 - DNA, 15 bp, Homo sapiens
aaatccaatagccaa

SEQ ID NO: 16777 - DNA, 15 bp, Homo sapiens
aaaatccaatagcca

SEQ ID NO: 16778 - DNA, 15 bp, Homo sapiens
aaaaatccaatagcc

SEQ ID NO: 16779 - DNA, 15 bp, Homo sapiens
aaaaaatccaatagc

SEQ ID NO: 16780 - DNA, 15 bp, Homo sapiens
taaaaaatccaatag

SEQ ID NO: 16781 - DNA, 15 bp, Homo sapiens
ttaaaaaatccaata

SEQ ID NO: 16782 - DNA, 15 bp, Homo sapiens
tttaaaaaatccaat

SEQ ID NO: 16783 - DNA, 15 bp, Homo sapiens
ttttaaaaaatccaa

SEQ ID NO: 16784 - DNA, 15 bp, Homo sapiens
gttttaaaaaatcca

SEQ ID NO: 16785 - DNA, 15 bp, Homo sapiens
agttttaaaaaatcc

SEQ ID NO: 16786 - DNA, 15 bp, Homo sapiens
aagttttaaaaaatc

SEQ ID NO: 16787 - DNA, 15 bp, Homo sapiens
gaagttttaaaaaat

SEQ ID NO: 16788 - DNA, 15 bp, Homo sapiens
ggaagttttaaaaaa

SEQ ID NO: 16789 - DNA, 15 bp, Homo sapiens
aggaagttttaaaaa

SEQ ID NO: 16790 - DNA, 15 bp, Homo sapiens
caggaagttttaaaa

SEQ ID NO: 16791 - DNA, 15 bp, Homo sapiens
acaggaagttttaaa

SEQ ID NO: 16792 - DNA, 15 bp, Homo sapiens
aacaggaagttttaa

SEQ ID NO: 16793 - DNA, 15 bp, Homo sapiens
aaacaggaagtttta

SEQ ID NO: 16794 - DNA, 15 bp, Homo sapiens
aaaacaggaagtttt

SEQ ID NO: 16795 - DNA, 15 bp, Homo sapiens
caaaacaggaagttt

SEQ ID NO: 16796 - DNA, 15 bp, Homo sapiens
ccaaaacaggaagtt

SEQ ID NO: 16797 - DNA, 15 bp, Homo sapiens
gccaaaacaggaagt

SEQ ID NO: 16798 - DNA, 15 bp, Homo sapiens
ggccaaaacaggaag

SEQ ID NO: 16799 - DNA, 15 bp, Homo sapiens
tggccaaaacaggaa

SEQ ID NO: 16800 - DNA, 15 bp, Homo sapiens
ctggccaaaacagga

SEQ ID NO: 16801 - DNA, 15 bp, Homo sapiens
cctggccaaaacagg

SEQ ID NO: 16802 - DNA, 15 bp, Homo sapiens
gcctggccaaaacag

SEQ ID NO: 16803 - DNA, 15 bp, Homo sapiens
cgcctggccaaaaca

SEQ ID NO: 16804 - DNA, 15 bp, Homo sapiens
acgcctggccaaaac

SEQ ID NO: 16805 - DNA, 15 bp, Homo sapiens
cacgcctggccaaaa

SEQ ID NO: 16806 - DNA, 15 bp, Homo sapiens
ccacgcctggccaaa

SEQ ID NO: 16807 - DNA, 15 bp, Homo sapiens
accacgcctggccaa

SEQ ID NO: 16808 - DNA, 15 bp, Homo sapiens
caccacgcctggcca

SEQ ID NO: 16809 - DNA, 15 bp, Homo sapiens
ccaccacgcctggcc

SEQ ID NO: 16810 - DNA, 15 bp, Homo sapiens
gccaccacgcctggc

SEQ ID NO: 16811 - DNA, 15 bp, Homo sapiens
agccaccacgcctgg

SEQ ID NO: 16812 - DNA, 15 bp, Homo sapiens
gagccaccacgcctg

SEQ ID NO: 16813 - DNA, 15 bp, Homo sapiens
tgagccaccacgcct

SEQ ID NO: 16814 - DNA, 15 bp, Homo sapiens
atgagccaccacgcc

SEQ ID NO: 16815 - DNA, 15 bp, Homo sapiens
catgagccaccacgc

SEQ ID NO: 16816 - DNA, 15 bp, Homo sapiens
gcatgagccaccacg

SEQ ID NO: 16817 - DNA, 15 bp, Homo sapiens
ggcatgagccaccac

SEQ ID NO: 16818 - DNA, 15 bp, Homo sapiens
aggcatgagccacca

SEQ ID NO: 16819 - DNA, 15 bp, Homo sapiens
tgcccacctcagcct

SEQ ID NO: 16820 - DNA, 15 bp, Homo sapiens
ctgcccacctcagcc

SEQ ID NO: 16821 - DNA, 15 bp, Homo sapiens
tctgcccacctcagc

SEQ ID NO: 16822 - DNA, 15 bp, Homo sapiens
atctgcccacctcag

SEQ ID NO: 16823 - DNA, 15 bp, Homo sapiens
gatctgcccacctca

SEQ ID NO: 16824 - DNA, 15 bp, Homo sapiens
tgatctgcccacctc

SEQ ID NO: 16825 - DNA, 15 bp, Homo sapiens
atgatctgcccacct

SEQ ID NO: 16826 - DNA, 15 bp, Homo sapiens
catgatctgcccacc

SEQ ID NO: 16827 - DNA, 15 bp, Homo sapiens
tcatgatctgcccac

SEQ ID NO: 16828 - DNA, 15 bp, Homo sapiens
ctcatgatctgccca

SEQ ID NO: 16829 - DNA, 15 bp, Homo sapiens
cctcatgatctgccc

SEQ ID NO: 16830 - DNA, 15 bp, Homo sapiens
acctcatgatctgcc

SEQ ID NO: 16831 - DNA, 15 bp, Homo sapiens
gacctcatgatctgc

SEQ ID NO: 16832 - DNA, 15 bp, Homo sapiens
tgacctcatgatctg

SEQ ID NO: 16833 - DNA, 15 bp, Homo sapiens
ttgacctcatgatct

SEQ ID NO: 16834 - DNA, 15 bp, Homo sapiens
cttgacctcatgatc

SEQ ID NO: 16835 - DNA, 15 bp, Homo sapiens
tcttgacctcatgat

SEQ ID NO: 16836 - DNA, 15 bp, Homo sapiens
ctcttgacctcatga

SEQ ID NO: 16837 - DNA, 15 bp, Homo sapiens
tctcttgacctcatg

SEQ ID NO: 16838 - DNA, 15 bp, Homo sapiens
atctcttgacctcat

SEQ ID NO: 16839 - DNA, 15 bp, Homo sapiens
gatctcttgacctca

SEQ ID NO: 16840 - DNA, 15 bp, Homo sapiens
cgatctcttgacctc

SEQ ID NO: 16841 - DNA, 15 bp, Homo sapiens
tcgatctcttgacct

SEQ ID NO: 16842 - DNA, 15 bp, Homo sapiens
ttcgatctcttgacc

SEQ ID NO: 16843 - DNA, 15 bp, Homo sapiens
tttcgatctcttgac

SEQ ID NO: 16844 - DNA, 15 bp, Homo sapiens
gtttcgatctcttga

SEQ ID NO: 16845 - DNA, 15 bp, Homo sapiens
agtttcgatctcttg

SEQ ID NO: 16846 - DNA, 15 bp, Homo sapiens
tagtttcgatctctt

SEQ ID NO: 16847 - DNA, 15 bp, Homo sapiens
atagtttcgatctct

SEQ ID NO: 16848 - DNA, 15 bp, Homo sapiens
gatagtttcgatctc

SEQ ID NO: 16849 - DNA, 15 bp, Homo sapiens
ggatagtttcgatct

SEQ ID NO: 16850 - DNA, 15 bp, Homo sapiens
aggatagtttcgatc

SEQ ID NO: 16851 - DNA, 15 bp, Homo sapiens
caggatagtttcgat

SEQ ID NO: 16852 - DNA, 15 bp, Homo sapiens
ccaggatagtttcga

SEQ ID NO: 16853 - DNA, 15 bp, Homo sapiens
gccaggatagtttcg

SEQ ID NO: 16854 - DNA, 15 bp, Homo sapiens
ggccaggatagtttc

SEQ ID NO: 16855 - DNA, 15 bp, Homo sapiens
tggccaggatagttt

SEQ ID NO: 16856 - DNA, 15 bp, Homo sapiens
ttggccaggatagtt

SEQ ID NO: 16857 - DNA, 15 bp, Homo sapiens
tttggccaggatagt

SEQ ID NO: 16858 - DNA, 15 bp, Homo sapiens
ttttggccaggatag

SEQ ID NO: 16859 - DNA, 15 bp, Homo sapiens
attttggccaggata

SEQ ID NO: 16860 - DNA, 15 bp, Homo sapiens
cattttggccaggat

SEQ ID NO: 16861 - DNA, 15 bp, Homo sapiens
ccattttggccagga

SEQ ID NO: 16862 - DNA, 15 bp, Homo sapiens
accattttggccagg

SEQ ID NO: 16863 - DNA, 15 bp, Homo sapiens
caccattttggccag

SEQ ID NO: 16864 - DNA, 15 bp, Homo sapiens
tcaccattttggcca

SEQ ID NO: 16865 - DNA, 15 bp, Homo sapiens
ttcaccattttggcc

SEQ ID NO: 16866 - DNA, 15 bp, Homo sapiens
tttcaccattttggc

SEQ ID NO: 16867 - DNA, 15 bp, Homo sapiens
gtttcaccattttgg

SEQ ID NO: 16868 - DNA, 15 bp, Homo sapiens
ggtttcaccattttg

SEQ ID NO: 16869 - DNA, 15 bp, Homo sapiens
gggtttcaccatttt

SEQ ID NO: 16870 - DNA, 15 bp, Homo sapiens
agggtttcaccattt

SEQ ID NO: 16871 - DNA, 15 bp, Homo sapiens
cagggtttcaccatt

SEQ ID NO: 16872 - DNA, 15 bp, Homo sapiens
acagggtttcaccat

SEQ ID NO: 16873 - DNA, 15 bp, Homo sapiens
gacagggtttcacca

SEQ ID NO: 16874 - DNA, 15 bp, Homo sapiens
agacagggtttcacc

SEQ ID NO: 16875 - DNA, 15 bp, Homo sapiens
gagacagggtttcac

SEQ ID NO: 16876 - DNA, 15 bp, Homo sapiens
agagacagggtttca

SEQ ID NO: 16877 - DNA, 15 bp, Homo sapiens
tagagacagggtttc

SEQ ID NO: 16878 - DNA, 15 bp, Homo sapiens
gtagagacagggttt

SEQ ID NO: 16879 - DNA, 15 bp, Homo sapiens
agtagagacagggtt

SEQ ID NO: 16880 - DNA, 15 bp, Homo sapiens
cagtagagacagggt

SEQ ID NO: 16881 - DNA, 15 bp, Homo sapiens
tcagtagagacaggg

SEQ ID NO: 16882 - DNA, 15 bp, Homo sapiens
ttcagtagagacagg

SEQ ID NO: 16883 - DNA, 15 bp, Homo sapiens
tttcagtagagacag

SEQ ID NO: 16884 - DNA, 15 bp, Homo sapiens
ttttcagtagagaca

SEQ ID NO: 16885 - DNA, 15 bp, Homo sapiens
attttcagtagagac

SEQ ID NO: 16886 - DNA, 15 bp, Homo sapiens
tattttcagtagaga

SEQ ID NO: 16887 - DNA, 15 bp, Homo sapiens
gtattttcagtagag

SEQ ID NO: 16888 - DNA, 15 bp, Homo sapiens
tgtattttcagtaga

SEQ ID NO: 16889 - DNA, 15 bp, Homo sapiens
ctgtattttcagtag

SEQ ID NO: 16890 - DNA, 15 bp, Homo sapiens
tctgtattttcagta

SEQ ID NO: 16891 - DNA, 15 bp, Homo sapiens
ttctgtattttcagt

SEQ ID NO: 16892 - DNA, 15 bp, Homo sapiens
tttctgtattttcag

SEQ ID NO: 16893 - DNA, 15 bp, Homo sapiens
atttctgtattttca

SEQ ID NO: 16894 - DNA, 15 bp, Homo sapiens
gatttctgtattttc

SEQ ID NO: 16895 - DNA, 15 bp, Homo sapiens
tgatttctgtatttt

SEQ ID NO: 16896 - DNA, 15 bp, Homo sapiens
ctgatttctgtattt

SEQ ID NO: 16897 - DNA, 15 bp, Homo sapiens
gctgatttctgtatt

SEQ ID NO: 16898 - DNA, 15 bp, Homo sapiens
agctgatttctgtat

SEQ ID NO: 16899 - DNA, 15 bp, Homo sapiens
cagctgatttctgta

SEQ ID NO: 16900 - DNA, 15 bp, Homo sapiens
ccagctgatttctgt

SEQ ID NO: 16901 - DNA, 15 bp, Homo sapiens
cccagctgatttctg

SEQ ID NO: 16902 - DNA, 15 bp, Homo sapiens
gcccagctgatttct

SEQ ID NO: 16903 - DNA, 15 bp, Homo sapiens
tgcccagctgatttc

SEQ ID NO: 16904 - DNA, 15 bp, Homo sapiens
atgcccagctgattt

SEQ ID NO: 16905 - DNA, 15 bp, Homo sapiens
catgcccagctgatt

SEQ ID NO: 16906 - DNA, 15 bp, Homo sapiens
ccatgcccagctgat

SEQ ID NO: 16907 - DNA, 15 bp, Homo sapiens
accatgcccagctga

SEQ ID NO: 16908 - DNA, 15 bp, Homo sapiens
caccatgcccagctg

SEQ ID NO: 16909 - DNA, 15 bp, Homo sapiens
ccaccatgcccagct

SEQ ID NO: 16910 - DNA, 15 bp, Homo sapiens
gccaccatgcccagc

SEQ ID NO: 16911 - DNA, 15 bp, Homo sapiens
agccaccatgcccag

SEQ ID NO: 16912 - DNA, 15 bp, Homo sapiens
gagccaccatgccca

SEQ ID NO: 16913 - DNA, 15 bp, Homo sapiens
ggagccaccatgccc

SEQ ID NO: 16914 - DNA, 15 bp, Homo sapiens
gggagccaccatgcc

SEQ ID NO: 16915 - DNA, 15 bp, Homo sapiens
tgggagccaccatgc

SEQ ID NO: 16916 - DNA, 15 bp, Homo sapiens
gtgggagccaccatg

SEQ ID NO: 16917 - DNA, 15 bp, Homo sapiens
ggtgggagccaccat

SEQ ID NO: 16918 - DNA, 15 bp, Homo sapiens
aggtgggagccacca

SEQ ID NO: 16919 - DNA, 15 bp, Homo sapiens
caggtgggagccacc

SEQ ID NO: 16920 - DNA, 15 bp, Homo sapiens
acaggtgggagccac

SEQ ID NO: 16921 - DNA, 15 bp, Homo sapiens
tacaggtgggagcca

SEQ ID NO: 16922 - DNA, 15 bp, Homo sapiens
ctacaggtgggagcc

SEQ ID NO: 16923 - DNA, 15 bp, Homo sapiens
actacaggtgggagc

SEQ ID NO: 16924 - DNA, 15 bp, Homo sapiens
gactacaggtgggag

SEQ ID NO: 16925 - DNA, 15 bp, Homo sapiens
ggactacaggtggga

SEQ ID NO: 16926 - DNA, 15 bp, Homo sapiens
cggactacaggtggg

SEQ ID NO: 16927 - DNA, 15 bp, Homo sapiens
tcggactacaggtgg

SEQ ID NO: 16928 - DNA, 15 bp, Homo sapiens
ctcggactacaggtg

SEQ ID NO: 16929 - DNA, 15 bp, Homo sapiens
gctcggactacaggt

SEQ ID NO: 16930 - DNA, 15 bp, Homo sapiens
agctcggactacagg

SEQ ID NO: 16931 - DNA, 15 bp, Homo sapiens
gagctcggactacag

SEQ ID NO: 16932 - DNA, 15 bp, Homo sapiens
ggagctcggactaca

SEQ ID NO: 16933 - DNA, 15 bp, Homo sapiens
aggagctcggactac

SEQ ID NO: 16934 - DNA, 15 bp, Homo sapiens
gaggagctcggacta

SEQ ID NO: 16935 - DNA, 15 bp, Homo sapiens
cgaggagctcggact

SEQ ID NO: 16936 - DNA, 15 bp, Homo sapiens
ccgaggagctcggac

SEQ ID NO: 16937 - DNA, 15 bp, Homo sapiens
cccgaggagctcgga

SEQ ID NO: 16938 - DNA, 15 bp, Homo sapiens
tcccgaggagctcgg

SEQ ID NO: 16939 - DNA, 15 bp, Homo sapiens
ctcccgaggagctcg

SEQ ID NO: 16940 - DNA, 15 bp, Homo sapiens
cctcccgaggagctc

SEQ ID NO: 16941 - DNA, 15 bp, Homo sapiens
gcctcccgaggagct

SEQ ID NO: 16942 - DNA, 15 bp, Homo sapiens
agcctcccgaggagc

SEQ ID NO: 16943 - DNA, 15 bp, Homo sapiens
cagcctcccgaggag

SEQ ID NO: 16944 - DNA, 15 bp, Homo sapiens
tcagcctcccgagga

SEQ ID NO: 16945 - DNA, 15 bp, Homo sapiens
ctcagcctcccgagg

SEQ ID NO: 16946 - DNA, 15 bp, Homo sapiens
gcctcagcctcccga

SEQ ID NO: 16947 - DNA, 15 bp, Homo sapiens
tgcctcagcctcccg

SEQ ID NO: 16948 - DNA, 15 bp, Homo sapiens
agattctcctgcctc

SEQ ID NO: 16949 - DNA, 15 bp, Homo sapiens
gagattctcctgcct

SEQ ID NO: 16950 - DNA, 15 bp, Homo sapiens
agagattctcctgcc

SEQ ID NO: 16951 - DNA, 15 bp, Homo sapiens
aagagattctcctgc

SEQ ID NO: 16952 - DNA, 15 bp, Homo sapiens
taagagattctcctg

SEQ ID NO: 16953 - DNA, 15 bp, Homo sapiens
ttaagagattctcct

SEQ ID NO: 16954 - DNA, 15 bp, Homo sapiens
tttaagagattctcc

SEQ ID NO: 16955 - DNA, 15 bp, Homo sapiens
gtttaagagattctc

SEQ ID NO: 16956 - DNA, 15 bp, Homo sapiens
ggtttaagagattct

SEQ ID NO: 16957 - DNA, 15 bp, Homo sapiens
gggtttaagagattc

SEQ ID NO: 16958 - DNA, 15 bp, Homo sapiens
tgggtttaagagatt

SEQ ID NO: 16959 - DNA, 15 bp, Homo sapiens
ctgggtttaagagat

SEQ ID NO: 16960 - DNA, 15 bp, Homo sapiens
cctgggtttaagaga

SEQ ID NO: 16961 - DNA, 15 bp, Homo sapiens
tcctgggtttaagag

SEQ ID NO: 16962 - DNA, 15 bp, Homo sapiens
ctcctgggtttaaga

SEQ ID NO: 16963 - DNA, 15 bp, Homo sapiens
cctcctgggtttaag

SEQ ID NO: 16964 - DNA, 15 bp, Homo sapiens
gcctcctgggtttaa

SEQ ID NO: 16965 - DNA, 15 bp, Homo sapiens
tgcctcctgggttta

SEQ ID NO: 16966 - DNA, 15 bp, Homo sapiens
ctgcctcctgggttt

SEQ ID NO: 16967 - DNA, 15 bp, Homo sapiens
tctgcctcctgggtt

SEQ ID NO: 16968 - DNA, 15 bp, Homo sapiens
ctctgcctcctgggt

SEQ ID NO: 16969 - DNA, 15 bp, Homo sapiens
cctctgcctcctggg

SEQ ID NO: 16970 - DNA, 15 bp, Homo sapiens
acctctgcctcctgg

SEQ ID NO: 16971 - DNA, 15 bp, Homo sapiens
aacctctgcctcctg

SEQ ID NO: 16972 - DNA, 15 bp, Homo sapiens
gcaacctctgcctcc

SEQ ID NO: 16973 - DNA, 15 bp, Homo sapiens
tgcaacctctgcctc

SEQ ID NO: 16974 - DNA, 15 bp, Homo sapiens
ctgcaacctctgcct

SEQ ID NO: 16975 - DNA, 15 bp, Homo sapiens
actgcaacctctgcc

SEQ ID NO: 16976 - DNA, 15 bp, Homo sapiens
cactgcaacctctgc

SEQ ID NO: 16977 - DNA, 15 bp, Homo sapiens
tcactgcaacctctg

SEQ ID NO: 16978 - DNA, 15 bp, Homo sapiens
ctcactgcaacctct

SEQ ID NO: 16979 - DNA, 15 bp, Homo sapiens
cctcggctcactgca

SEQ ID NO: 16980 - DNA, 15 bp, Homo sapiens
acctcggctcactgc

SEQ ID NO: 16981 - DNA, 15 bp, Homo sapiens
gacctcggctcactg

SEQ ID NO: 16982 - DNA, 15 bp, Homo sapiens
cgacctcggctcact

SEQ ID NO: 16983 - DNA, 15 bp, Homo sapiens
acgacctcggctcac

SEQ ID NO: 16984 - DNA, 15 bp, Homo sapiens
cacgacctcggctca

SEQ ID NO: 16985 - DNA, 15 bp, Homo sapiens
gcacgacctcggctc

SEQ ID NO: 16986 - DNA, 15 bp, Homo sapiens
ggcacgacctcggct

SEQ ID NO: 16987 - DNA, 15 bp, Homo sapiens
tggcacgacctcggc

SEQ ID NO: 16988 - DNA, 15 bp, Homo sapiens
atggcacgacctcgg

SEQ ID NO: 16989 - DNA, 15 bp, Homo sapiens
aatggcacgacctcg

SEQ ID NO: 16990 - DNA, 15 bp, Homo sapiens
aaatggcacgacctc

SEQ ID NO: 16991 - DNA, 15 bp, Homo sapiens
gaaatggcacgacct

SEQ ID NO: 16992 - DNA, 15 bp, Homo sapiens
tgaaatggcacgacc

SEQ ID NO: 16993 - DNA, 15 bp, Homo sapiens
gtgaaatggcacgac

SEQ ID NO: 16994 - DNA, 15 bp, Homo sapiens
agtgaaatggcacga

SEQ ID NO: 16995 - DNA, 15 bp, Homo sapiens
cagtgaaatggcacg

SEQ ID NO: 16996 - DNA, 15 bp, Homo sapiens
gcagtgaaatggcac

SEQ ID NO: 16997 - DNA, 15 bp, Homo sapiens
tgcagtgaaatggca

SEQ ID NO: 16998 - DNA, 15 bp, Homo sapiens
ttgataatcagataa

SEQ ID NO: 16999 - DNA, 15 bp, Homo sapiens
attgataatcagata

SEQ ID NO: 17000 - DNA, 15 bp, Homo sapiens
aattgataatcagat

SEQ ID NO: 17001 - DNA, 15 bp, Homo sapiens
aaattgataatcaga

SEQ ID NO: 17002 - DNA, 15 bp, Homo sapiens
aaaattgataatcag

SEQ ID NO: 17003 - DNA, 15 bp, Homo sapiens
caaaattgataatca

SEQ ID NO: 17004 - DNA, 15 bp, Homo sapiens
tcaaaattgataatc

SEQ ID NO: 17005 - DNA, 15 bp, Homo sapiens
ttcaaaattgataat

SEQ ID NO: 17006 - DNA, 15 bp, Homo sapiens
tttcaaaattgataa

SEQ ID NO: 17007 - DNA, 15 bp, Homo sapiens
ttttcaaaattgata

SEQ ID NO: 17008 - DNA, 15 bp, Homo sapiens
cttttcaaaattgat

SEQ ID NO: 17009 - DNA, 15 bp, Homo sapiens
gcttttcaaaattga

SEQ ID NO: 17010 - DNA, 15 bp, Homo sapiens
tgcttttcaaaattg

SEQ ID NO: 17011 - DNA, 15 bp, Homo sapiens
ctgcttttcaaaatt

SEQ ID NO: 17012 - DNA, 15 bp, Homo sapiens
gctgcttttcaaaat

SEQ ID NO: 17013 - DNA, 15 bp, Homo sapiens
agctgcttttcaaaa

SEQ ID NO: 17014 - DNA, 15 bp, Homo sapiens
tagctgcttttcaaa

SEQ ID NO: 17015 - DNA, 15 bp, Homo sapiens
ttagctgcttttcaa

SEQ ID NO: 17016 - DNA, 15 bp, Homo sapiens
attagctgcttttca

SEQ ID NO: 17017 - DNA, 15 bp, Homo sapiens
cattagctgcttttc

SEQ ID NO: 17018 - DNA, 15 bp, Homo sapiens
acattagctgctttt

SEQ ID NO: 17019 - DNA, 15 bp, Homo sapiens
gacattagctgcttt

SEQ ID NO: 17020 - DNA, 15 bp, Homo sapiens
tgacattagctgctt

SEQ ID NO: 17021 - DNA, 15 bp, Homo sapiens
atgacattagctgct

SEQ ID NO: 17022 - DNA, 15 bp, Homo sapiens
catgacattagctgc

SEQ ID NO: 17023 - DNA, 15 bp, Homo sapiens
ccatgacattagctg

SEQ ID NO: 17024 - DNA, 15 bp, Homo sapiens
tccatgacattagct

SEQ ID NO: 17025 - DNA, 15 bp, Homo sapiens
ctccatgacattagc

SEQ ID NO: 17026 - DNA, 15 bp, Homo sapiens
tctccatgacattag

SEQ ID NO: 17027 - DNA, 15 bp, Homo sapiens
gtctccatgacatta

SEQ ID NO: 17028 - DNA, 15 bp, Homo sapiens
tgtctccatgacatt

SEQ ID NO: 17029 - DNA, 15 bp, Homo sapiens
ctgtctccatgacat

SEQ ID NO: 17030 - DNA, 15 bp, Homo sapiens
actgtctccatgaca

SEQ ID NO: 17031 - DNA, 15 bp, Homo sapiens
aactgtctccatgac

SEQ ID NO: 17032 - DNA, 15 bp, Homo sapiens
taactgtctccatga

SEQ ID NO: 17033 - DNA, 15 bp, Homo sapiens
ataactgtctccatg

SEQ ID NO: 17034 - DNA, 15 bp, Homo sapiens
tataactgtctccat

SEQ ID NO: 17035 - DNA, 15 bp, Homo sapiens
atataactgtctcca

SEQ ID NO: 17036 - DNA, 15 bp, Homo sapiens
catataactgtctcc

SEQ ID NO: 17037 - DNA, 15 bp, Homo sapiens
tcatataactgtctc

SEQ ID NO: 17038 - DNA, 15 bp, Homo sapiens
ctcatataactgtct

SEQ ID NO: 17039 - DNA, 15 bp, Homo sapiens
actcatataactgtc

SEQ ID NO: 17040 - DNA, 15 bp, Homo sapiens
tactcatataactgt

SEQ ID NO: 17041 - DNA, 15 bp, Homo sapiens
ttactcatataactg

SEQ ID NO: 17042 - DNA, 15 bp, Homo sapiens
gttactcatataact

SEQ ID NO: 17043 - DNA, 15 bp, Homo sapiens
ggttactcatataac

SEQ ID NO: 17044 - DNA, 15 bp, Homo sapiens
aggttactcatataa

SEQ ID NO: 17045 - DNA, 15 bp, Homo sapiens
caggttactcatata

SEQ ID NO: 17046 - DNA, 15 bp, Homo sapiens
ccaggttactcatat

SEQ ID NO: 17047 - DNA, 15 bp, Homo sapiens
gccaggttactcata

SEQ ID NO: 17048 - DNA, 15 bp, Homo sapiens
agccaggttactcat

SEQ ID NO: 17049 - DNA, 15 bp, Homo sapiens
gagccaggttactca

SEQ ID NO: 17050 - DNA, 15 bp, Homo sapiens
agagccaggttactc

SEQ ID NO: 17051 - DNA, 15 bp, Homo sapiens
tagagccaggttact

SEQ ID NO: 17052 - DNA, 15 bp, Homo sapiens
atagagccaggttac

SEQ ID NO: 17053 - DNA, 15 bp, Homo sapiens
aatagagccaggtta

SEQ ID NO: 17054 - DNA, 15 bp, Homo sapiens
aaatagagccaggtt

SEQ ID NO: 17055 - DNA, 15 bp, Homo sapiens
aaaatagagccaggt

SEQ ID NO: 17056 - DNA, 15 bp, Homo sapiens
aaaaatagagccagg

SEQ ID NO: 17057 - DNA, 15 bp, Homo sapiens
aaaaaatagagccag

SEQ ID NO: 17058 - DNA, 15 bp, Homo sapiens
aaaaaaatagagcca

SEQ ID NO: 17059 - DNA, 15 bp, Homo sapiens
aaaaaaaatagagcc

SEQ ID NO: 17060 - DNA, 15 bp, Homo sapiens
caaaaaaaatagagc

SEQ ID NO: 17061 - DNA, 15 bp, Homo sapiens
ccaaaaaaaatagag

SEQ ID NO: 17062 - DNA, 15 bp, Homo sapiens
accaaaaaaaataga

SEQ ID NO: 17063 - DNA, 15 bp, Homo sapiens
taccaaaaaaaatag

SEQ ID NO: 17064 - DNA, 15 bp, Homo sapiens
ataccaaaaaaaata

SEQ ID NO: 17065 - DNA, 15 bp, Homo sapiens
aataccaaaaaaaat

SEQ ID NO: 17066 - DNA, 15 bp, Homo sapiens
caataccaaaaaaaa

SEQ ID NO: 17067 - DNA, 15 bp, Homo sapiens
acaataccaaaaaaa

SEQ ID NO: 17068 - DNA, 15 bp, Homo sapiens
aacaataccaaaaaa

SEQ ID NO: 17069 - DNA, 15 bp, Homo sapiens
aaacaataccaaaaa

SEQ ID NO: 17070 - DNA, 15 bp, Homo sapiens
gaaacaataccaaaa

SEQ ID NO: 17071 - DNA, 15 bp, Homo sapiens
agaaacaataccaaa

SEQ ID NO: 17072 - DNA, 15 bp, Homo sapiens
aagaaacaataccaa

SEQ ID NO: 17073 - DNA, 15 bp, Homo sapiens
aaagaaacaatacca

SEQ ID NO: 17074 - DNA, 15 bp, Homo sapiens
taaagaaacaatacc

SEQ ID NO: 17075 - DNA, 15 bp, Homo sapiens
ataaagaaacaatac

SEQ ID NO: 17076 - DNA, 15 bp, Homo sapiens
tataaagaaacaata

SEQ ID NO: 17077 - DNA, 15 bp, Homo sapiens
ttataaagaaacaat

SEQ ID NO: 17078 - DNA, 15 bp, Homo sapiens
tttataaagaaacaa

SEQ ID NO: 17079 - DNA, 15 bp, Homo sapiens
atttataaagaaaca

SEQ ID NO: 17080 - DNA, 15 bp, Homo sapiens
tatttataaagaaac

SEQ ID NO: 17081 - DNA, 15 bp, Homo sapiens
ctatttataaagaaa

SEQ ID NO: 17082 - DNA, 15 bp, Homo sapiens
gctatttataaagaa

SEQ ID NO: 17083 - DNA, 15 bp, Homo sapiens
agctatttataaaga

SEQ ID NO: 17084 - DNA, 15 bp, Homo sapiens
aagctatttataaag

SEQ ID NO: 17085 - DNA, 15 bp, Homo sapiens
taagctatttataaa

SEQ ID NO: 17086 - DNA, 15 bp, Homo sapiens
gtaagctatttataa

SEQ ID NO: 17087 - DNA, 15 bp, Homo sapiens
agtaagctatttata

SEQ ID NO: 17088 - DNA, 15 bp, Homo sapiens
aagtaagctatttat

SEQ ID NO: 17089 - DNA, 15 bp, Homo sapiens
taagtaagctattta

SEQ ID NO: 17090 - DNA, 15 bp, Homo sapiens
ataagtaagctattt

SEQ ID NO: 17091 - DNA, 15 bp, Homo sapiens
aataagtaagctatt

SEQ ID NO: 17092 - DNA, 15 bp, Homo sapiens
taataagtaagctat

SEQ ID NO: 17093 - DNA, 15 bp, Homo sapiens
ttaataagtaagcta

SEQ ID NO: 17094 - DNA, 15 bp, Homo sapiens
tttaataagtaagct

SEQ ID NO: 17095 - DNA, 15 bp, Homo sapiens
ttttaataagtaagc

SEQ ID NO: 17096 - DNA, 15 bp, Homo sapiens
attttaataagtaag

SEQ ID NO: 17097 - DNA, 15 bp, Homo sapiens
aattttaataagtaa

SEQ ID NO: 17098 - DNA, 15 bp, Homo sapiens
gaattttaataagta

SEQ ID NO: 17099 - DNA, 15 bp, Homo sapiens
agaattttaataagt

SEQ ID NO: 17100 - DNA, 15 bp, Homo sapiens
gagaattttaataag

SEQ ID NO: 17101 - DNA, 15 bp, Homo sapiens
tgagaattttaataa

SEQ ID NO: 17102 - DNA, 15 bp, Homo sapiens
atgagaattttaata

SEQ ID NO: 17103 - DNA, 15 bp, Homo sapiens
aatgagaattttaat

SEQ ID NO: 17104 - DNA, 15 bp, Homo sapiens
taatgagaattttaa

SEQ ID NO: 17105 - DNA, 15 bp, Homo sapiens
ctaatgagaatttta

SEQ ID NO: 17106 - DNA, 15 bp, Homo sapiens
gctaatgagaatttt

SEQ ID NO: 17107 - DNA, 15 bp, Homo sapiens
tgctaatgagaattt

SEQ ID NO: 17108 - DNA, 15 bp, Homo sapiens
ttgctaatgagaatt

SEQ ID NO: 17109 - DNA, 15 bp, Homo sapiens
gttgctaatgagaat

SEQ ID NO: 17110 - DNA, 15 bp, Homo sapiens
tgttgctaatgagaa

SEQ ID NO: 17111 - DNA, 15 bp, Homo sapiens
ttgttgctaatgaga

SEQ ID NO: 17112 - DNA, 15 bp, Homo sapiens
gttgttgctaatgag

SEQ ID NO: 17113 - DNA, 15 bp, Homo sapiens
tgttgttgctaatga

SEQ ID NO: 17114 - DNA, 15 bp, Homo sapiens
ttgttgttgctaatg

SEQ ID NO: 17115 - DNA, 15 bp, Homo sapiens
cttgttgttgctaat

SEQ ID NO: 17116 - DNA, 15 bp, Homo sapiens
gcttgttgttgctaa

SEQ ID NO: 17117 - DNA, 15 bp, Homo sapiens
agcttgttgttgcta

SEQ ID NO: 17118 - DNA, 15 bp, Homo sapiens
cagcttgttgttgct

SEQ ID NO: 17119 - DNA, 15 bp, Homo sapiens
ccagcttgttgttgc

SEQ ID NO: 17120 - DNA, 15 bp, Homo sapiens
tccagcttgttgttg

SEQ ID NO: 17121 - DNA, 15 bp, Homo sapiens
ctccagcttgttgtt

SEQ ID NO: 17122 - DNA, 15 bp, Homo sapiens
cctccagcttgttgt

SEQ ID NO: 17123 - DNA, 15 bp, Homo sapiens
gcctccagcttgttg

SEQ ID NO: 17124 - DNA, 15 bp, Homo sapiens
ggcctccagcttgtt

SEQ ID NO: 17125 - DNA, 15 bp, Homo sapiens
tggcctccagcttgt

SEQ ID NO: 17126 - DNA, 15 bp, Homo sapiens
ttggcctccagcttg

SEQ ID NO: 17127 - DNA, 15 bp, Homo sapiens
attggcctccagctt

SEQ ID NO: 17128 - DNA, 15 bp, Homo sapiens
aattggcctccagct

SEQ ID NO: 17129 - DNA, 15 bp, Homo sapiens
taattggcctccagc

SEQ ID NO: 17130 - DNA, 15 bp, Homo sapiens
ttaattggcctccag

SEQ ID NO: 17131 - DNA, 15 bp, Homo sapiens
cttaattggcctcca

SEQ ID NO: 17132 - DNA, 15 bp, Homo sapiens
gcttaattggcctcc

SEQ ID NO: 17133 - DNA, 15 bp, Homo sapiens
ggcttaattggcctc

SEQ ID NO: 17134 - DNA, 15 bp, Homo sapiens
tggcttaattggcct

SEQ ID NO: 17135 - DNA, 15 bp, Homo sapiens
atggcttaattggcc

SEQ ID NO: 17136 - DNA, 15 bp, Homo sapiens
tatggcttaattggc

SEQ ID NO: 17137 - DNA, 15 bp, Homo sapiens
ttatggcttaattgg

SEQ ID NO: 17138 - DNA, 15 bp, Homo sapiens
tttatggcttaattg

SEQ ID NO: 17139 - DNA, 15 bp, Homo sapiens
ttttatggcttaatt

SEQ ID NO: 17140 - DNA, 15 bp, Homo sapiens
attttatggcttaat

SEQ ID NO: 17141 - DNA, 15 bp, Homo sapiens
cattttatggcttaa

SEQ ID NO: 17142 - DNA, 15 bp, Homo sapiens
acattttatggctta

SEQ ID NO: 17143 - DNA, 15 bp, Homo sapiens
aacattttatggctt

SEQ ID NO: 17144 - DNA, 15 bp, Homo sapiens
caacattttatggct

SEQ ID NO: 17145 - DNA, 15 bp, Homo sapiens
ccaacattttatggc

SEQ ID NO: 17146 - DNA, 15 bp, Homo sapiens
tccaacattttatgg

SEQ ID NO: 17147 - DNA, 15 bp, Homo sapiens
ctccaacattttatg

SEQ ID NO: 17148 - DNA, 15 bp, Homo sapiens
tctccaacattttat

SEQ ID NO: 17149 - DNA, 15 bp, Homo sapiens
ttctccaacatttta

SEQ ID NO: 17150 - DNA, 15 bp, Homo sapiens
tttctccaacatttt

SEQ ID NO: 17151 - DNA, 15 bp, Homo sapiens
atttctccaacattt

SEQ ID NO: 17152 - DNA, 15 bp, Homo sapiens
catttctccaacatt

SEQ ID NO: 17153 - DNA, 15 bp, Homo sapiens
ccatttctccaacat

SEQ ID NO: 17154 - DNA, 15 bp, Homo sapiens
accatttctccaaca

SEQ ID NO: 17155 - DNA, 15 bp, Homo sapiens
aaccatttctccaac

SEQ ID NO: 17156 - DNA, 15 bp, Homo sapiens
caaccatttctccaa

SEQ ID NO: 17157 - DNA, 15 bp, Homo sapiens
ccaaccatttctcca

SEQ ID NO: 17158 - DNA, 15 bp, Homo sapiens
cccaaccatttctcc

SEQ ID NO: 17159 - DNA, 15 bp, Homo sapiens
acccaaccatttctc

SEQ ID NO: 17160 - DNA, 15 bp, Homo sapiens
aacccaaccatttct

SEQ ID NO: 17161 - DNA, 15 bp, Homo sapiens
taacccaaccatttc

SEQ ID NO: 17162 - DNA, 15 bp, Homo sapiens
ataacccaaccattt

SEQ ID NO: 17163 - DNA, 15 bp, Homo sapiens
tataacccaaccatt

SEQ ID NO: 17164 - DNA, 15 bp, Homo sapiens
atataacccaaccat

SEQ ID NO: 17165 - DNA, 15 bp, Homo sapiens
catataacccaacca

SEQ ID NO: 17166 - DNA, 15 bp, Homo sapiens
acatataacccaacc

SEQ ID NO: 17167 - DNA, 15 bp, Homo sapiens
cacatataacccaac

SEQ ID NO: 17168 - DNA, 15 bp, Homo sapiens
acacatataacccaa

SEQ ID NO: 17169 - DNA, 15 bp, Homo sapiens
cacacatataaccca

SEQ ID NO: 17170 - DNA, 15 bp, Homo sapiens
tcacacatataaccc

SEQ ID NO: 17171 - DNA, 15 bp, Homo sapiens
ttcacacatataacc

SEQ ID NO: 17172 - DNA, 15 bp, Homo sapiens
tttcacacatataac

SEQ ID NO: 17173 - DNA, 15 bp, Homo sapiens
atttcacacatataa

SEQ ID NO: 17174 - DNA, 15 bp, Homo sapiens
aatttcacacatata

SEQ ID NO: 17175 - DNA, 15 bp, Homo sapiens
gaatttcacacatat

SEQ ID NO: 17176 - DNA, 15 bp, Homo sapiens
agaatttcacacata

SEQ ID NO: 17177 - DNA, 15 bp, Homo sapiens
gagaatttcacacat

SEQ ID NO: 17178 - DNA, 15 bp, Homo sapiens
tgagaatttcacaca

SEQ ID NO: 17179 - DNA, 15 bp, Homo sapiens
atgagaatttcacac

SEQ ID NO: 17180 - DNA, 15 bp, Homo sapiens
tatgagaatttcaca

SEQ ID NO: 17181 - DNA, 15 bp, Homo sapiens
ctatgagaatttcac

SEQ ID NO: 17182 - DNA, 15 bp, Homo sapiens
actatgagaatttca

SEQ ID NO: 17183 - DNA, 15 bp, Homo sapiens
cactatgagaatttc

SEQ ID NO: 17184 - DNA, 15 bp, Homo sapiens
acactatgagaattt

SEQ ID NO: 17185 - DNA, 15 bp, Homo sapiens
cacactatgagaatt

SEQ ID NO: 17186 - DNA, 15 bp, Homo sapiens
gcacactatgagaat

SEQ ID NO: 17187 - DNA, 15 bp, Homo sapiens
ggcacactatgagaa

SEQ ID NO: 17188 - DNA, 15 bp, Homo sapiens
gggcacactatgaga

SEQ ID NO: 17189 - DNA, 15 bp, Homo sapiens
agggcacactatgag

SEQ ID NO: 17190 - DNA, 15 bp, Homo sapiens
tagggcacactatga

SEQ ID NO: 17191 - DNA, 15 bp, Homo sapiens
ttagggcacactatg

SEQ ID NO: 17192 - DNA, 15 bp, Homo sapiens
tttagggcacactat

SEQ ID NO: 17193 - DNA, 15 bp, Homo sapiens
ctttagggcacacta

SEQ ID NO: 17194 - DNA, 15 bp, Homo sapiens
tctttagggcacact

SEQ ID NO: 17195 - DNA, 15 bp, Homo sapiens
gtctttagggcacac

SEQ ID NO: 17196 - DNA, 15 bp, Homo sapiens
cgtctttagggcaca

SEQ ID NO: 17197 - DNA, 15 bp, Homo sapiens
acgtctttagggcac

SEQ ID NO: 17198 - DNA, 15 bp, Homo sapiens
tacgtctttagggca

SEQ ID NO: 17199 - DNA, 15 bp, Homo sapiens
ctacgtctttagggc

SEQ ID NO: 17200 - DNA, 15 bp, Homo sapiens
actacgtctttaggg

SEQ ID NO: 17201 - DNA, 15 bp, Homo sapiens
aactacgtctttagg

SEQ ID NO: 17202 - DNA, 15 bp, Homo sapiens
caactacgtctttag

SEQ ID NO: 17203 - DNA, 15 bp, Homo sapiens
gcaactacgtcttta

SEQ ID NO: 17204 - DNA, 15 bp, Homo sapiens
ggcaactacgtcttt

SEQ ID NO: 17205 - DNA, 15 bp, Homo sapiens
tggcaactacgtctt

SEQ ID NO: 17206 - DNA, 15 bp, Homo sapiens
atggcaactacgtct

SEQ ID NO: 17207 - DNA, 15 bp, Homo sapiens
aatggcaactacgtc

SEQ ID NO: 17208 - DNA, 15 bp, Homo sapiens
aaatggcaactacgt

SEQ ID NO: 17209 - DNA, 15 bp, Homo sapiens
taaatggcaactacg

SEQ ID NO: 17210 - DNA, 15 bp, Homo sapiens
ttaaatggcaactac

SEQ ID NO: 17211 - DNA, 15 bp, Homo sapiens
tttaaatggcaacta

SEQ ID NO: 17212 - DNA, 15 bp, Homo sapiens
ttttaaatggcaact

SEQ ID NO: 17213 - DNA, 15 bp, Homo sapiens
tttttaaatggcaac

SEQ ID NO: 17214 - DNA, 15 bp, Homo sapiens
ttttttaaatggcaa

SEQ ID NO: 17215 - DNA, 15 bp, Homo sapiens
tttttttaaatggca

SEQ ID NO: 17216 - DNA, 15 bp, Homo sapiens
ttttttttaaatggc

SEQ ID NO: 17217 - DNA, 15 bp, Homo sapiens
attttttttaaatgg

SEQ ID NO: 17218 - DNA, 15 bp, Homo sapiens
aattttttttaaatg

SEQ ID NO: 17219 - DNA, 15 bp, Homo sapiens
aaattttttttaaat

SEQ ID NO: 17220 - DNA, 15 bp, Homo sapiens
aaaattttttttaaa

SEQ ID NO: 17221 - DNA, 15 bp, Homo sapiens
aaaaattttttttaa

SEQ ID NO: 17222 - DNA, 15 bp, Homo sapiens
aaaaaatttttttta

SEQ ID NO: 17223 - DNA, 15 bp, Homo sapiens
aaaaaaaaaaatttt

SEQ ID NO: 17224 - DNA, 15 bp, Homo sapiens
aaaaaaaaaaaattt

SEQ ID NO: 17225 - DNA, 15 bp, Homo sapiens
caaaaaaaaaaaaat

SEQ ID NO: 17226 - DNA, 15 bp, Homo sapiens
gactccgcctcaaaa

SEQ ID NO: 17227 - DNA, 15 bp, Homo sapiens
agactccgcctcaaa

SEQ ID NO: 17228 - DNA, 15 bp, Homo sapiens
gagactccgcctcaa

SEQ ID NO: 17229 - DNA, 15 bp, Homo sapiens
cgagactccgcctca

SEQ ID NO: 17230 - DNA, 15 bp, Homo sapiens
gcgagactccgcctc

SEQ ID NO: 17231 - DNA, 15 bp, Homo sapiens
agcgagactccgcct

SEQ ID NO: 17232 - DNA, 15 bp, Homo sapiens
gagcgagactccgcc

SEQ ID NO: 17233 - DNA, 15 bp, Homo sapiens
agagcgagactccgc

SEQ ID NO: 17234 - DNA, 15 bp, Homo sapiens
gggcaacagagcgag

SEQ ID NO: 17235 - DNA, 15 bp, Homo sapiens
tgggcaacagagcga

SEQ ID NO: 17236 - DNA, 15 bp, Homo sapiens
ctgggcaacagagcg

SEQ ID NO: 17237 - DNA, 15 bp, Homo sapiens
tagcctgggcaacag

SEQ ID NO: 17238 - DNA, 15 bp, Homo sapiens
atagcctgggcaaca

SEQ ID NO: 17239 - DNA, 15 bp, Homo sapiens
tatagcctgggcaac

SEQ ID NO: 17240 - DNA, 15 bp, Homo sapiens
ctatagcctgggcaa

SEQ ID NO: 17241 - DNA, 15 bp, Homo sapiens
actatagcctgggca

SEQ ID NO: 17242 - DNA, 15 bp, Homo sapiens
cactatagcctgggc

SEQ ID NO: 17243 - DNA, 15 bp, Homo sapiens
acactatagcctggg

SEQ ID NO: 17244 - DNA, 15 bp, Homo sapiens
tacactatagcctgg

SEQ ID NO: 17245 - DNA, 15 bp, Homo sapiens
ctacactatagcctg

SEQ ID NO: 17246 - DNA, 15 bp, Homo sapiens
actacactatagcct

SEQ ID NO: 17247 - DNA, 15 bp, Homo sapiens
cactacactatagcc

SEQ ID NO: 17248 - DNA, 15 bp, Homo sapiens
gcactacactatagc

SEQ ID NO: 17249 - DNA, 15 bp, Homo sapiens
agcactacactatag

SEQ ID NO: 17250 - DNA, 15 bp, Homo sapiens
cagcactacactata

SEQ ID NO: 17251 - DNA, 15 bp, Homo sapiens
acagcactacactat

SEQ ID NO: 17252 - DNA, 15 bp, Homo sapiens
cacagcactacacta

SEQ ID NO: 17253 - DNA, 15 bp, Homo sapiens
tcacagcactacact

SEQ ID NO: 17254 - DNA, 15 bp, Homo sapiens
atcacagcactacac

SEQ ID NO: 17255 - DNA, 15 bp, Homo sapiens
gatcacagcactaca

SEQ ID NO: 17256 - DNA, 15 bp, Homo sapiens
agatcacagcactac

SEQ ID NO: 17257 - DNA, 15 bp, Homo sapiens
gagatcacagcacta

SEQ ID NO: 17258 - DNA, 15 bp, Homo sapiens
tgagatcacagcact

SEQ ID NO: 17259 - DNA, 15 bp, Homo sapiens
ctgagatcacagcac

SEQ ID NO: 17260 - DNA, 15 bp, Homo sapiens
gctgagatcacagca

SEQ ID NO: 17261 - DNA, 15 bp, Homo sapiens
agctgagatcacagc

SEQ ID NO: 17262 - DNA, 15 bp, Homo sapiens
gagctgagatcacag

SEQ ID NO: 17263 - DNA, 15 bp, Homo sapiens
tgagctgagatcaca

SEQ ID NO: 17264 - DNA, 15 bp, Homo sapiens
aggaggcagaggttg

SEQ ID NO: 17265 - DNA, 15 bp, Homo sapiens
tccaggaggcagagg

SEQ ID NO: 17266 - DNA, 15 bp, Homo sapiens
atccaggaggcagag

SEQ ID NO: 17267 - DNA, 15 bp, Homo sapiens
aatccaggaggcaga

SEQ ID NO: 17268 - DNA, 15 bp, Homo sapiens
gaatccaggaggcag

SEQ ID NO: 17269 - DNA, 15 bp, Homo sapiens
tgaatccaggaggca

SEQ ID NO: 17270 - DNA, 15 bp, Homo sapiens
ttgaatccaggaggc

SEQ ID NO: 17271 - DNA, 15 bp, Homo sapiens
cttgaatccaggagg

SEQ ID NO: 17272 - DNA, 15 bp, Homo sapiens
gcttgaatccaggag

SEQ ID NO: 17273 - DNA, 15 bp, Homo sapiens
agcttgaatccagga

SEQ ID NO: 17274 - DNA, 15 bp, Homo sapiens
cagcttgaatccagg

SEQ ID NO: 17275 - DNA, 15 bp, Homo sapiens
acagcttgaatccag

SEQ ID NO: 17276 - DNA, 15 bp, Homo sapiens
aacagcttgaatcca

SEQ ID NO: 17277 - DNA, 15 bp, Homo sapiens
gaacagcttgaatcc

SEQ ID NO: 17278 - DNA, 15 bp, Homo sapiens
agaacagcttgaatc

SEQ ID NO: 17279 - DNA, 15 bp, Homo sapiens
gagaacagcttgaat

SEQ ID NO: 17280 - DNA, 15 bp, Homo sapiens
ggagaacagcttgaa

SEQ ID NO: 17281 - DNA, 15 bp, Homo sapiens
aggagaacagcttga

SEQ ID NO: 17282 - DNA, 15 bp, Homo sapiens
caggagaacagcttg

SEQ ID NO: 17283 - DNA, 15 bp, Homo sapiens
gcaggagaacagctt

SEQ ID NO: 17284 - DNA, 15 bp, Homo sapiens
ggcaggagaacagct

SEQ ID NO: 17285 - DNA, 15 bp, Homo sapiens
aggcaggagaacagc

SEQ ID NO: 17286 - DNA, 15 bp, Homo sapiens
gaggcaggagaacag

SEQ ID NO: 17287 - DNA, 15 bp, Homo sapiens
tgaggcaggagaaca

SEQ ID NO: 17288 - DNA, 15 bp, Homo sapiens
ctgaggcaggagaac

SEQ ID NO: 17289 - DNA, 15 bp, Homo sapiens
tggctgaggcaggag

SEQ ID NO: 17290 - DNA, 15 bp, Homo sapiens
gtggctgaggcagga

SEQ ID NO: 17291 - DNA, 15 bp, Homo sapiens
ggtggctgaggcagg

SEQ ID NO: 17292 - DNA, 15 bp, Homo sapiens
aggtggctgaggcag

SEQ ID NO: 17293 - DNA, 15 bp, Homo sapiens
caggtggctgaggca

SEQ ID NO: 17294 - DNA, 15 bp, Homo sapiens
tcaggtggctgaggc

SEQ ID NO: 17295 - DNA, 15 bp, Homo sapiens
ctcaggtggctgagg

SEQ ID NO: 17296 - DNA, 15 bp, Homo sapiens
actcaggtggctgag

SEQ ID NO: 17297 - DNA, 15 bp, Homo sapiens
cactcaggtggctga

SEQ ID NO: 17298 - DNA, 15 bp, Homo sapiens
acactcaggtggctg

SEQ ID NO: 17299 - DNA, 15 bp, Homo sapiens
gacactcaggtggct

SEQ ID NO: 17300 - DNA, 15 bp, Homo sapiens
agacactcaggtggc

SEQ ID NO: 17301 - DNA, 15 bp, Homo sapiens
cagacactcaggtgg

SEQ ID NO: 17302 - DNA, 15 bp, Homo sapiens
ccagacactcaggtg

SEQ ID NO: 17303 - DNA, 15 bp, Homo sapiens
cccagacactcaggt

SEQ ID NO: 17304 - DNA, 15 bp, Homo sapiens
tcccagacactcagg

SEQ ID NO: 17305 - DNA, 15 bp, Homo sapiens
atcccagacactcag

SEQ ID NO: 17306 - DNA, 15 bp, Homo sapiens
aatcccagacactca

SEQ ID NO: 17307 - DNA, 15 bp, Homo sapiens
taatcccagacactc

SEQ ID NO: 17308 - DNA, 15 bp, Homo sapiens
ataatcccagacact

SEQ ID NO: 17309 - DNA, 15 bp, Homo sapiens
tataatcccagacac

SEQ ID NO: 17310 - DNA, 15 bp, Homo sapiens
ctataatcccagaca

SEQ ID NO: 17311 - DNA, 15 bp, Homo sapiens
cctataatcccagac

SEQ ID NO: 17312 - DNA, 15 bp, Homo sapiens
gcctataatcccaga

SEQ ID NO: 17313 - DNA, 15 bp, Homo sapiens
acgcctataatccca

SEQ ID NO: 17314 - DNA, 15 bp, Homo sapiens
cacgcctataatccc

SEQ ID NO: 17315 - DNA, 15 bp, Homo sapiens
gcacgcctataatcc

SEQ ID NO: 17316 - DNA, 15 bp, Homo sapiens
cgcacgcctataatc

SEQ ID NO: 17317 - DNA, 15 bp, Homo sapiens
gcgcacgcctataat

SEQ ID NO: 17318 - DNA, 15 bp, Homo sapiens
ggcgcacgcctataa

SEQ ID NO: 17319 - DNA, 15 bp, Homo sapiens
tggcgcacgcctata

SEQ ID NO: 17320 - DNA, 15 bp, Homo sapiens
gtggcgcacgcctat

SEQ ID NO: 17321 - DNA, 15 bp, Homo sapiens
ggtggcgcacgccta

SEQ ID NO: 17322 - DNA, 15 bp, Homo sapiens
tggtggcgcacgcct

SEQ ID NO: 17323 - DNA, 15 bp, Homo sapiens
atggtggcgcacgcc

SEQ ID NO: 17324 - DNA, 15 bp, Homo sapiens
catggtggcgcacgc

SEQ ID NO: 17325 - DNA, 15 bp, Homo sapiens
gcatggtggcgcacg

SEQ ID NO: 17326 - DNA, 15 bp, Homo sapiens
ggcatggtggcgcac

SEQ ID NO: 17327 - DNA, 15 bp, Homo sapiens
gggcatggtggcgca

SEQ ID NO: 17328 - DNA, 15 bp, Homo sapiens
tgggcatggtggcgc

SEQ ID NO: 17329 - DNA, 15 bp, Homo sapiens
ctgggcatggtggcg

SEQ ID NO: 17330 - DNA, 15 bp, Homo sapiens
taagctgggcatggt

SEQ ID NO: 17331 - DNA, 15 bp, Homo sapiens
ataagctgggcatgg

SEQ ID NO: 17332 - DNA, 15 bp, Homo sapiens
aataagctgggcatg

SEQ ID NO: 17333 - DNA, 15 bp, Homo sapiens
aaataagctgggcat

SEQ ID NO: 17334 - DNA, 15 bp, Homo sapiens
aaaataagctgggca

SEQ ID NO: 17335 - DNA, 15 bp, Homo sapiens
aaaaataagctgggc

SEQ ID NO: 17336 - DNA, 15 bp, Homo sapiens
caaaaataagctggg

SEQ ID NO: 17337 - DNA, 15 bp, Homo sapiens
acaaaaataagctgg

SEQ ID NO: 17338 - DNA, 15 bp, Homo sapiens
tacaaaaataagctg

SEQ ID NO: 17339 - DNA, 15 bp, Homo sapiens
atacaaaaataagct

SEQ ID NO: 17340 - DNA, 15 bp, Homo sapiens
aatacaaaaataagc

SEQ ID NO: 17341 - DNA, 15 bp, Homo sapiens
aaatacaaaaataag

SEQ ID NO: 17342 - DNA, 15 bp, Homo sapiens
aaaatacaaaaataa

SEQ ID NO: 17343 - DNA, 15 bp, Homo sapiens
agtgaaaccccgtct

SEQ ID NO: 17344 - DNA, 15 bp, Homo sapiens
cagtgaaaccccgtc

SEQ ID NO: 17345 - DNA, 15 bp, Homo sapiens
acagtgaaaccccgt

SEQ ID NO: 17346 - DNA, 15 bp, Homo sapiens
cacagtgaaaccccg

SEQ ID NO: 17347 - DNA, 15 bp, Homo sapiens
acacagtgaaacccc

SEQ ID NO: 17348 - DNA, 15 bp, Homo sapiens
caacacagtgaaacc

SEQ ID NO: 17349 - DNA, 15 bp, Homo sapiens
ccaacacagtgaaac

SEQ ID NO: 17350 - DNA, 15 bp, Homo sapiens
accaacacagtgaaa

SEQ ID NO: 17351 - DNA, 15 bp, Homo sapiens
gaccaacacagtgaa

SEQ ID NO: 17352 - DNA, 15 bp, Homo sapiens
tgaccaacacagtga

SEQ ID NO: 17353 - DNA, 15 bp, Homo sapiens
ctgaccaacacagtg

SEQ ID NO: 17354 - DNA, 15 bp, Homo sapiens
cctgaccaacacagt

SEQ ID NO: 17355 - DNA, 15 bp, Homo sapiens
gcctgaccaacacag

SEQ ID NO: 17356 - DNA, 15 bp, Homo sapiens
agcctgaccaacaca

SEQ ID NO: 17357 - DNA, 15 bp, Homo sapiens
atcaggagttcgaga

SEQ ID NO: 17358 - DNA, 15 bp, Homo sapiens
gatcaggagttcgag

SEQ ID NO: 17359 - DNA, 15 bp, Homo sapiens
agatcaggagttcga

SEQ ID NO: 17360 - DNA, 15 bp, Homo sapiens
gagatcaggagttcg

SEQ ID NO: 17361 - DNA, 15 bp, Homo sapiens
tgagatcaggagttc

SEQ ID NO: 17362 - DNA, 15 bp, Homo sapiens
atgagatcaggagtt

SEQ ID NO: 17363 - DNA, 15 bp, Homo sapiens
catgagatcaggagt

SEQ ID NO: 17364 - DNA, 15 bp, Homo sapiens
tcatgagatcaggag

SEQ ID NO: 17365 - DNA, 15 bp, Homo sapiens
atcatgagatcagga

SEQ ID NO: 17366 - DNA, 15 bp, Homo sapiens
gatcatgagatcagg

SEQ ID NO: 17367 - DNA, 15 bp, Homo sapiens
ggatcatgagatcag

SEQ ID NO: 17368 - DNA, 15 bp, Homo sapiens
cggatcatgagatca

SEQ ID NO: 17369 - DNA, 15 bp, Homo sapiens
gcggatcatgagatc

SEQ ID NO: 17370 - DNA, 15 bp, Homo sapiens
ggcggatcatgagat

SEQ ID NO: 17371 - DNA, 15 bp, Homo sapiens
aggcggatcatgaga

SEQ ID NO: 17372 - DNA, 15 bp, Homo sapiens
caggcggatcatgag

SEQ ID NO: 17373 - DNA, 15 bp, Homo sapiens
gcaggcggatcatga

SEQ ID NO: 17374 - DNA, 15 bp, Homo sapiens
ggcaggcggatcatg

SEQ ID NO: 17375 - DNA, 15 bp, Homo sapiens
aaggcaggcggatca

SEQ ID NO: 17376 - DNA, 15 bp, Homo sapiens
caaggcaggcggatc

SEQ ID NO: 17377 - DNA, 15 bp, Homo sapiens
ccaaggcaggcggat

SEQ ID NO: 17378 - DNA, 15 bp, Homo sapiens
gccaaggcaggcgga

SEQ ID NO: 17379 - DNA, 15 bp, Homo sapiens
ggccaaggcaggcgg

SEQ ID NO: 17380 - DNA, 15 bp, Homo sapiens
aatgcctgtaatccc

SEQ ID NO: 17381 - DNA, 15 bp, Homo sapiens
aaatgcctgtaatcc

SEQ ID NO: 17382 - DNA, 15 bp, Homo sapiens
taaatgcctgtaatc

SEQ ID NO: 17383 - DNA, 15 bp, Homo sapiens
ttaaatgcctgtaat

SEQ ID NO: 17384 - DNA, 15 bp, Homo sapiens
tttaaatgcctgtaa

SEQ ID NO: 17385 - DNA, 15 bp, Homo sapiens
ttttaaatgcctgta

SEQ ID NO: 17386 - DNA, 15 bp, Homo sapiens
tttttaaatgcctgt

SEQ ID NO: 17387 - DNA, 15 bp, Homo sapiens
gtttttaaatgcctg

SEQ ID NO: 17388 - DNA, 15 bp, Homo sapiens
agtttttaaatgcct

SEQ ID NO: 17389 - DNA, 15 bp, Homo sapiens
aagtttttaaatgcc

SEQ ID NO: 17390 - DNA, 15 bp, Homo sapiens
aaagtttttaaatgc

SEQ ID NO: 17391 - DNA, 15 bp, Homo sapiens
aaaagtttttaaatg

SEQ ID NO: 17392 - DNA, 15 bp, Homo sapiens
aaaaagtttttaaat

SEQ ID NO: 17393 - DNA, 15 bp, Homo sapiens
taaaaagtttttaaa

SEQ ID NO: 17394 - DNA, 15 bp, Homo sapiens
ctaaaaagtttttaa

SEQ ID NO: 17395 - DNA, 15 bp, Homo sapiens
cctaaaaagttttta

SEQ ID NO: 17396 - DNA, 15 bp, Homo sapiens
gcctaaaaagttttt

SEQ ID NO: 17397 - DNA, 15 bp, Homo sapiens
agcctaaaaagtttt

SEQ ID NO: 17398 - DNA, 15 bp, Homo sapiens
cagcctaaaaagttt

SEQ ID NO: 17399 - DNA, 15 bp, Homo sapiens
ccagcctaaaaagtt

SEQ ID NO: 17400 - DNA, 15 bp, Homo sapiens
accagcctaaaaagt

SEQ ID NO: 17401 - DNA, 15 bp, Homo sapiens
gaccagcctaaaaag

SEQ ID NO: 17402 - DNA, 15 bp, Homo sapiens
tgaccagcctaaaaa

SEQ ID NO: 17403 - DNA, 15 bp, Homo sapiens
gtgaccagcctaaaa

SEQ ID NO: 17404 - DNA, 15 bp, Homo sapiens
cgtgaccagcctaaa

SEQ ID NO: 17405 - DNA, 15 bp, Homo sapiens
ccgtgaccagcctaa

SEQ ID NO: 17406 - DNA, 15 bp, Homo sapiens
accgtgaccagccta

SEQ ID NO: 17407 - DNA, 15 bp, Homo sapiens
caccgtgaccagcct

SEQ ID NO: 17408 - DNA, 15 bp, Homo sapiens
ccaccgtgaccagcc

SEQ ID NO: 17409 - DNA, 15 bp, Homo sapiens
gccaccgtgaccagc

SEQ ID NO: 17410 - DNA, 15 bp, Homo sapiens
agccaccgtgaccag

SEQ ID NO: 17411 - DNA, 15 bp, Homo sapiens
gagccaccgtgacca

SEQ ID NO: 17412 - DNA, 15 bp, Homo sapiens
tgagccaccgtgacc

SEQ ID NO: 17413 - DNA, 15 bp, Homo sapiens
atgagccaccgtgac

SEQ ID NO: 17414 - DNA, 15 bp, Homo sapiens
catgagccaccgtga

SEQ ID NO: 17415 - DNA, 15 bp, Homo sapiens
aattacaggcatgag

SEQ ID NO: 17416 - DNA, 15 bp, Homo sapiens
aaattacaggcatga

SEQ ID NO: 17417 - DNA, 15 bp, Homo sapiens
cctgaaattacaggc

SEQ ID NO: 17418 - DNA, 15 bp, Homo sapiens
tcctgaaattacagg

SEQ ID NO: 17419 - DNA, 15 bp, Homo sapiens
gtcctgaaattacag

SEQ ID NO: 17420 - DNA, 15 bp, Homo sapiens
agtcctgaaattaca

SEQ ID NO: 17421 - DNA, 15 bp, Homo sapiens
aagtcctgaaattac

SEQ ID NO: 17422 - DNA, 15 bp, Homo sapiens
aaagtcctgaaatta

SEQ ID NO: 17423 - DNA, 15 bp, Homo sapiens
caaagtcctgaaatt

SEQ ID NO: 17424 - DNA, 15 bp, Homo sapiens
ccaaagtcctgaaat

SEQ ID NO: 17425 - DNA, 15 bp, Homo sapiens
cccaaagtcctgaaa

SEQ ID NO: 17426 - DNA, 15 bp, Homo sapiens
tcccaaagtcctgaa

SEQ ID NO: 17427 - DNA, 15 bp, Homo sapiens
ctcccaaagtcctga

SEQ ID NO: 17428 - DNA, 15 bp, Homo sapiens
cctcccaaagtcctg

SEQ ID NO: 17429 - DNA, 15 bp, Homo sapiens
gcctcccaaagtcct

SEQ ID NO: 17430 - DNA, 15 bp, Homo sapiens
agcctcccaaagtcc

SEQ ID NO: 17431 - DNA, 15 bp, Homo sapiens
cagcctcccaaagtc

SEQ ID NO: 17432 - DNA, 15 bp, Homo sapiens
gcagcctcccaaagt

SEQ ID NO: 17433 - DNA, 15 bp, Homo sapiens
cgcagcctcccaaag

SEQ ID NO: 17434 - DNA, 15 bp, Homo sapiens
ccgcagcctcccaaa

SEQ ID NO: 17435 - DNA, 15 bp, Homo sapiens
gccgcagcctcccaa

SEQ ID NO: 17436 - DNA, 15 bp, Homo sapiens
tgccgcagcctccca

SEQ ID NO: 17437 - DNA, 15 bp, Homo sapiens
ctgccgcagcctccc

SEQ ID NO: 17438 - DNA, 15 bp, Homo sapiens
actgccgcagcctcc

SEQ ID NO: 17439 - DNA, 15 bp, Homo sapiens
tactgccgcagcctc

SEQ ID NO: 17440 - DNA, 15 bp, Homo sapiens
ctactgccgcagcct

SEQ ID NO: 17441 - DNA, 15 bp, Homo sapiens
cctactgccgcagcc

SEQ ID NO: 17442 - DNA, 15 bp, Homo sapiens
tcctactgccgcagc

SEQ ID NO: 17443 - DNA, 15 bp, Homo sapiens
atcctactgccgcag

SEQ ID NO: 17444 - DNA, 15 bp, Homo sapiens
gatcctactgccgca

SEQ ID NO: 17445 - DNA, 15 bp, Homo sapiens
tgatcctactgccgc

SEQ ID NO: 17446 - DNA, 15 bp, Homo sapiens
gtgatcctactgccg

SEQ ID NO: 17447 - DNA, 15 bp, Homo sapiens
agtgatcctactgcc

SEQ ID NO: 17448 - DNA, 15 bp, Homo sapiens
aagtgatcctactgc

SEQ ID NO: 17449 - DNA, 15 bp, Homo sapiens
caagtgatcctactg

SEQ ID NO: 17450 - DNA, 15 bp, Homo sapiens
acaagtgatcctact

SEQ ID NO: 17451 - DNA, 15 bp, Homo sapiens
cacaagtgatcctac

SEQ ID NO: 17452 - DNA, 15 bp, Homo sapiens
ccacaagtgatccta

SEQ ID NO: 17453 - DNA, 15 bp, Homo sapiens
gccacaagtgatcct

SEQ ID NO: 17454 - DNA, 15 bp, Homo sapiens
ggccacaagtgatcc

SEQ ID NO: 17455 - DNA, 15 bp, Homo sapiens
tggccacaagtgatc

SEQ ID NO: 17456 - DNA, 15 bp, Homo sapiens
ttggccacaagtgat

SEQ ID NO: 17457 - DNA, 15 bp, Homo sapiens
cttggccacaagtga

SEQ ID NO: 17458 - DNA, 15 bp, Homo sapiens
tcttggccacaagtg

SEQ ID NO: 17459 - DNA, 15 bp, Homo sapiens
ctcttggccacaagt

SEQ ID NO: 17460 - DNA, 15 bp, Homo sapiens
actcttggccacaag

SEQ ID NO: 17461 - DNA, 15 bp, Homo sapiens
aactcttggccacaa

SEQ ID NO: 17462 - DNA, 15 bp, Homo sapiens
aaactcttggccaca

SEQ ID NO: 17463 - DNA, 15 bp, Homo sapiens
caaactcttggccac

SEQ ID NO: 17464 - DNA, 15 bp, Homo sapiens
tcaaactcttggcca

SEQ ID NO: 17465 - DNA, 15 bp, Homo sapiens
ctcaaactcttggcc

SEQ ID NO: 17466 - DNA, 15 bp, Homo sapiens
tctcaaactcttggc

SEQ ID NO: 17467 - DNA, 15 bp, Homo sapiens
ctctcaaactcttgg

SEQ ID NO: 17468 - DNA, 15 bp, Homo sapiens
tctctcaaactcttg

SEQ ID NO: 17469 - DNA, 15 bp, Homo sapiens
ctctctcaaactctt

SEQ ID NO: 17470 - DNA, 15 bp, Homo sapiens
gctctctcaaactct

SEQ ID NO: 17471 - DNA, 15 bp, Homo sapiens
tgctctctcaaactc

SEQ ID NO: 17472 - DNA, 15 bp, Homo sapiens
ctgctctctcaaact

SEQ ID NO: 17473 - DNA, 15 bp, Homo sapiens
actgctctctcaaac

SEQ ID NO: 17474 - DNA, 15 bp, Homo sapiens
aactgctctctcaaa

SEQ ID NO: 17475 - DNA, 15 bp, Homo sapiens
taactgctctctcaa

SEQ ID NO: 17476 - DNA, 15 bp, Homo sapiens
ataactgctctctca

SEQ ID NO: 17477 - DNA, 15 bp, Homo sapiens
tataactgctctctc

SEQ ID NO: 17478 - DNA, 15 bp, Homo sapiens
ctataactgctctct

SEQ ID NO: 17479 - DNA, 15 bp, Homo sapiens
actataactgctctc

SEQ ID NO: 17480 - DNA, 15 bp, Homo sapiens
gactataactgctct

SEQ ID NO: 17481 - DNA, 15 bp, Homo sapiens
agactataactgctc

SEQ ID NO: 17482 - DNA, 15 bp, Homo sapiens
gagactataactgct

SEQ ID NO: 17483 - DNA, 15 bp, Homo sapiens
agagactataactgc

SEQ ID NO: 17484 - DNA, 15 bp, Homo sapiens
tagagactataactg

SEQ ID NO: 17485 - DNA, 15 bp, Homo sapiens
atagagactataact

SEQ ID NO: 17486 - DNA, 15 bp, Homo sapiens
tatagagactataac

SEQ ID NO: 17487 - DNA, 15 bp, Homo sapiens
ttatagagactataa

SEQ ID NO: 17488 - DNA, 15 bp, Homo sapiens
attatagagactata

SEQ ID NO: 17489 - DNA, 15 bp, Homo sapiens
cattatagagactat

SEQ ID NO: 17490 - DNA, 15 bp, Homo sapiens
tcattatagagacta

SEQ ID NO: 17491 - DNA, 15 bp, Homo sapiens
ttcattatagagact

SEQ ID NO: 17492 - DNA, 15 bp, Homo sapiens
tttcattatagagac

SEQ ID NO: 17493 - DNA, 15 bp, Homo sapiens
ttttcattatagaga

SEQ ID NO: 17494 - DNA, 15 bp, Homo sapiens
attttcattatagag

SEQ ID NO: 17495 - DNA, 15 bp, Homo sapiens
gattttcattataga

SEQ ID NO: 17496 - DNA, 15 bp, Homo sapiens
agattttcattatag

SEQ ID NO: 17497 - DNA, 15 bp, Homo sapiens
aagattttcattata

SEQ ID NO: 17498 - DNA, 15 bp, Homo sapiens
aaagattttcattat

SEQ ID NO: 17499 - DNA, 15 bp, Homo sapiens
aaaagattttcatta

SEQ ID NO: 17500 - DNA, 15 bp, Homo sapiens
aaaaagattttcatt

SEQ ID NO: 17501 - DNA, 15 bp, Homo sapiens
aaaaaagattttcat

SEQ ID NO: 17502 - DNA, 15 bp, Homo sapiens
aaaaaaagattttca

SEQ ID NO: 17503 - DNA, 15 bp, Homo sapiens
aaaaaaaagattttc

SEQ ID NO: 17504 - DNA, 15 bp, Homo sapiens
aaaaaaaaagatttt

SEQ ID NO: 17505 - DNA, 15 bp, Homo sapiens
aaaaaaaaaagattt

SEQ ID NO: 17506 - DNA, 15 bp, Homo sapiens
aaaaaaaaaaagatt

SEQ ID NO: 17507 - DNA, 15 bp, Homo sapiens
tgtctttaaaaaaaa

SEQ ID NO: 17508 - DNA, 15 bp, Homo sapiens
ctgtctttaaaaaaa

SEQ ID NO: 17509 - DNA, 15 bp, Homo sapiens
tctgtctttaaaaaa

SEQ ID NO: 17510 - DNA, 15 bp, Homo sapiens
ctctgtctttaaaaa

SEQ ID NO: 17511 - DNA, 15 bp, Homo sapiens
actctgtctttaaaa

SEQ ID NO: 17512 - DNA, 15 bp, Homo sapiens
aactctgtctttaaa

SEQ ID NO: 17513 - DNA, 15 bp, Homo sapiens
caactctgtctttaa

SEQ ID NO: 17514 - DNA, 15 bp, Homo sapiens
gcaactctgtcttta

SEQ ID NO: 17515 - DNA, 15 bp, Homo sapiens
tgcaactctgtcttt

SEQ ID NO: 17516 - DNA, 15 bp, Homo sapiens
gtgcaactctgtctt

SEQ ID NO: 17517 - DNA, 15 bp, Homo sapiens
agtgcaactctgtct

SEQ ID NO: 17518 - DNA, 15 bp, Homo sapiens
gagtgcaactctgtc

SEQ ID NO: 17519 - DNA, 15 bp, Homo sapiens
agagtgcaactctgt

SEQ ID NO: 17520 - DNA, 15 bp, Homo sapiens
cagagtgcaactctg

SEQ ID NO: 17521 - DNA, 15 bp, Homo sapiens
acagagtgcaactct

SEQ ID NO: 17522 - DNA, 15 bp, Homo sapiens
cacagagtgcaactc

SEQ ID NO: 17523 - DNA, 15 bp, Homo sapiens
ccacagagtgcaact

SEQ ID NO: 17524 - DNA, 15 bp, Homo sapiens
gccacagagtgcaac

SEQ ID NO: 17525 - DNA, 15 bp, Homo sapiens
ggccacagagtgcaa

SEQ ID NO: 17526 - DNA, 15 bp, Homo sapiens
gggccacagagtgca

SEQ ID NO: 17527 - DNA, 15 bp, Homo sapiens
tgggccacagagtgc

SEQ ID NO: 17528 - DNA, 15 bp, Homo sapiens
ctgggccacagagtg

SEQ ID NO: 17529 - DNA, 15 bp, Homo sapiens
actgggccacagagt

SEQ ID NO: 17530 - DNA, 15 bp, Homo sapiens
cactgggccacagag

SEQ ID NO: 17531 - DNA, 15 bp, Homo sapiens
ccactgggccacaga

SEQ ID NO: 17532 - DNA, 15 bp, Homo sapiens
gccactgggccacag

SEQ ID NO: 17533 - DNA, 15 bp, Homo sapiens
cgccactgggccaca

SEQ ID NO: 17534 - DNA, 15 bp, Homo sapiens
gcgccactgggccac

SEQ ID NO: 17535 - DNA, 15 bp, Homo sapiens
cgcgccactgggcca

SEQ ID NO: 17536 - DNA, 15 bp, Homo sapiens
tcgcgccactgggcc

SEQ ID NO: 17537 - DNA, 15 bp, Homo sapiens
atcgcgccactgggc

SEQ ID NO: 17538 - DNA, 15 bp, Homo sapiens
gatcgcgccactggg

SEQ ID NO: 17539 - DNA, 15 bp, Homo sapiens
agatcgcgccactgg

SEQ ID NO: 17540 - DNA, 15 bp, Homo sapiens
ctgagctgagatcgc

SEQ ID NO: 17541 - DNA, 15 bp, Homo sapiens
actgagctgagatcg

SEQ ID NO: 17542 - DNA, 15 bp, Homo sapiens
cactgagctgagatc

SEQ ID NO: 17543 - DNA, 15 bp, Homo sapiens
gcactgagctgagat

SEQ ID NO: 17544 - DNA, 15 bp, Homo sapiens
tgcactgagctgaga

SEQ ID NO: 17545 - DNA, 15 bp, Homo sapiens
ctgcactgagctgag

SEQ ID NO: 17546 - DNA, 15 bp, Homo sapiens
gctgcactgagctga

SEQ ID NO: 17547 - DNA, 15 bp, Homo sapiens
ggctgcactgagctg

SEQ ID NO: 17548 - DNA, 15 bp, Homo sapiens
aggctgcactgagct

SEQ ID NO: 17549 - DNA, 15 bp, Homo sapiens
gaggctgcactgagc

SEQ ID NO: 17550 - DNA, 15 bp, Homo sapiens
agaggctgcactgag

SEQ ID NO: 17551 - DNA, 15 bp, Homo sapiens
cagaggctgcactga

SEQ ID NO: 17552 - DNA, 15 bp, Homo sapiens
gcagaggctgcactg

SEQ ID NO: 17553 - DNA, 15 bp, Homo sapiens
agcagaggctgcact

SEQ ID NO: 17554 - DNA, 15 bp, Homo sapiens
aagcagaggctgcac

SEQ ID NO: 17555 - DNA, 15 bp, Homo sapiens
gaagcagaggctgca

SEQ ID NO: 17556 - DNA, 15 bp, Homo sapiens
ggaagcagaggctgc

SEQ ID NO: 17557 - DNA, 15 bp, Homo sapiens
cggaagcagaggctg

SEQ ID NO: 17558 - DNA, 15 bp, Homo sapiens
ccggaagcagaggct

SEQ ID NO: 17559 - DNA, 15 bp, Homo sapiens
cccggaagcagaggc

SEQ ID NO: 17560 - DNA, 15 bp, Homo sapiens
ccccggaagcagagg

SEQ ID NO: 17561 - DNA, 15 bp, Homo sapiens
accccggaagcagag

SEQ ID NO: 17562 - DNA, 15 bp, Homo sapiens
aaccccggaagcaga

SEQ ID NO: 17563 - DNA, 15 bp, Homo sapiens
gaaccccggaagcag

SEQ ID NO: 17564 - DNA, 15 bp, Homo sapiens
tgaaccccggaagca

SEQ ID NO: 17565 - DNA, 15 bp, Homo sapiens
ttgaaccccggaagc

SEQ ID NO: 17566 - DNA, 15 bp, Homo sapiens
cttgaaccccggaag

SEQ ID NO: 17567 - DNA, 15 bp, Homo sapiens
acttgaaccccggaa

SEQ ID NO: 17568 - DNA, 15 bp, Homo sapiens
tacttgaaccccgga

SEQ ID NO: 17569 - DNA, 15 bp, Homo sapiens
ttacttgaaccccgg

SEQ ID NO: 17570 - DNA, 15 bp, Homo sapiens
attacttgaaccccg

SEQ ID NO: 17571 - DNA, 15 bp, Homo sapiens
aattacttgaacccc

SEQ ID NO: 17572 - DNA, 15 bp, Homo sapiens
gaattacttgaaccc

SEQ ID NO: 17573 - DNA, 15 bp, Homo sapiens
agaattacttgaacc

SEQ ID NO: 17574 - DNA, 15 bp, Homo sapiens
gagaattacttgaac

SEQ ID NO: 17575 - DNA, 15 bp, Homo sapiens
tgagaattacttgaa

SEQ ID NO: 17576 - DNA, 15 bp, Homo sapiens
atgagaattacttga

SEQ ID NO: 17577 - DNA, 15 bp, Homo sapiens
catgagaattacttg

SEQ ID NO: 17578 - DNA, 15 bp, Homo sapiens
gcatgagaattactt

SEQ ID NO: 17579 - DNA, 15 bp, Homo sapiens
ggcatgagaattact

SEQ ID NO: 17580 - DNA, 15 bp, Homo sapiens
aggcatgagaattac

SEQ ID NO: 17581 - DNA, 15 bp, Homo sapiens
gaggcatgagaatta

SEQ ID NO: 17582 - DNA, 15 bp, Homo sapiens
tgaggcatgagaatt

SEQ ID NO: 17583 - DNA, 15 bp, Homo sapiens
ctgaggcatgagaat

SEQ ID NO: 17584 - DNA, 15 bp, Homo sapiens
gctgaggcatgagaa

SEQ ID NO: 17585 - DNA, 15 bp, Homo sapiens
ggctgaggcatgaga

SEQ ID NO: 17586 - DNA, 15 bp, Homo sapiens
aggctgaggcatgag

SEQ ID NO: 17587 - DNA, 15 bp, Homo sapiens
gaggctgaggcatga

SEQ ID NO: 17588 - DNA, 15 bp, Homo sapiens
ggaggctgaggcatg

SEQ ID NO: 17589 - DNA, 15 bp, Homo sapiens
gggaggctgaggcat

SEQ ID NO: 17590 - DNA, 15 bp, Homo sapiens
agctactagggaggc

SEQ ID NO: 17591 - DNA, 15 bp, Homo sapiens
cagctactagggagg

SEQ ID NO: 17592 - DNA, 15 bp, Homo sapiens
tcagctactagggag

SEQ ID NO: 17593 - DNA, 15 bp, Homo sapiens
ttcagctactaggga

SEQ ID NO: 17594 - DNA, 15 bp, Homo sapiens
tttcagctactaggg

SEQ ID NO: 17595 - DNA, 15 bp, Homo sapiens
atttcagctactagg

SEQ ID NO: 17596 - DNA, 15 bp, Homo sapiens
aatttcagctactag

SEQ ID NO: 17597 - DNA, 15 bp, Homo sapiens
taatttcagctacta

SEQ ID NO: 17598 - DNA, 15 bp, Homo sapiens
gtaatttcagctact

SEQ ID NO: 17599 - DNA, 15 bp, Homo sapiens
tgtaatttcagctac

SEQ ID NO: 17600 - DNA, 15 bp, Homo sapiens
ctgtaatttcagcta

SEQ ID NO: 17601 - DNA, 15 bp, Homo sapiens
cctgtaatttcagct

SEQ ID NO: 17602 - DNA, 15 bp, Homo sapiens
gcctgtaatttcagc

SEQ ID NO: 17603 - DNA, 15 bp, Homo sapiens
gcatgcctgtaattt

SEQ ID NO: 17604 - DNA, 15 bp, Homo sapiens
tgcatgcctgtaatt

SEQ ID NO: 17605 - DNA, 15 bp, Homo sapiens
aggtgtggtggtgca

SEQ ID NO: 17606 - DNA, 15 bp, Homo sapiens
caggtgtggtggtgc

SEQ ID NO: 17607 - DNA, 15 bp, Homo sapiens
ccaggtgtggtggtg

SEQ ID NO: 17608 - DNA, 15 bp, Homo sapiens
gccaggtgtggtggt

SEQ ID NO: 17609 - DNA, 15 bp, Homo sapiens
caattagccaggtgt

SEQ ID NO: 17610 - DNA, 15 bp, Homo sapiens
acaattagccaggtg

SEQ ID NO: 17611 - DNA, 15 bp, Homo sapiens
tacaattagccaggt

SEQ ID NO: 17612 - DNA, 15 bp, Homo sapiens
atacaattagccagg

SEQ ID NO: 17613 - DNA, 15 bp, Homo sapiens
aatacaattagccag

SEQ ID NO: 17614 - DNA, 15 bp, Homo sapiens
aaatacaattagcca

SEQ ID NO: 17615 - DNA, 15 bp, Homo sapiens
aaaatacaattagcc

SEQ ID NO: 17616 - DNA, 15 bp, Homo sapiens
aaaaatacaattagc

SEQ ID NO: 17617 - DNA, 15 bp, Homo sapiens
taaaaatacaattag

SEQ ID NO: 17618 - DNA, 15 bp, Homo sapiens
ctaaaaatacaatta

SEQ ID NO: 17619 - DNA, 15 bp, Homo sapiens
actaaaaatacaatt

SEQ ID NO: 17620 - DNA, 15 bp, Homo sapiens
tactaaaaatacaat

SEQ ID NO: 17621 - DNA, 15 bp, Homo sapiens
tatctctactaaaaa

SEQ ID NO: 17622 - DNA, 15 bp, Homo sapiens
aaaaccctatctcta

SEQ ID NO: 17623 - DNA, 15 bp, Homo sapiens
caaaaccctatctct

SEQ ID NO: 17624 - DNA, 15 bp, Homo sapiens
gcaaaaccctatctc

SEQ ID NO: 17625 - DNA, 15 bp, Homo sapiens
ggcaaaaccctatct

SEQ ID NO: 17626 - DNA, 15 bp, Homo sapiens
tggcaaaaccctatc

SEQ ID NO: 17627 - DNA, 15 bp, Homo sapiens
atggcaaaaccctat

SEQ ID NO: 17628 - DNA, 15 bp, Homo sapiens
catggcaaaacccta

SEQ ID NO: 17629 - DNA, 15 bp, Homo sapiens
acatggcaaaaccct

SEQ ID NO: 17630 - DNA, 15 bp, Homo sapiens
aacatggcaaaaccc

SEQ ID NO: 17631 - DNA, 15 bp, Homo sapiens
caacatggcaaaacc

SEQ ID NO: 17632 - DNA, 15 bp, Homo sapiens
acaacatggcaaaac

SEQ ID NO: 17633 - DNA, 15 bp, Homo sapiens
gacaacatggcaaaa

SEQ ID NO: 17634 - DNA, 15 bp, Homo sapiens
ggacaacatggcaaa

SEQ ID NO: 17635 - DNA, 15 bp, Homo sapiens
tggacaacatggcaa

SEQ ID NO: 17636 - DNA, 15 bp, Homo sapiens
ctggacaacatggca

SEQ ID NO: 17637 - DNA, 15 bp, Homo sapiens
cctggacaacatggc

SEQ ID NO: 17638 - DNA, 15 bp, Homo sapiens
gcctggacaacatgg

SEQ ID NO: 17639 - DNA, 15 bp, Homo sapiens
agcctggacaacatg

SEQ ID NO: 17640 - DNA, 15 bp, Homo sapiens
cagcctggacaacat

SEQ ID NO: 17641 - DNA, 15 bp, Homo sapiens
gtcaagaccagcctg

SEQ ID NO: 17642 - DNA, 15 bp, Homo sapiens
ggtcaagaccagcct

SEQ ID NO: 17643 - DNA, 15 bp, Homo sapiens
aggtcaagaccagcc

SEQ ID NO: 17644 - DNA, 15 bp, Homo sapiens
gaggtcaagaccagc

SEQ ID NO: 17645 - DNA, 15 bp, Homo sapiens
ggaggtcaagaccag

SEQ ID NO: 17646 - DNA, 15 bp, Homo sapiens
aggaggtcaagacca

SEQ ID NO: 17647 - DNA, 15 bp, Homo sapiens
caggaggtcaagacc

SEQ ID NO: 17648 - DNA, 15 bp, Homo sapiens
tcaggaggtcaagac

SEQ ID NO: 17649 - DNA, 15 bp, Homo sapiens
gtcaggaggtcaaga

SEQ ID NO: 17650 - DNA, 15 bp, Homo sapiens
ggtcaggaggtcaag

SEQ ID NO: 17651 - DNA, 15 bp, Homo sapiens
aggtcaggaggtcaa

SEQ ID NO: 17652 - DNA, 15 bp, Homo sapiens
caggtcaggaggtca

SEQ ID NO: 17653 - DNA, 15 bp, Homo sapiens
tcaggtcaggaggtc

SEQ ID NO: 17654 - DNA, 15 bp, Homo sapiens
ttcaggtcaggaggt

SEQ ID NO: 17655 - DNA, 15 bp, Homo sapiens
cttcaggtcaggagg

SEQ ID NO: 17656 - DNA, 15 bp, Homo sapiens
acttcaggtcaggag

SEQ ID NO: 17657 - DNA, 15 bp, Homo sapiens
cacttcaggtcagga

SEQ ID NO: 17658 - DNA, 15 bp, Homo sapiens
tcacttcaggtcagg

SEQ ID NO: 17659 - DNA, 15 bp, Homo sapiens
atcacttcaggtcag

SEQ ID NO: 17660 - DNA, 15 bp, Homo sapiens
gatcacttcaggtca

SEQ ID NO: 17661 - DNA, 15 bp, Homo sapiens
cgatcacttcaggtc

SEQ ID NO: 17662 - DNA, 15 bp, Homo sapiens
gcgatcacttcaggt

SEQ ID NO: 17663 - DNA, 15 bp, Homo sapiens
ggcgatcacttcagg

SEQ ID NO: 17664 - DNA, 15 bp, Homo sapiens
gggcgatcacttcag

SEQ ID NO: 17665 - DNA, 15 bp, Homo sapiens
cgggcgatcacttca

SEQ ID NO: 17666 - DNA, 15 bp, Homo sapiens
gcgggcgatcacttc

SEQ ID NO: 17667 - DNA, 15 bp, Homo sapiens
ggcgggcgatcactt

SEQ ID NO: 17668 - DNA, 15 bp, Homo sapiens
aggcgggcgatcact

SEQ ID NO: 17669 - DNA, 15 bp, Homo sapiens
gaggcgggcgatcac

SEQ ID NO: 17670 - DNA, 15 bp, Homo sapiens
tgaggcgggcgatca

SEQ ID NO: 17671 - DNA, 15 bp, Homo sapiens
ttgaggcgggcgatc

SEQ ID NO: 17672 - DNA, 15 bp, Homo sapiens
tttgaggcgggcgat

SEQ ID NO: 17673 - DNA, 15 bp, Homo sapiens
gtttgaggcgggcga

SEQ ID NO: 17674 - DNA, 15 bp, Homo sapiens
ggtttgaggcgggcg

SEQ ID NO: 17675 - DNA, 15 bp, Homo sapiens
gggtttgaggcgggc

SEQ ID NO: 17676 - DNA, 15 bp, Homo sapiens
ggggtttgaggcggg

SEQ ID NO: 17677 - DNA, 15 bp, Homo sapiens
gggggtttgaggcgg

SEQ ID NO: 17678 - DNA, 15 bp, Homo sapiens
tgggggtttgaggcg

SEQ ID NO: 17679 - DNA, 15 bp, Homo sapiens
ttgggggtttgaggc

SEQ ID NO: 17680 - DNA, 15 bp, Homo sapiens
tttgggggtttgagg

SEQ ID NO: 17681 - DNA, 15 bp, Homo sapiens
ctttgggggtttgag

SEQ ID NO: 17682 - DNA, 15 bp, Homo sapiens
actttgggggtttga

SEQ ID NO: 17683 - DNA, 15 bp, Homo sapiens
cactttgggggtttg

SEQ ID NO: 17684 - DNA, 15 bp, Homo sapiens
gcactttgggggttt

SEQ ID NO: 17685 - DNA, 15 bp, Homo sapiens
agcactttgggggtt

SEQ ID NO: 17686 - DNA, 15 bp, Homo sapiens
cagcactttgggggt

SEQ ID NO: 17687 - DNA, 15 bp, Homo sapiens
ccagcactttggggg

SEQ ID NO: 17688 - DNA, 15 bp, Homo sapiens
cccagcactttgggg

SEQ ID NO: 17689 - DNA, 15 bp, Homo sapiens
tatgtctgtaatccc

SEQ ID NO: 17690 - DNA, 15 bp, Homo sapiens
ttatgtctgtaatcc

SEQ ID NO: 17691 - DNA, 15 bp, Homo sapiens
cttatgtctgtaatc

SEQ ID NO: 17692 - DNA, 15 bp, Homo sapiens
acttatgtctgtaat

SEQ ID NO: 17693 - DNA, 15 bp, Homo sapiens
gacttatgtctgtaa

SEQ ID NO: 17694 - DNA, 15 bp, Homo sapiens
tgacttatgtctgta

SEQ ID NO: 17695 - DNA, 15 bp, Homo sapiens
atgacttatgtctgt

SEQ ID NO: 17696 - DNA, 15 bp, Homo sapiens
gatgacttatgtctg

SEQ ID NO: 17697 - DNA, 15 bp, Homo sapiens
tgatgacttatgtct

SEQ ID NO: 17698 - DNA, 15 bp, Homo sapiens
gtgatgacttatgtc

SEQ ID NO: 17699 - DNA, 15 bp, Homo sapiens
tgtgatgacttatgt

SEQ ID NO: 17700 - DNA, 15 bp, Homo sapiens
gtgtgatgacttatg

SEQ ID NO: 17701 - DNA, 15 bp, Homo sapiens
ggtgtgatgacttat

SEQ ID NO: 17702 - DNA, 15 bp, Homo sapiens
gggtgtgatgactta

SEQ ID NO: 17703 - DNA, 15 bp, Homo sapiens
tgggtgtgatgactt

SEQ ID NO: 17704 - DNA, 15 bp, Homo sapiens
ctgggtgtgatgact

SEQ ID NO: 17705 - DNA, 15 bp, Homo sapiens
gctgggtgtgatgac

SEQ ID NO: 17706 - DNA, 15 bp, Homo sapiens
ggctgggtgtgatga

SEQ ID NO: 17707 - DNA, 15 bp, Homo sapiens
aggctgggtgtgatg

SEQ ID NO: 17708 - DNA, 15 bp, Homo sapiens
taggctgggtgtgat

SEQ ID NO: 17709 - DNA, 15 bp, Homo sapiens
ataggctgggtgtga

SEQ ID NO: 17710 - DNA, 15 bp, Homo sapiens
tataggctgggtgtg

SEQ ID NO: 17711 - DNA, 15 bp, Homo sapiens
ttataggctgggtgt

SEQ ID NO: 17712 - DNA, 15 bp, Homo sapiens
attataggctgggtg

SEQ ID NO: 17713 - DNA, 15 bp, Homo sapiens
tattataggctgggt

SEQ ID NO: 17714 - DNA, 15 bp, Homo sapiens
ttattataggctggg

SEQ ID NO: 17715 - DNA, 15 bp, Homo sapiens
tttattataggctgg

SEQ ID NO: 17716 - DNA, 15 bp, Homo sapiens
ttttattataggctg

SEQ ID NO: 17717 - DNA, 15 bp, Homo sapiens
tttttattataggct

SEQ ID NO: 17718 - DNA, 15 bp, Homo sapiens
ttttttattataggc

SEQ ID NO: 17719 - DNA, 15 bp, Homo sapiens
gttttttattatagg

SEQ ID NO: 17720 - DNA, 15 bp, Homo sapiens
agttttttattatag

SEQ ID NO: 17721 - DNA, 15 bp, Homo sapiens
aagttttttattata

SEQ ID NO: 17722 - DNA, 15 bp, Homo sapiens
aaagttttttattat

SEQ ID NO: 17723 - DNA, 15 bp, Homo sapiens
taaagttttttatta

SEQ ID NO: 17724 - DNA, 15 bp, Homo sapiens
ttaaagttttttatt

SEQ ID NO: 17725 - DNA, 15 bp, Homo sapiens
tttaaagttttttat

SEQ ID NO: 17726 - DNA, 15 bp, Homo sapiens
ttttaaagtttttta

SEQ ID NO: 17727 - DNA, 15 bp, Homo sapiens
cttttaaagtttttt

SEQ ID NO: 17728 - DNA, 15 bp, Homo sapiens
acttttaaagttttt

SEQ ID NO: 17729 - DNA, 15 bp, Homo sapiens
aacttttaaagtttt

SEQ ID NO: 17730 - DNA, 15 bp, Homo sapiens
aaacttttaaagttt

SEQ ID NO: 17731 - DNA, 15 bp, Homo sapiens
taaacttttaaagtt

SEQ ID NO: 17732 - DNA, 15 bp, Homo sapiens
ttaaacttttaaagt

SEQ ID NO: 17733 - DNA, 15 bp, Homo sapiens
tttaaacttttaaag

SEQ ID NO: 17734 - DNA, 15 bp, Homo sapiens
ttttaaacttttaaa

SEQ ID NO: 17735 - DNA, 15 bp, Homo sapiens
tttttaaacttttaa

SEQ ID NO: 17736 - DNA, 15 bp, Homo sapiens
ttttttaaactttta

SEQ ID NO: 17737 - DNA, 15 bp, Homo sapiens
tttttttaaactttt

SEQ ID NO: 17738 - DNA, 15 bp, Homo sapiens
ttttttttaaacttt

SEQ ID NO: 17739 - DNA, 15 bp, Homo sapiens
tttttttttaaactt

SEQ ID NO: 17740 - DNA, 15 bp, Homo sapiens
atttttttttaaact

SEQ ID NO: 17741 - DNA, 15 bp, Homo sapiens
aatttttttttaaac

SEQ ID NO: 17742 - DNA, 15 bp, Homo sapiens
aaatttttttttaaa

SEQ ID NO: 17743 - DNA, 15 bp, Homo sapiens
taaatttttttttaa

SEQ ID NO: 17744 - DNA, 15 bp, Homo sapiens
ttaaattttttttta

SEQ ID NO: 17745 - DNA, 15 bp, Homo sapiens
tttaaattttttttt

SEQ ID NO: 17746 - DNA, 15 bp, Homo sapiens
gtttaaatttttttt

SEQ ID NO: 17747 - DNA, 15 bp, Homo sapiens
agtttaaattttttt

SEQ ID NO: 17748 - DNA, 15 bp, Homo sapiens
aagtttaaatttttt

SEQ ID NO: 17749 - DNA, 15 bp, Homo sapiens
gaagtttaaattttt

SEQ ID NO: 17750 - DNA, 15 bp, Homo sapiens
tgaagtttaaatttt

SEQ ID NO: 17751 - DNA, 15 bp, Homo sapiens
atgaagtttaaattt

SEQ ID NO: 17752 - DNA, 15 bp, Homo sapiens
tatgaagtttaaatt

SEQ ID NO: 17753 - DNA, 15 bp, Homo sapiens
ctatgaagtttaaat

SEQ ID NO: 17754 - DNA, 15 bp, Homo sapiens
tctatgaagtttaaa

SEQ ID NO: 17755 - DNA, 15 bp, Homo sapiens
ctctatgaagtttaa

SEQ ID NO: 17756 - DNA, 15 bp, Homo sapiens
cctctatgaagttta

SEQ ID NO: 17757 - DNA, 15 bp, Homo sapiens
acctctatgaagttt

SEQ ID NO: 17758 - DNA, 15 bp, Homo sapiens
aacctctatgaagtt

SEQ ID NO: 17759 - DNA, 15 bp, Homo sapiens
gaacctctatgaagt

SEQ ID NO: 17760 - DNA, 15 bp, Homo sapiens
agaacctctatgaag

SEQ ID NO: 17761 - DNA, 15 bp, Homo sapiens
gagaacctctatgaa

SEQ ID NO: 17762 - DNA, 15 bp, Homo sapiens
cgagaacctctatga

SEQ ID NO: 17763 - DNA, 15 bp, Homo sapiens
tcgagaacctctatg

SEQ ID NO: 17764 - DNA, 15 bp, Homo sapiens
ttcgagaacctctat

SEQ ID NO: 17765 - DNA, 15 bp, Homo sapiens
attcgagaacctcta

SEQ ID NO: 17766 - DNA, 15 bp, Homo sapiens
tattcgagaacctct

SEQ ID NO: 17767 - DNA, 15 bp, Homo sapiens
atattcgagaacctc

SEQ ID NO: 17768 - DNA, 15 bp, Homo sapiens
aatattcgagaacct

SEQ ID NO: 17769 - DNA, 15 bp, Homo sapiens
taatattcgagaacc

SEQ ID NO: 17770 - DNA, 15 bp, Homo sapiens
ataatattcgagaac

SEQ ID NO: 17771 - DNA, 15 bp, Homo sapiens
gataatattcgagaa

SEQ ID NO: 17772 - DNA, 15 bp, Homo sapiens
agataatattcgaga

SEQ ID NO: 17773 - DNA, 15 bp, Homo sapiens
aagataatattcgag

SEQ ID NO: 17774 - DNA, 15 bp, Homo sapiens
aaagataatattcga

SEQ ID NO: 17775 - DNA, 15 bp, Homo sapiens
gaaagataatattcg

SEQ ID NO: 17776 - DNA, 15 bp, Homo sapiens
agaaagataatattc

SEQ ID NO: 17777 - DNA, 15 bp, Homo sapiens
aagaaagataatatt

SEQ ID NO: 17778 - DNA, 15 bp, Homo sapiens
aaagaaagataatat

SEQ ID NO: 17779 - DNA, 15 bp, Homo sapiens
gaaagaaagataata

SEQ ID NO: 17780 - DNA, 15 bp, Homo sapiens
tgaaagaaagataat

SEQ ID NO: 17781 - DNA, 15 bp, Homo sapiens
atgaaagaaagataa

SEQ ID NO: 17782 - DNA, 15 bp, Homo sapiens
aatgaaagaaagata

SEQ ID NO: 17783 - DNA, 15 bp, Homo sapiens
taatgaaagaaagat

SEQ ID NO: 17784 - DNA, 15 bp, Homo sapiens
ttaatgaaagaaaga

SEQ ID NO: 17785 - DNA, 15 bp, Homo sapiens
cttaatgaaagaaag

SEQ ID NO: 17786 - DNA, 15 bp, Homo sapiens
tcttaatgaaagaaa

SEQ ID NO: 17787 - DNA, 15 bp, Homo sapiens
ttcttaatgaaagaa

SEQ ID NO: 17788 - DNA, 15 bp, Homo sapiens
tttcttaatgaaaga

SEQ ID NO: 17789 - DNA, 15 bp, Homo sapiens
atttcttaatgaaag

SEQ ID NO: 17790 - DNA, 15 bp, Homo sapiens
gatttcttaatgaaa

SEQ ID NO: 17791 - DNA, 15 bp, Homo sapiens
tgatttcttaatgaa

SEQ ID NO: 17792 - DNA, 15 bp, Homo sapiens
atgatttcttaatga

SEQ ID NO: 17793 - DNA, 15 bp, Homo sapiens
tatgatttcttaatg

SEQ ID NO: 17794 - DNA, 15 bp, Homo sapiens
ttatgatttcttaat

SEQ ID NO: 17795 - DNA, 15 bp, Homo sapiens
attatgatttcttaa

SEQ ID NO: 17796 - DNA, 15 bp, Homo sapiens
cattatgatttctta

SEQ ID NO: 17797 - DNA, 15 bp, Homo sapiens
acattatgatttctt

SEQ ID NO: 17798 - DNA, 15 bp, Homo sapiens
tacattatgatttct

SEQ ID NO: 17799 - DNA, 15 bp, Homo sapiens
ctacattatgatttc

SEQ ID NO: 17800 - DNA, 15 bp, Homo sapiens
actacattatgattt

SEQ ID NO: 17801 - DNA, 15 bp, Homo sapiens
aactacattatgatt

SEQ ID NO: 17802 - DNA, 15 bp, Homo sapiens
aaactacattatgat

SEQ ID NO: 17803 - DNA, 15 bp, Homo sapiens
aaaactacattatga

SEQ ID NO: 17804 - DNA, 15 bp, Homo sapiens
aaaaactacattatg

SEQ ID NO: 17805 - DNA, 15 bp, Homo sapiens
caaaaactacattat

SEQ ID NO: 17806 - DNA, 15 bp, Homo sapiens
ccaaaaactacatta

SEQ ID NO: 17807 - DNA, 15 bp, Homo sapiens
gccaaaaactacatt

SEQ ID NO: 17808 - DNA, 15 bp, Homo sapiens
agccaaaaactacat

SEQ ID NO: 17809 - DNA, 15 bp, Homo sapiens
tagccaaaaactaca

SEQ ID NO: 17810 - DNA, 15 bp, Homo sapiens
ttagccaaaaactac

SEQ ID NO: 17811 - DNA, 15 bp, Homo sapiens
gttagccaaaaacta

SEQ ID NO: 17812 - DNA, 15 bp, Homo sapiens
agttagccaaaaact

SEQ ID NO: 17813 - DNA, 15 bp, Homo sapiens
aagttagccaaaaac

SEQ ID NO: 17814 - DNA, 15 bp, Homo sapiens
caagttagccaaaaa

SEQ ID NO: 17815 - DNA, 15 bp, Homo sapiens
acaagttagccaaaa

SEQ ID NO: 17816 - DNA, 15 bp, Homo sapiens
cacaagttagccaaa

SEQ ID NO: 17817 - DNA, 15 bp, Homo sapiens
ccacaagttagccaa

SEQ ID NO: 17818 - DNA, 15 bp, Homo sapiens
tccacaagttagcca

SEQ ID NO: 17819 - DNA, 15 bp, Homo sapiens
ttccacaagttagcc

SEQ ID NO: 17820 - DNA, 15 bp, Homo sapiens
gttccacaagttagc

SEQ ID NO: 17821 - DNA, 15 bp, Homo sapiens
ggttccacaagttag

SEQ ID NO: 17822 - DNA, 15 bp, Homo sapiens
tggttccacaagtta

SEQ ID NO: 17823 - DNA, 15 bp, Homo sapiens
ttggttccacaagtt

SEQ ID NO: 17824 - DNA, 15 bp, Homo sapiens
attggttccacaagt

SEQ ID NO: 17825 - DNA, 15 bp, Homo sapiens
aattggttccacaag

SEQ ID NO: 17826 - DNA, 15 bp, Homo sapiens
aaattggttccacaa

SEQ ID NO: 17827 - DNA, 15 bp, Homo sapiens
aaaattggttccaca

SEQ ID NO: 17828 - DNA, 15 bp, Homo sapiens
aaaaattggttccac

SEQ ID NO: 17829 - DNA, 15 bp, Homo sapiens
aaaaaattggttcca

SEQ ID NO: 17830 - DNA, 15 bp, Homo sapiens
aaaaaaattggttcc

SEQ ID NO: 17831 - DNA, 15 bp, Homo sapiens
caaaaaaattggttc

SEQ ID NO: 17832 - DNA, 15 bp, Homo sapiens
ccaaaaaaattggtt

SEQ ID NO: 17833 - DNA, 15 bp, Homo sapiens
accaaaaaaattggt

SEQ ID NO: 17834 - DNA, 15 bp, Homo sapiens
gaccaaaaaaattgg

SEQ ID NO: 17835 - DNA, 15 bp, Homo sapiens
tgaccaaaaaaattg

SEQ ID NO: 17836 - DNA, 15 bp, Homo sapiens
ttgaccaaaaaaatt

SEQ ID NO: 17837 - DNA, 15 bp, Homo sapiens
tttgaccaaaaaaat

SEQ ID NO: 17838 - DNA, 15 bp, Homo sapiens
atttgaccaaaaaaa

SEQ ID NO: 17839 - DNA, 15 bp, Homo sapiens
tatttgaccaaaaaa

SEQ ID NO: 17840 - DNA, 15 bp, Homo sapiens
atatttgaccaaaaa

SEQ ID NO: 17841 - DNA, 15 bp, Homo sapiens
aatatttgaccaaaa

SEQ ID NO: 17842 - DNA, 15 bp, Homo sapiens
caatatttgaccaaa

SEQ ID NO: 17843 - DNA, 15 bp, Homo sapiens
tcaatatttgaccaa

SEQ ID NO: 17844 - DNA, 15 bp, Homo sapiens
ctcaatatttgacca

SEQ ID NO: 17845 - DNA, 15 bp, Homo sapiens
tctcaatatttgacc

SEQ ID NO: 17846 - DNA, 15 bp, Homo sapiens
ctctcaatatttgac

SEQ ID NO: 17847 - DNA, 15 bp, Homo sapiens
actctcaatatttga

SEQ ID NO: 17848 - DNA, 15 bp, Homo sapiens
cactctcaatatttg

SEQ ID NO: 17849 - DNA, 15 bp, Homo sapiens
tcactctcaatattt

SEQ ID NO: 17850 - DNA, 15 bp, Homo sapiens
ttcactctcaatatt

SEQ ID NO: 17851 - DNA, 15 bp, Homo sapiens
cttcactctcaatat

SEQ ID NO: 17852 - DNA, 15 bp, Homo sapiens
acttcactctcaata

SEQ ID NO: 17853 - DNA, 15 bp, Homo sapiens
aacttcactctcaat

SEQ ID NO: 17854 - DNA, 15 bp, Homo sapiens
aaacttcactctcaa

SEQ ID NO: 17855 - DNA, 15 bp, Homo sapiens
caaacttcactctca

SEQ ID NO: 17856 - DNA, 15 bp, Homo sapiens
gcaaacttcactctc

SEQ ID NO: 17857 - DNA, 15 bp, Homo sapiens
agcaaacttcactct

SEQ ID NO: 17858 - DNA, 15 bp, Homo sapiens
tagcaaacttcactc

SEQ ID NO: 17859 - DNA, 15 bp, Homo sapiens
gtagcaaacttcact

SEQ ID NO: 17860 - DNA, 15 bp, Homo sapiens
ggtagcaaacttcac

SEQ ID NO: 17861 - DNA, 15 bp, Homo sapiens
aggtagcaaacttca

SEQ ID NO: 17862 - DNA, 15 bp, Homo sapiens
caggtagcaaacttc

SEQ ID NO: 17863 - DNA, 15 bp, Homo sapiens
acaggtagcaaactt

SEQ ID NO: 17864 - DNA, 15 bp, Homo sapiens
tacaggtagcaaact

SEQ ID NO: 17865 - DNA, 15 bp, Homo sapiens
ttacaggtagcaaac

SEQ ID NO: 17866 - DNA, 15 bp, Homo sapiens
gttacaggtagcaaa

SEQ ID NO: 17867 - DNA, 15 bp, Homo sapiens
agttacaggtagcaa

SEQ ID NO: 17868 - DNA, 15 bp, Homo sapiens
aagttacaggtagca

SEQ ID NO: 17869 - DNA, 15 bp, Homo sapiens
taagttacaggtagc

SEQ ID NO: 17870 - DNA, 15 bp, Homo sapiens
ttaagttacaggtag

SEQ ID NO: 17871 - DNA, 15 bp, Homo sapiens
tttaagttacaggta

SEQ ID NO: 17872 - DNA, 15 bp, Homo sapiens
ctttaagttacaggt

SEQ ID NO: 17873 - DNA, 15 bp, Homo sapiens
actttaagttacagg

SEQ ID NO: 17874 - DNA, 15 bp, Homo sapiens
tactttaagttacag

SEQ ID NO: 17875 - DNA, 15 bp, Homo sapiens
ttactttaagttaca

SEQ ID NO: 17876 - DNA, 15 bp, Homo sapiens
gttactttaagttac

SEQ ID NO: 17877 - DNA, 15 bp, Homo sapiens
tgttactttaagtta

SEQ ID NO: 17878 - DNA, 15 bp, Homo sapiens
atgttactttaagtt

SEQ ID NO: 17879 - DNA, 15 bp, Homo sapiens
aatgttactttaagt

SEQ ID NO: 17880 - DNA, 15 bp, Homo sapiens
aaatgttactttaag

SEQ ID NO: 17881 - DNA, 15 bp, Homo sapiens
taaatgttactttaa

SEQ ID NO: 17882 - DNA, 15 bp, Homo sapiens
ctaaatgttacttta

SEQ ID NO: 17883 - DNA, 15 bp, Homo sapiens
tctaaatgttacttt

SEQ ID NO: 17884 - DNA, 15 bp, Homo sapiens
ctctaaatgttactt

SEQ ID NO: 17885 - DNA, 15 bp, Homo sapiens
tctctaaatgttact

SEQ ID NO: 17886 - DNA, 15 bp, Homo sapiens
gtctctaaatgttac

SEQ ID NO: 17887 - DNA, 15 bp, Homo sapiens
tgtctctaaatgtta

SEQ ID NO: 17888 - DNA, 15 bp, Homo sapiens
atgtctctaaatgtt

SEQ ID NO: 17889 - DNA, 15 bp, Homo sapiens
tatgtctctaaatgt

SEQ ID NO: 17890 - DNA, 15 bp, Homo sapiens
atatgtctctaaatg

SEQ ID NO: 17891 - DNA, 15 bp, Homo sapiens
aatatgtctctaaat

SEQ ID NO: 17892 - DNA, 15 bp, Homo sapiens
aaatatgtctctaaa

SEQ ID NO: 17893 - DNA, 15 bp, Homo sapiens
aaaatatgtctctaa

SEQ ID NO: 17894 - DNA, 15 bp, Homo sapiens
taaaatatgtctcta

SEQ ID NO: 17895 - DNA, 15 bp, Homo sapiens
gtaaaatatgtctct

SEQ ID NO: 17896 - DNA, 15 bp, Homo sapiens
agtaaaatatgtctc

SEQ ID NO: 17897 - DNA, 15 bp, Homo sapiens
gagtaaaatatgtct

SEQ ID NO: 17898 - DNA, 15 bp, Homo sapiens
tgagtaaaatatgtc

SEQ ID NO: 17899 - DNA, 15 bp, Homo sapiens
ctgagtaaaatatgt

SEQ ID NO: 17900 - DNA, 15 bp, Homo sapiens
tctgagtaaaatatg

SEQ ID NO: 17901 - DNA, 15 bp, Homo sapiens
atctgagtaaaatat

SEQ ID NO: 17902 - DNA, 15 bp, Homo sapiens
aatctgagtaaaata

SEQ ID NO: 17903 - DNA, 15 bp, Homo sapiens
caatctgagtaaaat

SEQ ID NO: 17904 - DNA, 15 bp, Homo sapiens
tcaatctgagtaaaa

SEQ ID NO: 17905 - DNA, 15 bp, Homo sapiens
gtcaatctgagtaaa

SEQ ID NO: 17906 - DNA, 15 bp, Homo sapiens
ggtcaatctgagtaa

SEQ ID NO: 17907 - DNA, 15 bp, Homo sapiens
gggtcaatctgagta

SEQ ID NO: 17908 - DNA, 15 bp, Homo sapiens
agggtcaatctgagt

SEQ ID NO: 17909 - DNA, 15 bp, Homo sapiens
tagggtcaatctgag

SEQ ID NO: 17910 - DNA, 15 bp, Homo sapiens
ttagggtcaatctga

SEQ ID NO: 17911 - DNA, 15 bp, Homo sapiens
attagggtcaatctg

SEQ ID NO: 17912 - DNA, 15 bp, Homo sapiens
aattagggtcaatct

SEQ ID NO: 17913 - DNA, 15 bp, Homo sapiens
taattagggtcaatc

SEQ ID NO: 17914 - DNA, 15 bp, Homo sapiens
ataattagggtcaat

SEQ ID NO: 17915 - DNA, 15 bp, Homo sapiens
tataattagggtcaa

SEQ ID NO: 17916 - DNA, 15 bp, Homo sapiens
atataattagggtca

SEQ ID NO: 17917 - DNA, 15 bp, Homo sapiens
tatataattagggtc

SEQ ID NO: 17918 - DNA, 15 bp, Homo sapiens
atatataattagggt

SEQ ID NO: 17919 - DNA, 15 bp, Homo sapiens
gatatataattaggg

SEQ ID NO: 17920 - DNA, 15 bp, Homo sapiens
agatatataattagg

SEQ ID NO: 17921 - DNA, 15 bp, Homo sapiens
tagatatataattag

SEQ ID NO: 17922 - DNA, 15 bp, Homo sapiens
atagatatataatta

SEQ ID NO: 17923 - DNA, 15 bp, Homo sapiens
catagatatataatt

SEQ ID NO: 17924 - DNA, 15 bp, Homo sapiens
tcatagatatataat

SEQ ID NO: 17925 - DNA, 15 bp, Homo sapiens
gtcatagatatataa

SEQ ID NO: 17926 - DNA, 15 bp, Homo sapiens
tgtcatagatatata

SEQ ID NO: 17927 - DNA, 15 bp, Homo sapiens
atgtcatagatatat

SEQ ID NO: 17928 - DNA, 15 bp, Homo sapiens
catgtcatagatata

SEQ ID NO: 17929 - DNA, 15 bp, Homo sapiens
tcatgtcatagatat

SEQ ID NO: 17930 - DNA, 15 bp, Homo sapiens
atcatgtcatagata

SEQ ID NO: 17931 - DNA, 15 bp, Homo sapiens
aatcatgtcatagat

SEQ ID NO: 17932 - DNA, 15 bp, Homo sapiens
aaatcatgtcataga

SEQ ID NO: 17933 - DNA, 15 bp, Homo sapiens
aaaatcatgtcatag

SEQ ID NO: 17934 - DNA, 15 bp, Homo sapiens
aaaaatcatgtcata

SEQ ID NO: 17935 - DNA, 15 bp, Homo sapiens
taaaaatcatgtcat

SEQ ID NO: 17936 - DNA, 15 bp, Homo sapiens
ttaaaaatcatgtca

SEQ ID NO: 17937 - DNA, 15 bp, Homo sapiens
tttaaaaatcatgtc

SEQ ID NO: 17938 - DNA, 15 bp, Homo sapiens
atttaaaaatcatgt

SEQ ID NO: 17939 - DNA, 15 bp, Homo sapiens
aatttaaaaatcatg

SEQ ID NO: 17940 - DNA, 15 bp, Homo sapiens
caatttaaaaatcat

SEQ ID NO: 17941 - DNA, 15 bp, Homo sapiens
tcaatttaaaaatca

SEQ ID NO: 17942 - DNA, 15 bp, Homo sapiens
ttcaatttaaaaatc

SEQ ID NO: 17943 - DNA, 15 bp, Homo sapiens
tttcaatttaaaaat

SEQ ID NO: 17944 - DNA, 15 bp, Homo sapiens
atttcaatttaaaaa

SEQ ID NO: 17945 - DNA, 15 bp, Homo sapiens
gatttcaatttaaaa

SEQ ID NO: 17946 - DNA, 15 bp, Homo sapiens
tgatttcaatttaaa

SEQ ID NO: 17947 - DNA, 15 bp, Homo sapiens
ctgatttcaatttaa

SEQ ID NO: 17948 - DNA, 15 bp, Homo sapiens
gctgatttcaattta

SEQ ID NO: 17949 - DNA, 15 bp, Homo sapiens
agctgatttcaattt

SEQ ID NO: 17950 - DNA, 15 bp, Homo sapiens
cagctgatttcaatt

SEQ ID NO: 17951 - DNA, 15 bp, Homo sapiens
ccagctgatttcaat

SEQ ID NO: 17952 - DNA, 15 bp, Homo sapiens
cccagctgatttcaa

SEQ ID NO: 17953 - DNA, 15 bp, Homo sapiens
gcccagctgatttca

SEQ ID NO: 17954 - DNA, 15 bp, Homo sapiens
acaccatgcccagct

SEQ ID NO: 17955 - DNA, 15 bp, Homo sapiens
gacaccatgcccagc

SEQ ID NO: 17956 - DNA, 15 bp, Homo sapiens
agacaccatgcccag

SEQ ID NO: 17957 - DNA, 15 bp, Homo sapiens
gagacaccatgccca

SEQ ID NO: 17958 - DNA, 15 bp, Homo sapiens
tgagacaccatgccc

SEQ ID NO: 17959 - DNA, 15 bp, Homo sapiens
atgagacaccatgcc

SEQ ID NO: 17960 - DNA, 15 bp, Homo sapiens
catgagacaccatgc

SEQ ID NO: 17961 - DNA, 15 bp, Homo sapiens
gcatgagacaccatg

SEQ ID NO: 17962 - DNA, 15 bp, Homo sapiens
ggcatgagacaccat

SEQ ID NO: 17963 - DNA, 15 bp, Homo sapiens
aggcatgagacacca

SEQ ID NO: 17964 - DNA, 15 bp, Homo sapiens
caggcatgagacacc

SEQ ID NO: 17965 - DNA, 15 bp, Homo sapiens
acaggcatgagacac

SEQ ID NO: 17966 - DNA, 15 bp, Homo sapiens
tacaggcatgagaca

SEQ ID NO: 17967 - DNA, 15 bp, Homo sapiens
ttacaggcatgagac

SEQ ID NO: 17968 - DNA, 15 bp, Homo sapiens
attacaggcatgaga

SEQ ID NO: 17969 - DNA, 15 bp, Homo sapiens
ccccacctcggcctc

SEQ ID NO: 17970 - DNA, 15 bp, Homo sapiens
cccccacctcggcct

SEQ ID NO: 17971 - DNA, 15 bp, Homo sapiens
ccccccacctcggcc

SEQ ID NO: 17972 - DNA, 15 bp, Homo sapiens
tccccccacctcggc

SEQ ID NO: 17973 - DNA, 15 bp, Homo sapiens
atccccccacctcgg

SEQ ID NO: 17974 - DNA, 15 bp, Homo sapiens
gatccccccacctcg

SEQ ID NO: 17975 - DNA, 15 bp, Homo sapiens
tgatccccccacctc

SEQ ID NO: 17976 - DNA, 15 bp, Homo sapiens
gtgatccccccacct

SEQ ID NO: 17977 - DNA, 15 bp, Homo sapiens
ggtgatccccccacc

SEQ ID NO: 17978 - DNA, 15 bp, Homo sapiens
aggtgatccccccac

SEQ ID NO: 17979 - DNA, 15 bp, Homo sapiens
gaggtgatcccccca

SEQ ID NO: 17980 - DNA, 15 bp, Homo sapiens
tgaggtgatcccccc

SEQ ID NO: 17981 - DNA, 15 bp, Homo sapiens
ctgaggtgatccccc

SEQ ID NO: 17982 - DNA, 15 bp, Homo sapiens
cctgaggtgatcccc

SEQ ID NO: 17983 - DNA, 15 bp, Homo sapiens
acctgaggtgatccc

SEQ ID NO: 17984 - DNA, 15 bp, Homo sapiens
gacctgaggtgatcc

SEQ ID NO: 17985 - DNA, 15 bp, Homo sapiens
tgacctgaggtgatc

SEQ ID NO: 17986 - DNA, 15 bp, Homo sapiens
ctgacctgaggtgat

SEQ ID NO: 17987 - DNA, 15 bp, Homo sapiens
cctgacctgaggtga

SEQ ID NO: 17988 - DNA, 15 bp, Homo sapiens
tcctgacctgaggtg

SEQ ID NO: 17989 - DNA, 15 bp, Homo sapiens
ctcctgacctgaggt

SEQ ID NO: 17990 - DNA, 15 bp, Homo sapiens
actcctgacctgagg

SEQ ID NO: 17991 - DNA, 15 bp, Homo sapiens
aactcctgacctgag

SEQ ID NO: 17992 - DNA, 15 bp, Homo sapiens
aaactcctgacctga

SEQ ID NO: 17993 - DNA, 15 bp, Homo sapiens
caaactcctgacctg

SEQ ID NO: 17994 - DNA, 15 bp, Homo sapiens
aaggctggtctcaaa

SEQ ID NO: 17995 - DNA, 15 bp, Homo sapiens
caaggctggtctcaa

SEQ ID NO: 17996 - DNA, 15 bp, Homo sapiens
ccaaggctggtctca

SEQ ID NO: 17997 - DNA, 15 bp, Homo sapiens
gccaaggctggtctc

SEQ ID NO: 17998 - DNA, 15 bp, Homo sapiens
ggccaaggctggtct

SEQ ID NO: 17999 - DNA, 15 bp, Homo sapiens
tggccaaggctggtc

SEQ ID NO: 18000 - DNA, 15 bp, Homo sapiens
ttggccaaggctggt

SEQ ID NO: 18001 - DNA, 15 bp, Homo sapiens
gttggccaaggctgg

SEQ ID NO: 18002 - DNA, 15 bp, Homo sapiens
tgttggccaaggctg

SEQ ID NO: 18003 - DNA, 15 bp, Homo sapiens
atgttggccaaggct

SEQ ID NO: 18004 - DNA, 15 bp, Homo sapiens
tatgttggccaaggc

SEQ ID NO: 18005 - DNA, 15 bp, Homo sapiens
ctatgttggccaagg

SEQ ID NO: 18006 - DNA, 15 bp, Homo sapiens
gctatgttggccaag

SEQ ID NO: 18007 - DNA, 15 bp, Homo sapiens
tgctatgttggccaa

SEQ ID NO: 18008 - DNA, 15 bp, Homo sapiens
ttgctatgttggcca

SEQ ID NO: 18009 - DNA, 15 bp, Homo sapiens
tttgctatgttggcc

SEQ ID NO: 18010 - DNA, 15 bp, Homo sapiens
ttttgctatgttggc

SEQ ID NO: 18011 - DNA, 15 bp, Homo sapiens
gttttgctatgttgg

SEQ ID NO: 18012 - DNA, 15 bp, Homo sapiens
ggttttgctatgttg

SEQ ID NO: 18013 - DNA, 15 bp, Homo sapiens
aggttttgctatgtt

SEQ ID NO: 18014 - DNA, 15 bp, Homo sapiens
caggttttgctatgt

SEQ ID NO: 18015 - DNA, 15 bp, Homo sapiens
acaggttttgctatg

SEQ ID NO: 18016 - DNA, 15 bp, Homo sapiens
gacaggttttgctat

SEQ ID NO: 18017 - DNA, 15 bp, Homo sapiens
agacaggttttgcta

SEQ ID NO: 18018 - DNA, 15 bp, Homo sapiens
gagacaggttttgct

SEQ ID NO: 18019 - DNA, 15 bp, Homo sapiens
agagacaggttttgc

SEQ ID NO: 18020 - DNA, 15 bp, Homo sapiens
tagagacaggttttg

SEQ ID NO: 18021 - DNA, 15 bp, Homo sapiens
gtagagacaggtttt

SEQ ID NO: 18022 - DNA, 15 bp, Homo sapiens
agtagagacaggttt

SEQ ID NO: 18023 - DNA, 15 bp, Homo sapiens
tagtagagacaggtt

SEQ ID NO: 18024 - DNA, 15 bp, Homo sapiens
ttagtagagacaggt

SEQ ID NO: 18025 - DNA, 15 bp, Homo sapiens
tttagtagagacagg

SEQ ID NO: 18026 - DNA, 15 bp, Homo sapiens
tgccaccatgcccag

SEQ ID NO: 18027 - DNA, 15 bp, Homo sapiens
gtgccaccatgccca

SEQ ID NO: 18028 - DNA, 15 bp, Homo sapiens
tgtgccaccatgccc

SEQ ID NO: 18029 - DNA, 15 bp, Homo sapiens
atgtgccaccatgcc

SEQ ID NO: 18030 - DNA, 15 bp, Homo sapiens
catgtgccaccatgc

SEQ ID NO: 18031 - DNA, 15 bp, Homo sapiens
gcatgtgccaccatg

SEQ ID NO: 18032 - DNA, 15 bp, Homo sapiens
ttacaggcatgtgcc

SEQ ID NO: 18033 - DNA, 15 bp, Homo sapiens
attacaggcatgtgc

SEQ ID NO: 18034 - DNA, 15 bp, Homo sapiens
gattacaggcatgtg

SEQ ID NO: 18035 - DNA, 15 bp, Homo sapiens
ggattacaggcatgt

SEQ ID NO: 18036 - DNA, 15 bp, Homo sapiens
agcctcagcctccca

SEQ ID NO: 18037 - DNA, 15 bp, Homo sapiens
cagcctcagcctccc

SEQ ID NO: 18038 - DNA, 15 bp, Homo sapiens
ccagcctcagcctcc

SEQ ID NO: 18039 - DNA, 15 bp, Homo sapiens
tccagcctcagcctc

SEQ ID NO: 18040 - DNA, 15 bp, Homo sapiens
ttccagcctcagcct

SEQ ID NO: 18041 - DNA, 15 bp, Homo sapiens
tttccagcctcagcc

SEQ ID NO: 18042 - DNA, 15 bp, Homo sapiens
ttttccagcctcagc

SEQ ID NO: 18043 - DNA, 15 bp, Homo sapiens
attttccagcctcag

SEQ ID NO: 18044 - DNA, 15 bp, Homo sapiens
aattttccagcctca

SEQ ID NO: 18045 - DNA, 15 bp, Homo sapiens
caattttccagcctc

SEQ ID NO: 18046 - DNA, 15 bp, Homo sapiens
gcaattttccagcct

SEQ ID NO: 18047 - DNA, 15 bp, Homo sapiens
ggcaattttccagcc

SEQ ID NO: 18048 - DNA, 15 bp, Homo sapiens
gggcaattttccagc

SEQ ID NO: 18049 - DNA, 15 bp, Homo sapiens
cgggcaattttccag

SEQ ID NO: 18050 - DNA, 15 bp, Homo sapiens
ccgggcaattttcca

SEQ ID NO: 18051 - DNA, 15 bp, Homo sapiens
cccgggcaattttcc

SEQ ID NO: 18052 - DNA, 15 bp, Homo sapiens
tcccgggcaattttc

SEQ ID NO: 18053 - DNA, 15 bp, Homo sapiens
ctcccgggcaatttt

SEQ ID NO: 18054 - DNA, 15 bp, Homo sapiens
cctcccgggcaattt

SEQ ID NO: 18055 - DNA, 15 bp, Homo sapiens
gcctcccgggcaatt

SEQ ID NO: 18056 - DNA, 15 bp, Homo sapiens
tgcctcccgggcaat

SEQ ID NO: 18057 - DNA, 15 bp, Homo sapiens
ctgcctcccgggcaa

SEQ ID NO: 18058 - DNA, 15 bp, Homo sapiens
tctgcctcccgggca

SEQ ID NO: 18059 - DNA, 15 bp, Homo sapiens
ctctgcctcccgggc

SEQ ID NO: 18060 - DNA, 15 bp, Homo sapiens
cctctgcctcccggg

SEQ ID NO: 18061 - DNA, 15 bp, Homo sapiens
acctctgcctcccgg

SEQ ID NO: 18062 - DNA, 15 bp, Homo sapiens
aacctctgcctcccg

SEQ ID NO: 18063 - DNA, 15 bp, Homo sapiens
aaacctctgcctccc

SEQ ID NO: 18064 - DNA, 15 bp, Homo sapiens
gaaacctctgcctcc

SEQ ID NO: 18065 - DNA, 15 bp, Homo sapiens
tgaaacctctgcctc

SEQ ID NO: 18066 - DNA, 15 bp, Homo sapiens
ctgaaacctctgcct

SEQ ID NO: 18067 - DNA, 15 bp, Homo sapiens
actgaaacctctgcc

SEQ ID NO: 18068 - DNA, 15 bp, Homo sapiens
tactgaaacctctgc

SEQ ID NO: 18069 - DNA, 15 bp, Homo sapiens
ttactgaaacctctg

SEQ ID NO: 18070 - DNA, 15 bp, Homo sapiens
cttactgaaacctct

SEQ ID NO: 18071 - DNA, 15 bp, Homo sapiens
gcttactgaaacctc

SEQ ID NO: 18072 - DNA, 15 bp, Homo sapiens
ggcttactgaaacct

SEQ ID NO: 18073 - DNA, 15 bp, Homo sapiens
tggcttactgaaacc

SEQ ID NO: 18074 - DNA, 15 bp, Homo sapiens
ttggcttactgaaac

SEQ ID NO: 18075 - DNA, 15 bp, Homo sapiens
cttggcttactgaaa

SEQ ID NO: 18076 - DNA, 15 bp, Homo sapiens
tcttggcttactgaa

SEQ ID NO: 18077 - DNA, 15 bp, Homo sapiens
atcttggcttactga

SEQ ID NO: 18078 - DNA, 15 bp, Homo sapiens
aatcttggcttactg

SEQ ID NO: 18079 - DNA, 15 bp, Homo sapiens
caatcttggcttact

SEQ ID NO: 18080 - DNA, 15 bp, Homo sapiens
acaatcttggcttac

SEQ ID NO: 18081 - DNA, 15 bp, Homo sapiens
cacaatcttggctta

SEQ ID NO: 18082 - DNA, 15 bp, Homo sapiens
gcacaatcttggctt

SEQ ID NO: 18083 - DNA, 15 bp, Homo sapiens
ggcacaatcttggct

SEQ ID NO: 18084 - DNA, 15 bp, Homo sapiens
tggcacaatcttggc

SEQ ID NO: 18085 - DNA, 15 bp, Homo sapiens
gtggcacaatcttgg

SEQ ID NO: 18086 - DNA, 15 bp, Homo sapiens
agtggcacaatcttg

SEQ ID NO: 18087 - DNA, 15 bp, Homo sapiens
cagtggcacaatctt

SEQ ID NO: 18088 - DNA, 15 bp, Homo sapiens
ccagtggcacaatct

SEQ ID NO: 18089 - DNA, 15 bp, Homo sapiens
tccagtggcacaatc

SEQ ID NO: 18090 - DNA, 15 bp, Homo sapiens
gtccagtggcacaat

SEQ ID NO: 18091 - DNA, 15 bp, Homo sapiens
agtccagtggcacaa

SEQ ID NO: 18092 - DNA, 15 bp, Homo sapiens
gagtccagtggcaca

SEQ ID NO: 18093 - DNA, 15 bp, Homo sapiens
ggagtccagtggcac

SEQ ID NO: 18094 - DNA, 15 bp, Homo sapiens
tggagtccagtggca

SEQ ID NO: 18095 - DNA, 15 bp, Homo sapiens
ctggagtccagtggc

SEQ ID NO: 18096 - DNA, 15 bp, Homo sapiens
gctggagtccagtgg

SEQ ID NO: 18097 - DNA, 15 bp, Homo sapiens
ggctggagtccagtg

SEQ ID NO: 18098 - DNA, 15 bp, Homo sapiens
aggctggagtccagt

SEQ ID NO: 18099 - DNA, 15 bp, Homo sapiens
caggctggagtccag

SEQ ID NO: 18100 - DNA, 15 bp, Homo sapiens
ccaggctggagtcca

SEQ ID NO: 18101 - DNA, 15 bp, Homo sapiens
cccaggctggagtcc

SEQ ID NO: 18102 - DNA, 15 bp, Homo sapiens
gcccaggctggagtc

SEQ ID NO: 18103 - DNA, 15 bp, Homo sapiens
tgctttgttgcccag

SEQ ID NO: 18104 - DNA, 15 bp, Homo sapiens
ttgctttgttgccca

SEQ ID NO: 18105 - DNA, 15 bp, Homo sapiens
cttgctttgttgccc

SEQ ID NO: 18106 - DNA, 15 bp, Homo sapiens
agtcttgctttgttg

SEQ ID NO: 18107 - DNA, 15 bp, Homo sapiens
gagtcttgctttgtt

SEQ ID NO: 18108 - DNA, 15 bp, Homo sapiens
ggagtcttgctttgt

SEQ ID NO: 18109 - DNA, 15 bp, Homo sapiens
cggagtcttgctttg

SEQ ID NO: 18110 - DNA, 15 bp, Homo sapiens
acggagtcttgcttt

SEQ ID NO: 18111 - DNA, 15 bp, Homo sapiens
gacggagtcttgctt

SEQ ID NO: 18112 - DNA, 15 bp, Homo sapiens
agacggagtcttgct

SEQ ID NO: 18113 - DNA, 15 bp, Homo sapiens
gagacggagtcttgc

SEQ ID NO: 18114 - DNA, 15 bp, Homo sapiens
tgagacggagtcttg

SEQ ID NO: 18115 - DNA, 15 bp, Homo sapiens
ttgagacggagtctt

SEQ ID NO: 18116 - DNA, 15 bp, Homo sapiens
ctacttttttttttt

SEQ ID NO: 18117 - DNA, 15 bp, Homo sapiens
actactttttttttt

SEQ ID NO: 18118 - DNA, 15 bp, Homo sapiens
aactacttttttttt

SEQ ID NO: 18119 - DNA, 15 bp, Homo sapiens
gaactactttttttt

SEQ ID NO: 18120 - DNA, 15 bp, Homo sapiens
agaactacttttttt

SEQ ID NO: 18121 - DNA, 15 bp, Homo sapiens
aagaactactttttt

SEQ ID NO: 18122 - DNA, 15 bp, Homo sapiens
aaagaactacttttt

SEQ ID NO: 18123 - DNA, 15 bp, Homo sapiens
taaagaactactttt

SEQ ID NO: 18124 - DNA, 15 bp, Homo sapiens
ataaagaactacttt

SEQ ID NO: 18125 - DNA, 15 bp, Homo sapiens
aataaagaactactt

SEQ ID NO: 18126 - DNA, 15 bp, Homo sapiens
aaataaagaactact

SEQ ID NO: 18127 - DNA, 15 bp, Homo sapiens
taaataaagaactac

SEQ ID NO: 18128 - DNA, 15 bp, Homo sapiens
gtaaataaagaacta

SEQ ID NO: 18129 - DNA, 15 bp, Homo sapiens
ggtaaataaagaact

SEQ ID NO: 18130 - DNA, 15 bp, Homo sapiens
tggtaaataaagaac

SEQ ID NO: 18131 - DNA, 15 bp, Homo sapiens
atggtaaataaagaa

SEQ ID NO: 18132 - DNA, 15 bp, Homo sapiens
catggtaaataaaga

SEQ ID NO: 18133 - DNA, 15 bp, Homo sapiens
gcatggtaaataaag

SEQ ID NO: 18134 - DNA, 15 bp, Homo sapiens
cgcatggtaaataaa

SEQ ID NO: 18135 - DNA, 15 bp, Homo sapiens
tcgcatggtaaataa

SEQ ID NO: 18136 - DNA, 15 bp, Homo sapiens
atcgcatggtaaata

SEQ ID NO: 18137 - DNA, 15 bp, Homo sapiens
gatcgcatggtaaat

SEQ ID NO: 18138 - DNA, 15 bp, Homo sapiens
agatcgcatggtaaa

SEQ ID NO: 18139 - DNA, 15 bp, Homo sapiens
aagatcgcatggtaa

SEQ ID NO: 18140 - DNA, 15 bp, Homo sapiens
aaagatcgcatggta

SEQ ID NO: 18141 - DNA, 15 bp, Homo sapiens
gaaagatcgcatggt

SEQ ID NO: 18142 - DNA, 15 bp, Homo sapiens
ggaaagatcgcatgg

SEQ ID NO: 18143 - DNA, 15 bp, Homo sapiens
tggaaagatcgcatg

SEQ ID NO: 18144 - DNA, 15 bp, Homo sapiens
ctggaaagatcgcat

SEQ ID NO: 18145 - DNA, 15 bp, Homo sapiens
actggaaagatcgca

SEQ ID NO: 18146 - DNA, 15 bp, Homo sapiens
tactggaaagatcgc

SEQ ID NO: 18147 - DNA, 15 bp, Homo sapiens
gtactggaaagatcg

SEQ ID NO: 18148 - DNA, 15 bp, Homo sapiens
tgtactggaaagatc

SEQ ID NO: 18149 - DNA, 15 bp, Homo sapiens
gtgtactggaaagat

SEQ ID NO: 18150 - DNA, 15 bp, Homo sapiens
agtgtactggaaaga

SEQ ID NO: 18151 - DNA, 15 bp, Homo sapiens
aagtgtactggaaag

SEQ ID NO: 18152 - DNA, 15 bp, Homo sapiens
caagtgtactggaaa

SEQ ID NO: 18153 - DNA, 15 bp, Homo sapiens
gcaagtgtactggaa

SEQ ID NO: 18154 - DNA, 15 bp, Homo sapiens
agcaagtgtactgga

SEQ ID NO: 18155 - DNA, 15 bp, Homo sapiens
tagcaagtgtactgg

SEQ ID NO: 18156 - DNA, 15 bp, Homo sapiens
ttagcaagtgtactg

SEQ ID NO: 18157 - DNA, 15 bp, Homo sapiens
attagcaagtgtact

SEQ ID NO: 18158 - DNA, 15 bp, Homo sapiens
aattagcaagtgtac

SEQ ID NO: 18159 - DNA, 15 bp, Homo sapiens
caattagcaagtgta

SEQ ID NO: 18160 - DNA, 15 bp, Homo sapiens
gcaattagcaagtgt

SEQ ID NO: 18161 - DNA, 15 bp, Homo sapiens
agcaattagcaagtg

SEQ ID NO: 18162 - DNA, 15 bp, Homo sapiens
tagcaattagcaagt

SEQ ID NO: 18163 - DNA, 15 bp, Homo sapiens
gtagcaattagcaag

SEQ ID NO: 18164 - DNA, 15 bp, Homo sapiens
agtagcaattagcaa

SEQ ID NO: 18165 - DNA, 15 bp, Homo sapiens
gagtagcaattagca

SEQ ID NO: 18166 - DNA, 15 bp, Homo sapiens
ggagtagcaattagc

SEQ ID NO: 18167 - DNA, 15 bp, Homo sapiens
tggagtagcaattag

SEQ ID NO: 18168 - DNA, 15 bp, Homo sapiens
ctggagtagcaatta

SEQ ID NO: 18169 - DNA, 15 bp, Homo sapiens
tctggagtagcaatt

SEQ ID NO: 18170 - DNA, 15 bp, Homo sapiens
ctctggagtagcaat

SEQ ID NO: 18171 - DNA, 15 bp, Homo sapiens
gctctggagtagcaa

SEQ ID NO: 18172 - DNA, 15 bp, Homo sapiens
tgctctggagtagca

SEQ ID NO: 18173 - DNA, 15 bp, Homo sapiens
atgctctggagtagc

SEQ ID NO: 18174 - DNA, 15 bp, Homo sapiens
tatgctctggagtag

SEQ ID NO: 18175 - DNA, 15 bp, Homo sapiens
ctatgctctggagta

SEQ ID NO: 18176 - DNA, 15 bp, Homo sapiens
gctatgctctggagt

SEQ ID NO: 18177 - DNA, 15 bp, Homo sapiens
ggctatgctctggag

SEQ ID NO: 18178 - DNA, 15 bp, Homo sapiens
tggctatgctctgga

SEQ ID NO: 18179 - DNA, 15 bp, Homo sapiens
ctggctatgctctgg

SEQ ID NO: 18180 - DNA, 15 bp, Homo sapiens
tctggctatgctctg

SEQ ID NO: 18181 - DNA, 15 bp, Homo sapiens
atctggctatgctct

SEQ ID NO: 18182 - DNA, 15 bp, Homo sapiens
catctggctatgctc

SEQ ID NO: 18183 - DNA, 15 bp, Homo sapiens
acatctggctatgct

SEQ ID NO: 18184 - DNA, 15 bp, Homo sapiens
cacatctggctatgc

SEQ ID NO: 18185 - DNA, 15 bp, Homo sapiens
ccacatctggctatg

SEQ ID NO: 18186 - DNA, 15 bp, Homo sapiens
gccacatctggctat

SEQ ID NO: 18187 - DNA, 15 bp, Homo sapiens
ggccacatctggcta

SEQ ID NO: 18188 - DNA, 15 bp, Homo sapiens
gggccacatctggct

SEQ ID NO: 18189 - DNA, 15 bp, Homo sapiens
tgggccacatctggc

SEQ ID NO: 18190 - DNA, 15 bp, Homo sapiens
gtgggccacatctgg

SEQ ID NO: 18191 - DNA, 15 bp, Homo sapiens
tgtgggccacatctg

SEQ ID NO: 18192 - DNA, 15 bp, Homo sapiens
gtgtgggccacatct

SEQ ID NO: 18193 - DNA, 15 bp, Homo sapiens
ggtgtgggccacatc

SEQ ID NO: 18194 - DNA, 15 bp, Homo sapiens
aggtgtgggccacat

SEQ ID NO: 18195 - DNA, 15 bp, Homo sapiens
caggtgtgggccaca

SEQ ID NO: 18196 - DNA, 15 bp, Homo sapiens
acaggtgtgggccac

SEQ ID NO: 18197 - DNA, 15 bp, Homo sapiens
tacaggtgtgggcca

SEQ ID NO: 18198 - DNA, 15 bp, Homo sapiens
ttacaggtgtgggcc

SEQ ID NO: 18199 - DNA, 15 bp, Homo sapiens
attacaggtgtgggc

SEQ ID NO: 18200 - DNA, 15 bp, Homo sapiens
aattacaggtgtggg

SEQ ID NO: 18201 - DNA, 15 bp, Homo sapiens
gaattacaggtgtgg

SEQ ID NO: 18202 - DNA, 15 bp, Homo sapiens
ggaattacaggtgtg

SEQ ID NO: 18203 - DNA, 15 bp, Homo sapiens
tggaattacaggtgt

SEQ ID NO: 18204 - DNA, 15 bp, Homo sapiens
ctggaattacaggtg

SEQ ID NO: 18205 - DNA, 15 bp, Homo sapiens
gctggaattacaggt

SEQ ID NO: 18206 - DNA, 15 bp, Homo sapiens
tgctggaattacagg

SEQ ID NO: 18207 - DNA, 15 bp, Homo sapiens
gtgctggaattacag

SEQ ID NO: 18208 - DNA, 15 bp, Homo sapiens
agtgctggaattaca

SEQ ID NO: 18209 - DNA, 15 bp, Homo sapiens
aagtgctggaattac

SEQ ID NO: 18210 - DNA, 15 bp, Homo sapiens
aaagtgctggaatta

SEQ ID NO: 18211 - DNA, 15 bp, Homo sapiens
caaagtgctggaatt

SEQ ID NO: 18212 - DNA, 15 bp, Homo sapiens
tcaaagtgctggaat

SEQ ID NO: 18213 - DNA, 15 bp, Homo sapiens
ctcaaagtgctggaa

SEQ ID NO: 18214 - DNA, 15 bp, Homo sapiens
cctcaaagtgctgga

SEQ ID NO: 18215 - DNA, 15 bp, Homo sapiens
tcctcaaagtgctgg

SEQ ID NO: 18216 - DNA, 15 bp, Homo sapiens
ctcctcaaagtgctg

SEQ ID NO: 18217 - DNA, 15 bp, Homo sapiens
cctcctcaaagtgct

SEQ ID NO: 18218 - DNA, 15 bp, Homo sapiens
tcctcctcaaagtgc

SEQ ID NO: 18219 - DNA, 15 bp, Homo sapiens
gtcctcctcaaagtg

SEQ ID NO: 18220 - DNA, 15 bp, Homo sapiens
tgtcctcctcaaagt

SEQ ID NO: 18221 - DNA, 15 bp, Homo sapiens
ttgtcctcctcaaag

SEQ ID NO: 18222 - DNA, 15 bp, Homo sapiens
cttgtcctcctcaaa

SEQ ID NO: 18223 - DNA, 15 bp, Homo sapiens
tcttgtcctcctcaa

SEQ ID NO: 18224 - DNA, 15 bp, Homo sapiens
atcttgtcctcctca

SEQ ID NO: 18225 - DNA, 15 bp, Homo sapiens
catcttgtcctcctc

SEQ ID NO: 18226 - DNA, 15 bp, Homo sapiens
tcatcttgtcctcct

SEQ ID NO: 18227 - DNA, 15 bp, Homo sapiens
ctcatcttgtcctcc

SEQ ID NO: 18228 - DNA, 15 bp, Homo sapiens
gctcatcttgtcctc

SEQ ID NO: 18229 - DNA, 15 bp, Homo sapiens
tgctcatcttgtcct

SEQ ID NO: 18230 - DNA, 15 bp, Homo sapiens
ttgctcatcttgtcc

SEQ ID NO: 18231 - DNA, 15 bp, Homo sapiens
tttgctcatcttgtc

SEQ ID NO: 18232 - DNA, 15 bp, Homo sapiens
atttgctcatcttgt

SEQ ID NO: 18233 - DNA, 15 bp, Homo sapiens
aatttgctcatcttg

SEQ ID NO: 18234 - DNA, 15 bp, Homo sapiens
caatttgctcatctt

SEQ ID NO: 18235 - DNA, 15 bp, Homo sapiens
acaatttgctcatct

SEQ ID NO: 18236 - DNA, 15 bp, Homo sapiens
aacaatttgctcatc

SEQ ID NO: 18237 - DNA, 15 bp, Homo sapiens
aaacaatttgctcat

SEQ ID NO: 18238 - DNA, 15 bp, Homo sapiens
caaacaatttgctca

SEQ ID NO: 18239 - DNA, 15 bp, Homo sapiens
tcaaacaatttgctc

SEQ ID NO: 18240 - DNA, 15 bp, Homo sapiens
ctcaaacaatttgct

SEQ ID NO: 18241 - DNA, 15 bp, Homo sapiens
actcaaacaatttgc

SEQ ID NO: 18242 - DNA, 15 bp, Homo sapiens
gactcaaacaatttg

SEQ ID NO: 18243 - DNA, 15 bp, Homo sapiens
ggactcaaacaattt

SEQ ID NO: 18244 - DNA, 15 bp, Homo sapiens
tggactcaaacaatt

SEQ ID NO: 18245 - DNA, 15 bp, Homo sapiens
gtggactcaaacaat

SEQ ID NO: 18246 - DNA, 15 bp, Homo sapiens
cgtggactcaaacaa

SEQ ID NO: 18247 - DNA, 15 bp, Homo sapiens
tcgtggactcaaaca

SEQ ID NO: 18248 - DNA, 15 bp, Homo sapiens
ctcgtggactcaaac

SEQ ID NO: 18249 - DNA, 15 bp, Homo sapiens
actcgtggactcaaa

SEQ ID NO: 18250 - DNA, 15 bp, Homo sapiens
aactcgtggactcaa

SEQ ID NO: 18251 - DNA, 15 bp, Homo sapiens
caactcgtggactca

SEQ ID NO: 18252 - DNA, 15 bp, Homo sapiens
ccaactcgtggactc

SEQ ID NO: 18253 - DNA, 15 bp, Homo sapiens
tccaactcgtggact

SEQ ID NO: 18254 - DNA, 15 bp, Homo sapiens
ctccaactcgtggac

SEQ ID NO: 18255 - DNA, 15 bp, Homo sapiens
tctccaactcgtgga

SEQ ID NO: 18256 - DNA, 15 bp, Homo sapiens
gtctccaactcgtgg

SEQ ID NO: 18257 - DNA, 15 bp, Homo sapiens
ggtctccaactcgtg

SEQ ID NO: 18258 - DNA, 15 bp, Homo sapiens
tggtctccaactcgt

SEQ ID NO: 18259 - DNA, 15 bp, Homo sapiens
gtggtctccaactcg

SEQ ID NO: 18260 - DNA, 15 bp, Homo sapiens
ggtggtctccaactc

SEQ ID NO: 18261 - DNA, 15 bp, Homo sapiens
gggtggtctccaact

SEQ ID NO: 18262 - DNA, 15 bp, Homo sapiens
agggtggtctccaac

SEQ ID NO: 18263 - DNA, 15 bp, Homo sapiens
cagggtggtctccaa

SEQ ID NO: 18264 - DNA, 15 bp, Homo sapiens
ccagggtggtctcca

SEQ ID NO: 18265 - DNA, 15 bp, Homo sapiens
cccagggtggtctcc

SEQ ID NO: 18266 - DNA, 15 bp, Homo sapiens
gcccagggtggtctc

SEQ ID NO: 18267 - DNA, 15 bp, Homo sapiens
tgcccagggtggtct

SEQ ID NO: 18268 - DNA, 15 bp, Homo sapiens
ttgcccagggtggtc

SEQ ID NO: 18269 - DNA, 15 bp, Homo sapiens
gttgcccagggtggt

SEQ ID NO: 18270 - DNA, 15 bp, Homo sapiens
tgttgcccagggtgg

SEQ ID NO: 18271 - DNA, 15 bp, Homo sapiens
atgttgcccagggtg

SEQ ID NO: 18272 - DNA, 15 bp, Homo sapiens
catgttgcccagggt

SEQ ID NO: 18273 - DNA, 15 bp, Homo sapiens
ccatgttgcccaggg

SEQ ID NO: 18274 - DNA, 15 bp, Homo sapiens
accatgttgcccagg

SEQ ID NO: 18275 - DNA, 15 bp, Homo sapiens
taccatgttgcccag

SEQ ID NO: 18276 - DNA, 15 bp, Homo sapiens
ttaccatgttgccca

SEQ ID NO: 18277 - DNA, 15 bp, Homo sapiens
tttaccatgttgccc

SEQ ID NO: 18278 - DNA, 15 bp, Homo sapiens
ttttaccatgttgcc

SEQ ID NO: 18279 - DNA, 15 bp, Homo sapiens
gttttaccatgttgc

SEQ ID NO: 18280 - DNA, 15 bp, Homo sapiens
ggttttaccatgttg

SEQ ID NO: 18281 - DNA, 15 bp, Homo sapiens
aggttttaccatgtt

SEQ ID NO: 18282 - DNA, 15 bp, Homo sapiens
gaggttttaccatgt

SEQ ID NO: 18283 - DNA, 15 bp, Homo sapiens
tgaggttttaccatg

SEQ ID NO: 18284 - DNA, 15 bp, Homo sapiens
atgaggttttaccat

SEQ ID NO: 18285 - DNA, 15 bp, Homo sapiens
gatgaggttttacca

SEQ ID NO: 18286 - DNA, 15 bp, Homo sapiens
agatgaggttttacc

SEQ ID NO: 18287 - DNA, 15 bp, Homo sapiens
gagatgaggttttac

SEQ ID NO: 18288 - DNA, 15 bp, Homo sapiens
agagatgaggtttta

SEQ ID NO: 18289 - DNA, 15 bp, Homo sapiens
tagagatgaggtttt

SEQ ID NO: 18290 - DNA, 15 bp, Homo sapiens
tgtagagatgaggtt

SEQ ID NO: 18291 - DNA, 15 bp, Homo sapiens
ttgtagagatgaggt

SEQ ID NO: 18292 - DNA, 15 bp, Homo sapiens
tttgtagagatgagg

SEQ ID NO: 18293 - DNA, 15 bp, Homo sapiens
ttttgtagagatgag

SEQ ID NO: 18294 - DNA, 15 bp, Homo sapiens
tttttgtagagatga

SEQ ID NO: 18295 - DNA, 15 bp, Homo sapiens
tttttttgtagagat

SEQ ID NO: 18296 - DNA, 15 bp, Homo sapiens
atttttttgtagaga

SEQ ID NO: 18297 - DNA, 15 bp, Homo sapiens
tatttttttgtagag

SEQ ID NO: 18298 - DNA, 15 bp, Homo sapiens
gtatttttttgtaga

SEQ ID NO: 18299 - DNA, 15 bp, Homo sapiens
ggtatttttttgtag

SEQ ID NO: 18300 - DNA, 15 bp, Homo sapiens
tggtatttttttgta

SEQ ID NO: 18301 - DNA, 15 bp, Homo sapiens
ttggtatttttttgt

SEQ ID NO: 18302 - DNA, 15 bp, Homo sapiens
tttggtatttttttg

SEQ ID NO: 18303 - DNA, 15 bp, Homo sapiens
ttttggtattttttt

SEQ ID NO: 18304 - DNA, 15 bp, Homo sapiens
tttttggtatttttt

SEQ ID NO: 18305 - DNA, 15 bp, Homo sapiens
ttttttggtattttt

SEQ ID NO: 18306 - DNA, 15 bp, Homo sapiens
tttttttggtatttt

SEQ ID NO: 18307 - DNA, 15 bp, Homo sapiens
atttttttggtattt

SEQ ID NO: 18308 - DNA, 15 bp, Homo sapiens
aatttttttggtatt

SEQ ID NO: 18309 - DNA, 15 bp, Homo sapiens
taatttttttggtat

SEQ ID NO: 18310 - DNA, 15 bp, Homo sapiens
ttaatttttttggta

SEQ ID NO: 18311 - DNA, 15 bp, Homo sapiens
gttaatttttttggt

SEQ ID NO: 18312 - DNA, 15 bp, Homo sapiens
ggttaatttttttgg

SEQ ID NO: 18313 - DNA, 15 bp, Homo sapiens
gggttaatttttttg

SEQ ID NO: 18314 - DNA, 15 bp, Homo sapiens
cgggttaattttttt

SEQ ID NO: 18315 - DNA, 15 bp, Homo sapiens
ccgggttaatttttt

SEQ ID NO: 18316 - DNA, 15 bp, Homo sapiens
gccgggttaattttt

SEQ ID NO: 18317 - DNA, 15 bp, Homo sapiens
cgccgggttaatttt

SEQ ID NO: 18318 - DNA, 15 bp, Homo sapiens
acgccgggttaattt

SEQ ID NO: 18319 - DNA, 15 bp, Homo sapiens
cacgccgggttaatt

SEQ ID NO: 18320 - DNA, 15 bp, Homo sapiens
ccacgccgggttaat

SEQ ID NO: 18321 - DNA, 15 bp, Homo sapiens
accacgccgggttaa

SEQ ID NO: 18322 - DNA, 15 bp, Homo sapiens
taccacgccgggtta

SEQ ID NO: 18323 - DNA, 15 bp, Homo sapiens
ataccacgccgggtt

SEQ ID NO: 18324 - DNA, 15 bp, Homo sapiens
aataccacgccgggt

SEQ ID NO: 18325 - DNA, 15 bp, Homo sapiens
caataccacgccggg

SEQ ID NO: 18326 - DNA, 15 bp, Homo sapiens
ccaataccacgccgg

SEQ ID NO: 18327 - DNA, 15 bp, Homo sapiens
cccaataccacgccg

SEQ ID NO: 18328 - DNA, 15 bp, Homo sapiens
acccaataccacgcc

SEQ ID NO: 18329 - DNA, 15 bp, Homo sapiens
cacccaataccacgc

SEQ ID NO: 18330 - DNA, 15 bp, Homo sapiens
gcacccaataccacg

SEQ ID NO: 18331 - DNA, 15 bp, Homo sapiens
ggcacccaataccac

SEQ ID NO: 18332 - DNA, 15 bp, Homo sapiens
aggcacccaatacca

SEQ ID NO: 18333 - DNA, 15 bp, Homo sapiens
caggcacccaatacc

SEQ ID NO: 18334 - DNA, 15 bp, Homo sapiens
acaggcacccaatac

SEQ ID NO: 18335 - DNA, 15 bp, Homo sapiens
tacaggcacccaata

SEQ ID NO: 18336 - DNA, 15 bp, Homo sapiens
ttacaggcacccaat

SEQ ID NO: 18337 - DNA, 15 bp, Homo sapiens
attacaggcacccaa

SEQ ID NO: 18338 - DNA, 15 bp, Homo sapiens
gattacaggcaccca

SEQ ID NO: 18339 - DNA, 15 bp, Homo sapiens
ggattacaggcaccc

SEQ ID NO: 18340 - DNA, 15 bp, Homo sapiens
gggattacaggcacc

SEQ ID NO: 18341 - DNA, 15 bp, Homo sapiens
tgggattacaggcac

SEQ ID NO: 18342 - DNA, 15 bp, Homo sapiens
atagctgggattaca

SEQ ID NO: 18343 - DNA, 15 bp, Homo sapiens
aatagctgggattac

SEQ ID NO: 18344 - DNA, 15 bp, Homo sapiens
gaatagctgggatta

SEQ ID NO: 18345 - DNA, 15 bp, Homo sapiens
tgaatagctgggatt

SEQ ID NO: 18346 - DNA, 15 bp, Homo sapiens
ctgaatagctgggat

SEQ ID NO: 18347 - DNA, 15 bp, Homo sapiens
cctgaatagctggga

SEQ ID NO: 18348 - DNA, 15 bp, Homo sapiens
tcctgaatagctggg

SEQ ID NO: 18349 - DNA, 15 bp, Homo sapiens
ttcctgaatagctgg

SEQ ID NO: 18350 - DNA, 15 bp, Homo sapiens
cttcctgaatagctg

SEQ ID NO: 18351 - DNA, 15 bp, Homo sapiens
gcttcctgaatagct

SEQ ID NO: 18352 - DNA, 15 bp, Homo sapiens
ggcttcctgaatagc

SEQ ID NO: 18353 - DNA, 15 bp, Homo sapiens
tggcttcctgaatag

SEQ ID NO: 18354 - DNA, 15 bp, Homo sapiens
ttggcttcctgaata

SEQ ID NO: 18355 - DNA, 15 bp, Homo sapiens
cttggcttcctgaat

SEQ ID NO: 18356 - DNA, 15 bp, Homo sapiens
acttggcttcctgaa

SEQ ID NO: 18357 - DNA, 15 bp, Homo sapiens
aacttggcttcctga

SEQ ID NO: 18358 - DNA, 15 bp, Homo sapiens
caacttggcttcctg

SEQ ID NO: 18359 - DNA, 15 bp, Homo sapiens
ccaacttggcttcct

SEQ ID NO: 18360 - DNA, 15 bp, Homo sapiens
cccaacttggcttcc

SEQ ID NO: 18361 - DNA, 15 bp, Homo sapiens
tcccaacttggcttc

SEQ ID NO: 18362 - DNA, 15 bp, Homo sapiens
ttcccaacttggctt

SEQ ID NO: 18363 - DNA, 15 bp, Homo sapiens
cttcccaacttggct

SEQ ID NO: 18364 - DNA, 15 bp, Homo sapiens
tcttcccaacttggc

SEQ ID NO: 18365 - DNA, 15 bp, Homo sapiens
atcttcccaacttgg

SEQ ID NO: 18366 - DNA, 15 bp, Homo sapiens
aatcttcccaacttg

SEQ ID NO: 18367 - DNA, 15 bp, Homo sapiens
caatcttcccaactt

SEQ ID NO: 18368 - DNA, 15 bp, Homo sapiens
gcaatcttcccaact

SEQ ID NO: 18369 - DNA, 15 bp, Homo sapiens
agcaatcttcccaac

SEQ ID NO: 18370 - DNA, 15 bp, Homo sapiens
aagcaatcttcccaa

SEQ ID NO: 18371 - DNA, 15 bp, Homo sapiens
caagcaatcttccca

SEQ ID NO: 18372 - DNA, 15 bp, Homo sapiens
tcaagcaatcttccc

SEQ ID NO: 18373 - DNA, 15 bp, Homo sapiens
ctcaagcaatcttcc

SEQ ID NO: 18374 - DNA, 15 bp, Homo sapiens
gctcaagcaatcttc

SEQ ID NO: 18375 - DNA, 15 bp, Homo sapiens
ggctcaagcaatctt

SEQ ID NO: 18376 - DNA, 15 bp, Homo sapiens
gggctcaagcaatct

SEQ ID NO: 18377 - DNA, 15 bp, Homo sapiens
tgggctcaagcaatc

SEQ ID NO: 18378 - DNA, 15 bp, Homo sapiens
ctgggctcaagcaat

SEQ ID NO: 18379 - DNA, 15 bp, Homo sapiens
cctgggctcaagcaa

SEQ ID NO: 18380 - DNA, 15 bp, Homo sapiens
tcctgggctcaagca

SEQ ID NO: 18381 - DNA, 15 bp, Homo sapiens
ttcctgggctcaagc

SEQ ID NO: 18382 - DNA, 15 bp, Homo sapiens
cttcctgggctcaag

SEQ ID NO: 18383 - DNA, 15 bp, Homo sapiens
acttcctgggctcaa

SEQ ID NO: 18384 - DNA, 15 bp, Homo sapiens
aacttcctgggctca

SEQ ID NO: 18385 - DNA, 15 bp, Homo sapiens
caacttcctgggctc

SEQ ID NO: 18386 - DNA, 15 bp, Homo sapiens
tcaacttcctgggct

SEQ ID NO: 18387 - DNA, 15 bp, Homo sapiens
ctcaacttcctgggc

SEQ ID NO: 18388 - DNA, 15 bp, Homo sapiens
cctcaacttcctggg

SEQ ID NO: 18389 - DNA, 15 bp, Homo sapiens
gcctcaacttcctgg

SEQ ID NO: 18390 - DNA, 15 bp, Homo sapiens
agcctcaacttcctg

SEQ ID NO: 18391 - DNA, 15 bp, Homo sapiens
cagcctcaacttcct

SEQ ID NO: 18392 - DNA, 15 bp, Homo sapiens
acagcctcaacttcc

SEQ ID NO: 18393 - DNA, 15 bp, Homo sapiens
tacagcctcaacttc

SEQ ID NO: 18394 - DNA, 15 bp, Homo sapiens
ctacagcctcaactt

SEQ ID NO: 18395 - DNA, 15 bp, Homo sapiens
actacagcctcaact

SEQ ID NO: 18396 - DNA, 15 bp, Homo sapiens
cactacagcctcaac

SEQ ID NO: 18397 - DNA, 15 bp, Homo sapiens
tcactacagcctcaa

SEQ ID NO: 18398 - DNA, 15 bp, Homo sapiens
ctcactacagcctca

SEQ ID NO: 18399 - DNA, 15 bp, Homo sapiens
actcactacagcctc

SEQ ID NO: 18400 - DNA, 15 bp, Homo sapiens
aactcactacagcct

SEQ ID NO: 18401 - DNA, 15 bp, Homo sapiens
caactcactacagcc

SEQ ID NO: 18402 - DNA, 15 bp, Homo sapiens
acaactcactacagc

SEQ ID NO: 18403 - DNA, 15 bp, Homo sapiens
cacaactcactacag

SEQ ID NO: 18404 - DNA, 15 bp, Homo sapiens
tcacaactcactaca

SEQ ID NO: 18405 - DNA, 15 bp, Homo sapiens
atcacaactcactac

SEQ ID NO: 18406 - DNA, 15 bp, Homo sapiens
catcacaactcacta

SEQ ID NO: 18407 - DNA, 15 bp, Homo sapiens
ccatcacaactcact

SEQ ID NO: 18408 - DNA, 15 bp, Homo sapiens
accatcacaactcac

SEQ ID NO: 18409 - DNA, 15 bp, Homo sapiens
caccatcacaactca

SEQ ID NO: 18410 - DNA, 15 bp, Homo sapiens
gcaccatcacaactc

SEQ ID NO: 18411 - DNA, 15 bp, Homo sapiens
ggcaccatcacaact

SEQ ID NO: 18412 - DNA, 15 bp, Homo sapiens
tggcaccatcacaac

SEQ ID NO: 18413 - DNA, 15 bp, Homo sapiens
atggcaccatcacaa

SEQ ID NO: 18414 - DNA, 15 bp, Homo sapiens
aatggcaccatcaca

SEQ ID NO: 18415 - DNA, 15 bp, Homo sapiens
caatggcaccatcac

SEQ ID NO: 18416 - DNA, 15 bp, Homo sapiens
gcaatggcaccatca

SEQ ID NO: 18417 - DNA, 15 bp, Homo sapiens
tgcaatggcaccatc

SEQ ID NO: 18418 - DNA, 15 bp, Homo sapiens
gtgcaatggcaccat

SEQ ID NO: 18419 - DNA, 15 bp, Homo sapiens
ggtgcaatggcacca

SEQ ID NO: 18420 - DNA, 15 bp, Homo sapiens
tggtgcaatggcacc

SEQ ID NO: 18421 - DNA, 15 bp, Homo sapiens
ctggtgcaatggcac

SEQ ID NO: 18422 - DNA, 15 bp, Homo sapiens
gctggtgcaatggca

SEQ ID NO: 18423 - DNA, 15 bp, Homo sapiens
ggctggtgcaatggc

SEQ ID NO: 18424 - DNA, 15 bp, Homo sapiens
gggctggtgcaatgg

SEQ ID NO: 18425 - DNA, 15 bp, Homo sapiens
cgggctggtgcaatg

SEQ ID NO: 18426 - DNA, 15 bp, Homo sapiens
ccgggctggtgcaat

SEQ ID NO: 18427 - DNA, 15 bp, Homo sapiens
cccgggctggtgcaa

SEQ ID NO: 18428 - DNA, 15 bp, Homo sapiens
acccgggctggtgca

SEQ ID NO: 18429 - DNA, 15 bp, Homo sapiens
cacccgggctggtgc

SEQ ID NO: 18430 - DNA, 15 bp, Homo sapiens
tcacccgggctggtg

SEQ ID NO: 18431 - DNA, 15 bp, Homo sapiens
atcacccgggctggt

SEQ ID NO: 18432 - DNA, 15 bp, Homo sapiens
tatcacccgggctgg

SEQ ID NO: 18433 - DNA, 15 bp, Homo sapiens
ctatcacccgggctg

SEQ ID NO: 18434 - DNA, 15 bp, Homo sapiens
tctatcacccgggct

SEQ ID NO: 18435 - DNA, 15 bp, Homo sapiens
ctctatcacccgggc

SEQ ID NO: 18436 - DNA, 15 bp, Homo sapiens
gctctatcacccggg

SEQ ID NO: 18437 - DNA, 15 bp, Homo sapiens
tgctctatcacccgg

SEQ ID NO: 18438 - DNA, 15 bp, Homo sapiens
ttgctctatcacccg

SEQ ID NO: 18439 - DNA, 15 bp, Homo sapiens
ggtcttgctctatca

SEQ ID NO: 18440 - DNA, 15 bp, Homo sapiens
aggtcttgctctatc

SEQ ID NO: 18441 - DNA, 15 bp, Homo sapiens
gaggtcttgctctat

SEQ ID NO: 18442 - DNA, 15 bp, Homo sapiens
agaggtcttgctcta

SEQ ID NO: 18443 - DNA, 15 bp, Homo sapiens
cagaggtcttgctct

SEQ ID NO: 18444 - DNA, 15 bp, Homo sapiens
acagaggtcttgctc

SEQ ID NO: 18445 - DNA, 15 bp, Homo sapiens
gacagaggtcttgct

SEQ ID NO: 18446 - DNA, 15 bp, Homo sapiens
agacagaggtcttgc

SEQ ID NO: 18447 - DNA, 15 bp, Homo sapiens
gagacagaggtcttg

SEQ ID NO: 18448 - DNA, 15 bp, Homo sapiens
cgagacagaggtctt

SEQ ID NO: 18449 - DNA, 15 bp, Homo sapiens
tcgagacagaggtct

SEQ ID NO: 18450 - DNA, 15 bp, Homo sapiens
ttcgagacagaggtc

SEQ ID NO: 18451 - DNA, 15 bp, Homo sapiens
tttcgagacagaggt

SEQ ID NO: 18452 - DNA, 15 bp, Homo sapiens
ttttcgagacagagg

SEQ ID NO: 18453 - DNA, 15 bp, Homo sapiens
tttttcgagacagag

SEQ ID NO: 18454 - DNA, 15 bp, Homo sapiens
ttttttcgagacaga

SEQ ID NO: 18455 - DNA, 15 bp, Homo sapiens
tttttttcgagacag

SEQ ID NO: 18456 - DNA, 15 bp, Homo sapiens
ttttttttcgagaca

SEQ ID NO: 18457 - DNA, 15 bp, Homo sapiens
tttttttttcgagac

SEQ ID NO: 18458 - DNA, 15 bp, Homo sapiens
ttttttttttcgaga

SEQ ID NO: 18459 - DNA, 15 bp, Homo sapiens
tttttttttttcgag

SEQ ID NO: 18460 - DNA, 15 bp, Homo sapiens
ttttttttttttcga

SEQ ID NO: 18461 - DNA, 15 bp, Homo sapiens
tttttttttttttcg

SEQ ID NO: 18462 - DNA, 15 bp, Homo sapiens
ctttttttttttttc

SEQ ID NO: 18463 - DNA, 15 bp, Homo sapiens
atacttttttttttt

SEQ ID NO: 18464 - DNA, 15 bp, Homo sapiens
gatactttttttttt

SEQ ID NO: 18465 - DNA, 15 bp, Homo sapiens
tgatacttttttttt

SEQ ID NO: 18466 - DNA, 15 bp, Homo sapiens
ctgatactttttttt

SEQ ID NO: 18467 - DNA, 15 bp, Homo sapiens
actgatacttttttt

SEQ ID NO: 18468 - DNA, 15 bp, Homo sapiens
tactgatactttttt

SEQ ID NO: 18469 - DNA, 15 bp, Homo sapiens
atactgatacttttt

SEQ ID NO: 18470 - DNA, 15 bp, Homo sapiens
tatactgatactttt

SEQ ID NO: 18471 - DNA, 15 bp, Homo sapiens
atatactgatacttt

SEQ ID NO: 18472 - DNA, 15 bp, Homo sapiens
tatatactgatactt

SEQ ID NO: 18473 - DNA, 15 bp, Homo sapiens
atatatactgatact

SEQ ID NO: 18474 - DNA, 15 bp, Homo sapiens
catatatactgatac

SEQ ID NO: 18475 - DNA, 15 bp, Homo sapiens
acatatatactgata

SEQ ID NO: 18476 - DNA, 15 bp, Homo sapiens
aacatatatactgat

SEQ ID NO: 18477 - DNA, 15 bp, Homo sapiens
taacatatatactga

SEQ ID NO: 18478 - DNA, 15 bp, Homo sapiens
ttaacatatatactg

SEQ ID NO: 18479 - DNA, 15 bp, Homo sapiens
tttaacatatatact

SEQ ID NO: 18480 - DNA, 15 bp, Homo sapiens
ctttaacatatatac

SEQ ID NO: 18481 - DNA, 15 bp, Homo sapiens
actttaacatatata

SEQ ID NO: 18482 - DNA, 15 bp, Homo sapiens
tactttaacatatat

SEQ ID NO: 18483 - DNA, 15 bp, Homo sapiens
atactttaacatata

SEQ ID NO: 18484 - DNA, 15 bp, Homo sapiens
aatactttaacatat

SEQ ID NO: 18485 - DNA, 15 bp, Homo sapiens
aaatactttaacata

SEQ ID NO: 18486 - DNA, 15 bp, Homo sapiens
taaatactttaacat

SEQ ID NO: 18487 - DNA, 15 bp, Homo sapiens
ataaatactttaaca

SEQ ID NO: 18488 - DNA, 15 bp, Homo sapiens
aataaatactttaac

SEQ ID NO: 18489 - DNA, 15 bp, Homo sapiens
taataaatactttaa

SEQ ID NO: 18490 - DNA, 15 bp, Homo sapiens
ttaataaatacttta

SEQ ID NO: 18491 - DNA, 15 bp, Homo sapiens
tttaataaatacttt

SEQ ID NO: 18492 - DNA, 15 bp, Homo sapiens
ctttaataaatactt

SEQ ID NO: 18493 - DNA, 15 bp, Homo sapiens
actttaataaatact

SEQ ID NO: 18494 - DNA, 15 bp, Homo sapiens
tactttaataaatac

SEQ ID NO: 18495 - DNA, 15 bp, Homo sapiens
atactttaataaata

SEQ ID NO: 18496 - DNA, 15 bp, Homo sapiens
tatactttaataaat

SEQ ID NO: 18497 - DNA, 15 bp, Homo sapiens
gtatactttaataaa

SEQ ID NO: 18498 - DNA, 15 bp, Homo sapiens
tgtatactttaataa

SEQ ID NO: 18499 - DNA, 15 bp, Homo sapiens
ttgtatactttaata

SEQ ID NO: 18500 - DNA, 15 bp, Homo sapiens
gttgtatactttaat

SEQ ID NO: 18501 - DNA, 15 bp, Homo sapiens
tgttgtatactttaa

SEQ ID NO: 18502 - DNA, 15 bp, Homo sapiens
ttgttgtatacttta

SEQ ID NO: 18503 - DNA, 15 bp, Homo sapiens
tttgttgtatacttt

SEQ ID NO: 18504 - DNA, 15 bp, Homo sapiens
atttgttgtatactt

SEQ ID NO: 18505 - DNA, 15 bp, Homo sapiens
tatttgttgtatact

SEQ ID NO: 18506 - DNA, 15 bp, Homo sapiens
atatttgttgtatac

SEQ ID NO: 18507 - DNA, 15 bp, Homo sapiens
tatatttgttgtata

SEQ ID NO: 18508 - DNA, 15 bp, Homo sapiens
atatatttgttgtat

SEQ ID NO: 18509 - DNA, 15 bp, Homo sapiens
catatatttgttgta

SEQ ID NO: 18510 - DNA, 15 bp, Homo sapiens
acatatatttgttgt

SEQ ID NO: 18511 - DNA, 15 bp, Homo sapiens
tacatatatttgttg

SEQ ID NO: 18512 - DNA, 15 bp, Homo sapiens
ttacatatatttgtt

SEQ ID NO: 18513 - DNA, 15 bp, Homo sapiens
tttacatatatttgt

SEQ ID NO: 18514 - DNA, 15 bp, Homo sapiens
atttacatatatttg

SEQ ID NO: 18515 - DNA, 15 bp, Homo sapiens
tatttacatatattt

SEQ ID NO: 18516 - DNA, 15 bp, Homo sapiens
ttatttacatatatt

SEQ ID NO: 18517 - DNA, 15 bp, Homo sapiens
attatttacatatat

SEQ ID NO: 18518 - DNA, 15 bp, Homo sapiens
tattatttacatata

SEQ ID NO: 18519 - DNA, 15 bp, Homo sapiens
gtattatttacatat

SEQ ID NO: 18520 - DNA, 15 bp, Homo sapiens
tgtattatttacata

SEQ ID NO: 18521 - DNA, 15 bp, Homo sapiens
ctgtattatttacat

SEQ ID NO: 18522 - DNA, 15 bp, Homo sapiens
actgtattatttaca

SEQ ID NO: 18523 - DNA, 15 bp, Homo sapiens
gactgtattatttac

SEQ ID NO: 18524 - DNA, 15 bp, Homo sapiens
tgactgtattattta

SEQ ID NO: 18525 - DNA, 15 bp, Homo sapiens
gtgactgtattattt

SEQ ID NO: 18526 - DNA, 15 bp, Homo sapiens
tgtgactgtattatt

SEQ ID NO: 18527 - DNA, 15 bp, Homo sapiens
ctgtgactgtattat

SEQ ID NO: 18528 - DNA, 15 bp, Homo sapiens
actgtgactgtatta

SEQ ID NO: 18529 - DNA, 15 bp, Homo sapiens
tactgtgactgtatt

SEQ ID NO: 18530 - DNA, 15 bp, Homo sapiens
atactgtgactgtat

SEQ ID NO: 18531 - DNA, 15 bp, Homo sapiens
gatactgtgactgta

SEQ ID NO: 18532 - DNA, 15 bp, Homo sapiens
tgatactgtgactgt

SEQ ID NO: 18533 - DNA, 15 bp, Homo sapiens
ctgatactgtgactg

SEQ ID NO: 18534 - DNA, 15 bp, Homo sapiens
tctgatactgtgact

SEQ ID NO: 18535 - DNA, 15 bp, Homo sapiens
ctctgatactgtgac

SEQ ID NO: 18536 - DNA, 15 bp, Homo sapiens
actctgatactgtga

SEQ ID NO: 18537 - DNA, 15 bp, Homo sapiens
tactctgatactgtg

SEQ ID NO: 18538 - DNA, 15 bp, Homo sapiens
atactctgatactgt

SEQ ID NO: 18539 - DNA, 15 bp, Homo sapiens
tatactctgatactg

SEQ ID NO: 18540 - DNA, 15 bp, Homo sapiens
ttatactctgatact

SEQ ID NO: 18541 - DNA, 15 bp, Homo sapiens
tttatactctgatac

SEQ ID NO: 18542 - DNA, 15 bp, Homo sapiens
ttttatactctgata

SEQ ID NO: 18543 - DNA, 15 bp, Homo sapiens
attttatactctgat

SEQ ID NO: 18544 - DNA, 15 bp, Homo sapiens
cattttatactctga

SEQ ID NO: 18545 - DNA, 15 bp, Homo sapiens
tcattttatactctg

SEQ ID NO: 18546 - DNA, 15 bp, Homo sapiens
atcattttatactct

SEQ ID NO: 18547 - DNA, 15 bp, Homo sapiens
aatcattttatactc

SEQ ID NO: 18548 - DNA, 15 bp, Homo sapiens
taatcattttatact

SEQ ID NO: 18549 - DNA, 15 bp, Homo sapiens
gtaatcattttatac

SEQ ID NO: 18550 - DNA, 15 bp, Homo sapiens
agtaatcattttata

SEQ ID NO: 18551 - DNA, 15 bp, Homo sapiens
cagtaatcattttat

SEQ ID NO: 18552 - DNA, 15 bp, Homo sapiens
tcagtaatcatttta

SEQ ID NO: 18553 - DNA, 15 bp, Homo sapiens
ttcagtaatcatttt

SEQ ID NO: 18554 - DNA, 15 bp, Homo sapiens
tttcagtaatcattt

SEQ ID NO: 18555 - DNA, 15 bp, Homo sapiens
ttttcagtaatcatt

SEQ ID NO: 18556 - DNA, 15 bp, Homo sapiens
tttttcagtaatcat

SEQ ID NO: 18557 - DNA, 15 bp, Homo sapiens
atttttcagtaatca

SEQ ID NO: 18558 - DNA, 15 bp, Homo sapiens
tatttttcagtaatc

SEQ ID NO: 18559 - DNA, 15 bp, Homo sapiens
ttatttttcagtaat

SEQ ID NO: 18560 - DNA, 15 bp, Homo sapiens
tttatttttcagtaa

SEQ ID NO: 18561 - DNA, 15 bp, Homo sapiens
atttatttttcagta

SEQ ID NO: 18562 - DNA, 15 bp, Homo sapiens
aatttatttttcagt

SEQ ID NO: 18563 - DNA, 15 bp, Homo sapiens
taatttatttttcag

SEQ ID NO: 18564 - DNA, 15 bp, Homo sapiens
ttaatttatttttca

SEQ ID NO: 18565 - DNA, 15 bp, Homo sapiens
attaatttatttttc

SEQ ID NO: 18566 - DNA, 15 bp, Homo sapiens
aattaatttattttt

SEQ ID NO: 18567 - DNA, 15 bp, Homo sapiens
aaattaatttatttt

SEQ ID NO: 18568 - DNA, 15 bp, Homo sapiens
caaattaatttattt

SEQ ID NO: 18569 - DNA, 15 bp, Homo sapiens
tcaaattaatttatt

SEQ ID NO: 18570 - DNA, 15 bp, Homo sapiens
ttcaaattaatttat

SEQ ID NO: 18571 - DNA, 15 bp, Homo sapiens
attcaaattaattta

SEQ ID NO: 18572 - DNA, 15 bp, Homo sapiens
tattcaaattaattt

SEQ ID NO: 18573 - DNA, 15 bp, Homo sapiens
ctattcaaattaatt

SEQ ID NO: 18574 - DNA, 15 bp, Homo sapiens
actattcaaattaat

SEQ ID NO: 18575 - DNA, 15 bp, Homo sapiens
aactattcaaattaa

SEQ ID NO: 18576 - DNA, 15 bp, Homo sapiens
taactattcaaatta

SEQ ID NO: 18577 - DNA, 15 bp, Homo sapiens
gtaactattcaaatt

SEQ ID NO: 18578 - DNA, 15 bp, Homo sapiens
agtaactattcaaat

SEQ ID NO: 18579 - DNA, 15 bp, Homo sapiens
gagtaactattcaaa

SEQ ID NO: 18580 - DNA, 15 bp, Homo sapiens
ggagtaactattcaa

SEQ ID NO: 18581 - DNA, 15 bp, Homo sapiens
tggagtaactattca

SEQ ID NO: 18582 - DNA, 15 bp, Homo sapiens
ctggagtaactattc

SEQ ID NO: 18583 - DNA, 15 bp, Homo sapiens
tctggagtaactatt

SEQ ID NO: 18584 - DNA, 15 bp, Homo sapiens
ttctggagtaactat

SEQ ID NO: 18585 - DNA, 15 bp, Homo sapiens
tttctggagtaacta

SEQ ID NO: 18586 - DNA, 15 bp, Homo sapiens
ttttctggagtaact

SEQ ID NO: 18587 - DNA, 15 bp, Homo sapiens
attttctggagtaac

SEQ ID NO: 18588 - DNA, 15 bp, Homo sapiens
tattttctggagtaa

SEQ ID NO: 18589 - DNA, 15 bp, Homo sapiens
ttattttctggagta

SEQ ID NO: 18590 - DNA, 15 bp, Homo sapiens
attattttctggagt

SEQ ID NO: 18591 - DNA, 15 bp, Homo sapiens
gattattttctggag

SEQ ID NO: 18592 - DNA, 15 bp, Homo sapiens
tgattattttctgga

SEQ ID NO: 18593 - DNA, 15 bp, Homo sapiens
ttgattattttctgg

SEQ ID NO: 18594 - DNA, 15 bp, Homo sapiens
attgattattttctg

SEQ ID NO: 18595 - DNA, 15 bp, Homo sapiens
cattgattattttct

SEQ ID NO: 18596 - DNA, 15 bp, Homo sapiens
ccattgattattttc

SEQ ID NO: 18597 - DNA, 15 bp, Homo sapiens
cccattgattatttt

SEQ ID NO: 18598 - DNA, 15 bp, Homo sapiens
ccccattgattattt

SEQ ID NO: 18599 - DNA, 15 bp, Homo sapiens
tccccattgattatt

SEQ ID NO: 18600 - DNA, 15 bp, Homo sapiens
atccccattgattat

SEQ ID NO: 18601 - DNA, 15 bp, Homo sapiens
aatccccattgatta

SEQ ID NO: 18602 - DNA, 15 bp, Homo sapiens
gaatccccattgatt

SEQ ID NO: 18603 - DNA, 15 bp, Homo sapiens
agaatccccattgat

SEQ ID NO: 18604 - DNA, 15 bp, Homo sapiens
tagaatccccattga

SEQ ID NO: 18605 - DNA, 15 bp, Homo sapiens
gtagaatccccattg

SEQ ID NO: 18606 - DNA, 15 bp, Homo sapiens
agtagaatccccatt

SEQ ID NO: 18607 - DNA, 15 bp, Homo sapiens
aagtagaatccccat

SEQ ID NO: 18608 - DNA, 15 bp, Homo sapiens
caagtagaatcccca

SEQ ID NO: 18609 - DNA, 15 bp, Homo sapiens
tcaagtagaatcccc

SEQ ID NO: 18610 - DNA, 15 bp, Homo sapiens
ttcaagtagaatccc

SEQ ID NO: 18611 - DNA, 15 bp, Homo sapiens
tttcaagtagaatcc

SEQ ID NO: 18612 - DNA, 15 bp, Homo sapiens
ttttcaagtagaatc

SEQ ID NO: 18613 - DNA, 15 bp, Homo sapiens
attttcaagtagaat

SEQ ID NO: 18614 - DNA, 15 bp, Homo sapiens
aattttcaagtagaa

SEQ ID NO: 18615 - DNA, 15 bp, Homo sapiens
gaattttcaagtaga

SEQ ID NO: 18616 - DNA, 15 bp, Homo sapiens
tgaattttcaagtag

SEQ ID NO: 18617 - DNA, 15 bp, Homo sapiens
gtgaattttcaagta

SEQ ID NO: 18618 - DNA, 15 bp, Homo sapiens
agtgaattttcaagt

SEQ ID NO: 18619 - DNA, 15 bp, Homo sapiens
aagtgaattttcaag

SEQ ID NO: 18620 - DNA, 15 bp, Homo sapiens
aaagtgaattttcaa

SEQ ID NO: 18621 - DNA, 15 bp, Homo sapiens
aaaagtgaattttca

SEQ ID NO: 18622 - DNA, 15 bp, Homo sapiens
aaaaagtgaattttc

SEQ ID NO: 18623 - DNA, 15 bp, Homo sapiens
aaaaaagtgaatttt

SEQ ID NO: 18624 - DNA, 15 bp, Homo sapiens
taaaaaagtgaattt

SEQ ID NO: 18625 - DNA, 15 bp, Homo sapiens
ataaaaaagtgaatt

SEQ ID NO: 18626 - DNA, 15 bp, Homo sapiens
aataaaaaagtgaat

SEQ ID NO: 18627 - DNA, 15 bp, Homo sapiens
aaataaaaaagtgaa

SEQ ID NO: 18628 - DNA, 15 bp, Homo sapiens
aaaataaaaaagtga

SEQ ID NO: 18629 - DNA, 15 bp, Homo sapiens
caaaataaaaaagtg

SEQ ID NO: 18630 - DNA, 15 bp, Homo sapiens
ccaaaataaaaaagt

SEQ ID NO: 18631 - DNA, 15 bp, Homo sapiens
tccaaaataaaaaag

SEQ ID NO: 18632 - DNA, 15 bp, Homo sapiens
ttccaaaataaaaaa

SEQ ID NO: 18633 - DNA, 15 bp, Homo sapiens
attccaaaataaaaa

SEQ ID NO: 18634 - DNA, 15 bp, Homo sapiens
aattccaaaataaaa

SEQ ID NO: 18635 - DNA, 15 bp, Homo sapiens
caattccaaaataaa

SEQ ID NO: 18636 - DNA, 15 bp, Homo sapiens
acaattccaaaataa

SEQ ID NO: 18637 - DNA, 15 bp, Homo sapiens
cacaattccaaaata

SEQ ID NO: 18638 - DNA, 15 bp, Homo sapiens
acacaattccaaaat

SEQ ID NO: 18639 - DNA, 15 bp, Homo sapiens
aacacaattccaaaa

SEQ ID NO: 18640 - DNA, 15 bp, Homo sapiens
caacacaattccaaa

SEQ ID NO: 18641 - DNA, 15 bp, Homo sapiens
tcaacacaattccaa

SEQ ID NO: 18642 - DNA, 15 bp, Homo sapiens
atcaacacaattcca

SEQ ID NO: 18643 - DNA, 15 bp, Homo sapiens
aatcaacacaattcc

SEQ ID NO: 18644 - DNA, 15 bp, Homo sapiens
aaatcaacacaattc

SEQ ID NO: 18645 - DNA, 15 bp, Homo sapiens
aaaatcaacacaatt

SEQ ID NO: 18646 - DNA, 15 bp, Homo sapiens
aaaaatcaacacaat

SEQ ID NO: 18647 - DNA, 15 bp, Homo sapiens
taaaaatcaacacaa

SEQ ID NO: 18648 - DNA, 15 bp, Homo sapiens
ataaaaatcaacaca

SEQ ID NO: 18649 - DNA, 15 bp, Homo sapiens
gataaaaatcaacac

SEQ ID NO: 18650 - DNA, 15 bp, Homo sapiens
ggataaaaatcaaca

SEQ ID NO: 18651 - DNA, 15 bp, Homo sapiens
aggataaaaatcaac

SEQ ID NO: 18652 - DNA, 15 bp, Homo sapiens
caggataaaaatcaa

SEQ ID NO: 18653 - DNA, 15 bp, Homo sapiens
tcaggataaaaatca

SEQ ID NO: 18654 - DNA, 15 bp, Homo sapiens
gtcaggataaaaatc

SEQ ID NO: 18655 - DNA, 15 bp, Homo sapiens
tgtcaggataaaaat

SEQ ID NO: 18656 - DNA, 15 bp, Homo sapiens
gtgtcaggataaaaa

SEQ ID NO: 18657 - DNA, 15 bp, Homo sapiens
ggtgtcaggataaaa

SEQ ID NO: 18658 - DNA, 15 bp, Homo sapiens
gggtgtcaggataaa

SEQ ID NO: 18659 - DNA, 15 bp, Homo sapiens
agggtgtcaggataa

SEQ ID NO: 18660 - DNA, 15 bp, Homo sapiens
aagggtgtcaggata

SEQ ID NO: 18661 - DNA, 15 bp, Homo sapiens
aaagggtgtcaggat

SEQ ID NO: 18662 - DNA, 15 bp, Homo sapiens
caaagggtgtcagga

SEQ ID NO: 18663 - DNA, 15 bp, Homo sapiens
acaaagggtgtcagg

SEQ ID NO: 18664 - DNA, 15 bp, Homo sapiens
aacaaagggtgtcag

SEQ ID NO: 18665 - DNA, 15 bp, Homo sapiens
gaacaaagggtgtca

SEQ ID NO: 18666 - DNA, 15 bp, Homo sapiens
agaacaaagggtgtc

SEQ ID NO: 18667 - DNA, 15 bp, Homo sapiens
cagaacaaagggtgt

SEQ ID NO: 18668 - DNA, 15 bp, Homo sapiens
ccagaacaaagggtg

SEQ ID NO: 18669 - DNA, 15 bp, Homo sapiens
accagaacaaagggt

SEQ ID NO: 18670 - DNA, 15 bp, Homo sapiens
taccagaacaaaggg

SEQ ID NO: 18671 - DNA, 15 bp, Homo sapiens
ataccagaacaaagg

SEQ ID NO: 18672 - DNA, 15 bp, Homo sapiens
aataccagaacaaag

SEQ ID NO: 18673 - DNA, 15 bp, Homo sapiens
taataccagaacaaa

SEQ ID NO: 18674 - DNA, 15 bp, Homo sapiens
ttaataccagaacaa

SEQ ID NO: 18675 - DNA, 15 bp, Homo sapiens
attaataccagaaca

SEQ ID NO: 18676 - DNA, 15 bp, Homo sapiens
aattaataccagaac

SEQ ID NO: 18677 - DNA, 15 bp, Homo sapiens
aaattaataccagaa

SEQ ID NO: 18678 - DNA, 15 bp, Homo sapiens
gaaattaataccaga

SEQ ID NO: 18679 - DNA, 15 bp, Homo sapiens
ggaaattaataccag

SEQ ID NO: 18680 - DNA, 15 bp, Homo sapiens
tggaaattaatacca

SEQ ID NO: 18681 - DNA, 15 bp, Homo sapiens
atggaaattaatacc

SEQ ID NO: 18682 - DNA, 15 bp, Homo sapiens
aatggaaattaatac

SEQ ID NO: 18683 - DNA, 15 bp, Homo sapiens
taatggaaattaata

SEQ ID NO: 18684 - DNA, 15 bp, Homo sapiens
gtaatggaaattaat

SEQ ID NO: 18685 - DNA, 15 bp, Homo sapiens
agtaatggaaattaa

SEQ ID NO: 18686 - DNA, 15 bp, Homo sapiens
tagtaatggaaatta

SEQ ID NO: 18687 - DNA, 15 bp, Homo sapiens
ttagtaatggaaatt

SEQ ID NO: 18688 - DNA, 15 bp, Homo sapiens
cttagtaatggaaat

SEQ ID NO: 18689 - DNA, 15 bp, Homo sapiens
acttagtaatggaaa

SEQ ID NO: 18690 - DNA, 15 bp, Homo sapiens
aacttagtaatggaa

SEQ ID NO: 18691 - DNA, 15 bp, Homo sapiens
aaacttagtaatgga

SEQ ID NO: 18692 - DNA, 15 bp, Homo sapiens
aaaacttagtaatgg

SEQ ID NO: 18693 - DNA, 15 bp, Homo sapiens
gaaaacttagtaatg

SEQ ID NO: 18694 - DNA, 15 bp, Homo sapiens
ggaaaacttagtaat

SEQ ID NO: 18695 - DNA, 15 bp, Homo sapiens
gggaaaacttagtaa

SEQ ID NO: 18696 - DNA, 15 bp, Homo sapiens
tgggaaaacttagta

SEQ ID NO: 18697 - DNA, 15 bp, Homo sapiens
ctgggaaaacttagt

SEQ ID NO: 18698 - DNA, 15 bp, Homo sapiens
gctgggaaaacttag

SEQ ID NO: 18699 - DNA, 15 bp, Homo sapiens
agctgggaaaactta

SEQ ID NO: 18700 - DNA, 15 bp, Homo sapiens
aagctgggaaaactt

SEQ ID NO: 18701 - DNA, 15 bp, Homo sapiens
taagctgggaaaact

SEQ ID NO: 18702 - DNA, 15 bp, Homo sapiens
gtaagctgggaaaac

SEQ ID NO: 18703 - DNA, 15 bp, Homo sapiens
ggtaagctgggaaaa

SEQ ID NO: 18704 - DNA, 15 bp, Homo sapiens
aggtaagctgggaaa

SEQ ID NO: 18705 - DNA, 15 bp, Homo sapiens
gaggtaagctgggaa

SEQ ID NO: 18706 - DNA, 15 bp, Homo sapiens
ggaggtaagctggga

SEQ ID NO: 18707 - DNA, 15 bp, Homo sapiens
aggaggtaagctggg

SEQ ID NO: 18708 - DNA, 15 bp, Homo sapiens
aaggaggtaagctgg

SEQ ID NO: 18709 - DNA, 15 bp, Homo sapiens
aaaggaggtaagctg

SEQ ID NO: 18710 - DNA, 15 bp, Homo sapiens
caaaggaggtaagct

SEQ ID NO: 18711 - DNA, 15 bp, Homo sapiens
tcaaaggaggtaagc

SEQ ID NO: 18712 - DNA, 15 bp, Homo sapiens
ttcaaaggaggtaag

SEQ ID NO: 18713 - DNA, 15 bp, Homo sapiens
attcaaaggaggtaa

SEQ ID NO: 18714 - DNA, 15 bp, Homo sapiens
cattcaaaggaggta

SEQ ID NO: 18715 - DNA, 15 bp, Homo sapiens
tcattcaaaggaggt

SEQ ID NO: 18716 - DNA, 15 bp, Homo sapiens
ttcattcaaaggagg

SEQ ID NO: 18717 - DNA, 15 bp, Homo sapiens
attcattcaaaggag

SEQ ID NO: 18718 - DNA, 15 bp, Homo sapiens
aattcattcaaagga

SEQ ID NO: 18719 - DNA, 15 bp, Homo sapiens
caattcattcaaagg

SEQ ID NO: 18720 - DNA, 15 bp, Homo sapiens
ccaattcattcaaag

SEQ ID NO: 18721 - DNA, 15 bp, Homo sapiens
cccaattcattcaaa

SEQ ID NO: 18722 - DNA, 15 bp, Homo sapiens
gcccaattcattcaa

SEQ ID NO: 18723 - DNA, 15 bp, Homo sapiens
ggcccaattcattca

SEQ ID NO: 18724 - DNA, 15 bp, Homo sapiens
aggcccaattcattc

SEQ ID NO: 18725 - DNA, 15 bp, Homo sapiens
aaggcccaattcatt

SEQ ID NO: 18726 - DNA, 15 bp, Homo sapiens
aaaggcccaattcat

SEQ ID NO: 18727 - DNA, 15 bp, Homo sapiens
aaaaggcccaattca

SEQ ID NO: 18728 - DNA, 15 bp, Homo sapiens
caaaaggcccaattc

SEQ ID NO: 18729 - DNA, 15 bp, Homo sapiens
gcaaaaggcccaatt

SEQ ID NO: 18730 - DNA, 15 bp, Homo sapiens
ggcaaaaggcccaat

SEQ ID NO: 18731 - DNA, 15 bp, Homo sapiens
tggcaaaaggcccaa

SEQ ID NO: 18732 - DNA, 15 bp, Homo sapiens
ttggcaaaaggccca

SEQ ID NO: 18733 - DNA, 15 bp, Homo sapiens
gttggcaaaaggccc

SEQ ID NO: 18734 - DNA, 15 bp, Homo sapiens
ggttggcaaaaggcc

SEQ ID NO: 18735 - DNA, 15 bp, Homo sapiens
aggttggcaaaaggc

SEQ ID NO: 18736 - DNA, 15 bp, Homo sapiens
aaggttggcaaaagg

SEQ ID NO: 18737 - DNA, 15 bp, Homo sapiens
aaaggttggcaaaag

SEQ ID NO: 18738 - DNA, 15 bp, Homo sapiens
aaaaggttggcaaaa

SEQ ID NO: 18739 - DNA, 15 bp, Homo sapiens
gaaaaggttggcaaa

SEQ ID NO: 18740 - DNA, 15 bp, Homo sapiens
agaaaaggttggcaa

SEQ ID NO: 18741 - DNA, 15 bp, Homo sapiens
gagaaaaggttggca

SEQ ID NO: 18742 - DNA, 15 bp, Homo sapiens
tgagaaaaggttggc

SEQ ID NO: 18743 - DNA, 15 bp, Homo sapiens
gtgagaaaaggttgg

SEQ ID NO: 18744 - DNA, 15 bp, Homo sapiens
tgtgagaaaaggttg

SEQ ID NO: 18745 - DNA, 15 bp, Homo sapiens
gtgtgagaaaaggtt

SEQ ID NO: 18746 - DNA, 15 bp, Homo sapiens
agtgtgagaaaaggt

SEQ ID NO: 18747 - DNA, 15 bp, Homo sapiens
tagtgtgagaaaagg

SEQ ID NO: 18748 - DNA, 15 bp, Homo sapiens
ttagtgtgagaaaag

SEQ ID NO: 18749 - DNA, 15 bp, Homo sapiens
gttagtgtgagaaaa

SEQ ID NO: 18750 - DNA, 15 bp, Homo sapiens
tgttagtgtgagaaa

SEQ ID NO: 18751 - DNA, 15 bp, Homo sapiens
ctgttagtgtgagaa

SEQ ID NO: 18752 - DNA, 15 bp, Homo sapiens
actgttagtgtgaga

SEQ ID NO: 18753 - DNA, 15 bp, Homo sapiens
tactgttagtgtgag

SEQ ID NO: 18754 - DNA, 15 bp, Homo sapiens
atactgttagtgtga

SEQ ID NO: 18755 - DNA, 15 bp, Homo sapiens
gatactgttagtgtg

SEQ ID NO: 18756 - DNA, 15 bp, Homo sapiens
ggatactgttagtgt

SEQ ID NO: 18757 - DNA, 15 bp, Homo sapiens
gggatactgttagtg

SEQ ID NO: 18758 - DNA, 15 bp, Homo sapiens
tgggatactgttagt

SEQ ID NO: 18759 - DNA, 15 bp, Homo sapiens
ttgggatactgttag

SEQ ID NO: 18760 - DNA, 15 bp, Homo sapiens
cttgggatactgtta

SEQ ID NO: 18761 - DNA, 15 bp, Homo sapiens
tcttgggatactgtt

SEQ ID NO: 18762 - DNA, 15 bp, Homo sapiens
ctcttgggatactgt

SEQ ID NO: 18763 - DNA, 15 bp, Homo sapiens
actcttgggatactg

SEQ ID NO: 18764 - DNA, 15 bp, Homo sapiens
cactcttgggatact

SEQ ID NO: 18765 - DNA, 15 bp, Homo sapiens
ccactcttgggatac

SEQ ID NO: 18766 - DNA, 15 bp, Homo sapiens
accactcttgggata

SEQ ID NO: 18767 - DNA, 15 bp, Homo sapiens
taccactcttgggat

SEQ ID NO: 18768 - DNA, 15 bp, Homo sapiens
ttaccactcttggga

SEQ ID NO: 18769 - DNA, 15 bp, Homo sapiens
attaccactcttggg

SEQ ID NO: 18770 - DNA, 15 bp, Homo sapiens
cattaccactcttgg

SEQ ID NO: 18771 - DNA, 15 bp, Homo sapiens
ccattaccactcttg

SEQ ID NO: 18772 - DNA, 15 bp, Homo sapiens
cccattaccactctt

SEQ ID NO: 18773 - DNA, 15 bp, Homo sapiens
acccattaccactct

SEQ ID NO: 18774 - DNA, 15 bp, Homo sapiens
cacccattaccactc

SEQ ID NO: 18775 - DNA, 15 bp, Homo sapiens
ccacccattaccact

SEQ ID NO: 18776 - DNA, 15 bp, Homo sapiens
cccacccattaccac

SEQ ID NO: 18777 - DNA, 15 bp, Homo sapiens
gcccacccattacca

SEQ ID NO: 18778 - DNA, 15 bp, Homo sapiens
tgcccacccattacc

SEQ ID NO: 18779 - DNA, 15 bp, Homo sapiens
atgcccacccattac

SEQ ID NO: 18780 - DNA, 15 bp, Homo sapiens
catgcccacccatta

SEQ ID NO: 18781 - DNA, 15 bp, Homo sapiens
tcatgcccacccatt

SEQ ID NO: 18782 - DNA, 15 bp, Homo sapiens
ttcatgcccacccat

SEQ ID NO: 18783 - DNA, 15 bp, Homo sapiens
attcatgcccaccca

SEQ ID NO: 18784 - DNA, 15 bp, Homo sapiens
cattcatgcccaccc

SEQ ID NO: 18785 - DNA, 15 bp, Homo sapiens
tcattcatgcccacc

SEQ ID NO: 18786 - DNA, 15 bp, Homo sapiens
ctcattcatgcccac

SEQ ID NO: 18787 - DNA, 15 bp, Homo sapiens
tctcattcatgccca

SEQ ID NO: 18788 - DNA, 15 bp, Homo sapiens
ctctcattcatgccc

SEQ ID NO: 18789 - DNA, 15 bp, Homo sapiens
cctctcattcatgcc

SEQ ID NO: 18790 - DNA, 15 bp, Homo sapiens
acctctcattcatgc

SEQ ID NO: 18791 - DNA, 15 bp, Homo sapiens
aacctctcattcatg

SEQ ID NO: 18792 - DNA, 15 bp, Homo sapiens
gaacctctcattcat

SEQ ID NO: 18793 - DNA, 15 bp, Homo sapiens
agaacctctcattca

SEQ ID NO: 18794 - DNA, 15 bp, Homo sapiens
tagaacctctcattc

SEQ ID NO: 18795 - DNA, 15 bp, Homo sapiens
ctagaacctctcatt

SEQ ID NO: 18796 - DNA, 15 bp, Homo sapiens
cctagaacctctcat

SEQ ID NO: 18797 - DNA, 15 bp, Homo sapiens
acctagaacctctca

SEQ ID NO: 18798 - DNA, 15 bp, Homo sapiens
aacctagaacctctc

SEQ ID NO: 18799 - DNA, 15 bp, Homo sapiens
gaacctagaacctct

SEQ ID NO: 18800 - DNA, 15 bp, Homo sapiens
agaacctagaacctc

SEQ ID NO: 18801 - DNA, 15 bp, Homo sapiens
aagaacctagaacct

SEQ ID NO: 18802 - DNA, 15 bp, Homo sapiens
caagaacctagaacc

SEQ ID NO: 18803 - DNA, 15 bp, Homo sapiens
ccaagaacctagaac

SEQ ID NO: 18804 - DNA, 15 bp, Homo sapiens
accaagaacctagaa

SEQ ID NO: 18805 - DNA, 15 bp, Homo sapiens
caccaagaacctaga

SEQ ID NO: 18806 - DNA, 15 bp, Homo sapiens
acaccaagaacctag

SEQ ID NO: 18807 - DNA, 15 bp, Homo sapiens
cacaccaagaaccta

SEQ ID NO: 18808 - DNA, 15 bp, Homo sapiens
ccacaccaagaacct

SEQ ID NO: 18809 - DNA, 15 bp, Homo sapiens
cccacaccaagaacc

SEQ ID NO: 18810 - DNA, 15 bp, Homo sapiens
acccacaccaagaac

SEQ ID NO: 18811 - DNA, 15 bp, Homo sapiens
gacccacaccaagaa

SEQ ID NO: 18812 - DNA, 15 bp, Homo sapiens
cgacccacaccaaga

SEQ ID NO: 18813 - DNA, 15 bp, Homo sapiens
gcgacccacaccaag

SEQ ID NO: 18814 - DNA, 15 bp, Homo sapiens
tgcgacccacaccaa

SEQ ID NO: 18815 - DNA, 15 bp, Homo sapiens
ctgcgacccacacca

SEQ ID NO: 18816 - DNA, 15 bp, Homo sapiens
tctgcgacccacacc

SEQ ID NO: 18817 - DNA, 15 bp, Homo sapiens
ctctgcgacccacac

SEQ ID NO: 18818 - DNA, 15 bp, Homo sapiens
tctctgcgacccaca

SEQ ID NO: 18819 - DNA, 15 bp, Homo sapiens
atctctgcgacccac

SEQ ID NO: 18820 - DNA, 15 bp, Homo sapiens
gatctctgcgaccca

SEQ ID NO: 18821 - DNA, 15 bp, Homo sapiens
agatctctgcgaccc

SEQ ID NO: 18822 - DNA, 15 bp, Homo sapiens
cagatctctgcgacc

SEQ ID NO: 18823 - DNA, 15 bp, Homo sapiens
acagatctctgcgac

SEQ ID NO: 18824 - DNA, 15 bp, Homo sapiens
aacagatctctgcga

SEQ ID NO: 18825 - DNA, 15 bp, Homo sapiens
aaacagatctctgcg

SEQ ID NO: 18826 - DNA, 15 bp, Homo sapiens
aaaacagatctctgc

SEQ ID NO: 18827 - DNA, 15 bp, Homo sapiens
aaaaacagatctctg

SEQ ID NO: 18828 - DNA, 15 bp, Homo sapiens
aaaaaacagatctct

SEQ ID NO: 18829 - DNA, 15 bp, Homo sapiens
gaaaaaacagatctc

SEQ ID NO: 18830 - DNA, 15 bp, Homo sapiens
agaaaaaacagatct

SEQ ID NO: 18831 - DNA, 15 bp, Homo sapiens
cagaaaaaacagatc

SEQ ID NO: 18832 - DNA, 15 bp, Homo sapiens
acagaaaaaacagat

SEQ ID NO: 18833 - DNA, 15 bp, Homo sapiens
gacagaaaaaacaga

SEQ ID NO: 18834 - DNA, 15 bp, Homo sapiens
agacagaaaaaacag

SEQ ID NO: 18835 - DNA, 15 bp, Homo sapiens
gagacagaaaaaaca

SEQ ID NO: 18836 - DNA, 15 bp, Homo sapiens
tgagacagaaaaaac

SEQ ID NO: 18837 - DNA, 15 bp, Homo sapiens
gtgagacagaaaaaa

SEQ ID NO: 18838 - DNA, 15 bp, Homo sapiens
tgtgagacagaaaaa

SEQ ID NO: 18839 - DNA, 15 bp, Homo sapiens
ttgtgagacagaaaa

SEQ ID NO: 18840 - DNA, 15 bp, Homo sapiens
gttgtgagacagaaa

SEQ ID NO: 18841 - DNA, 15 bp, Homo sapiens
ggttgtgagacagaa

SEQ ID NO: 18842 - DNA, 15 bp, Homo sapiens
gggttgtgagacaga

SEQ ID NO: 18843 - DNA, 15 bp, Homo sapiens
cgggttgtgagacag

SEQ ID NO: 18844 - DNA, 15 bp, Homo sapiens
gcgggttgtgagaca

SEQ ID NO: 18845 - DNA, 15 bp, Homo sapiens
agcgggttgtgagac

SEQ ID NO: 18846 - DNA, 15 bp, Homo sapiens
aagcgggttgtgaga

SEQ ID NO: 18847 - DNA, 15 bp, Homo sapiens
taagcgggttgtgag

SEQ ID NO: 18848 - DNA, 15 bp, Homo sapiens
ctaagcgggttgtga

SEQ ID NO: 18849 - DNA, 15 bp, Homo sapiens
cctaagcgggttgtg

SEQ ID NO: 18850 - DNA, 15 bp, Homo sapiens
acctaagcgggttgt

SEQ ID NO: 18851 - DNA, 15 bp, Homo sapiens
cacctaagcgggttg

SEQ ID NO: 18852 - DNA, 15 bp, Homo sapiens
tcacctaagcgggtt

SEQ ID NO: 18853 - DNA, 15 bp, Homo sapiens
ttcacctaagcgggt

SEQ ID NO: 18854 - DNA, 15 bp, Homo sapiens
attcacctaagcggg

SEQ ID NO: 18855 - DNA, 15 bp, Homo sapiens
gattcacctaagcgg

SEQ ID NO: 18856 - DNA, 15 bp, Homo sapiens
agattcacctaagcg

SEQ ID NO: 18857 - DNA, 15 bp, Homo sapiens
cagattcacctaagc

SEQ ID NO: 18858 - DNA, 15 bp, Homo sapiens
acagattcacctaag

SEQ ID NO: 18859 - DNA, 15 bp, Homo sapiens
gacagattcacctaa

SEQ ID NO: 18860 - DNA, 15 bp, Homo sapiens
agacagattcaccta

SEQ ID NO: 18861 - DNA, 15 bp, Homo sapiens
gagacagattcacct

SEQ ID NO: 18862 - DNA, 15 bp, Homo sapiens
agagacagattcacc

SEQ ID NO: 18863 - DNA, 15 bp, Homo sapiens
cagagacagattcac

SEQ ID NO: 18864 - DNA, 15 bp, Homo sapiens
acagagacagattca

SEQ ID NO: 18865 - DNA, 15 bp, Homo sapiens
gacagagacagattc

SEQ ID NO: 18866 - DNA, 15 bp, Homo sapiens
tgacagagacagatt

SEQ ID NO: 18867 - DNA, 15 bp, Homo sapiens
atgacagagacagat

SEQ ID NO: 18868 - DNA, 15 bp, Homo sapiens
gatgacagagacaga

SEQ ID NO: 18869 - DNA, 15 bp, Homo sapiens
tgatgacagagacag

SEQ ID NO: 18870 - DNA, 15 bp, Homo sapiens
ttgatgacagagaca

SEQ ID NO: 18871 - DNA, 15 bp, Homo sapiens
cttgatgacagagac

SEQ ID NO: 18872 - DNA, 15 bp, Homo sapiens
gcttgatgacagaga

SEQ ID NO: 18873 - DNA, 15 bp, Homo sapiens
tgcttgatgacagag

SEQ ID NO: 18874 - DNA, 15 bp, Homo sapiens
gtgcttgatgacaga

SEQ ID NO: 18875 - DNA, 15 bp, Homo sapiens
tgtgcttgatgacag

SEQ ID NO: 18876 - DNA, 15 bp, Homo sapiens
gtgtgcttgatgaca

SEQ ID NO: 18877 - DNA, 15 bp, Homo sapiens
agtgtgcttgatgac

SEQ ID NO: 18878 - DNA, 15 bp, Homo sapiens
cagtgtgcttgatga

SEQ ID NO: 18879 - DNA, 15 bp, Homo sapiens
tcagtgtgcttgatg

SEQ ID NO: 18880 - DNA, 15 bp, Homo sapiens
atcagtgtgcttgat

SEQ ID NO: 18881 - DNA, 15 bp, Homo sapiens
gatcagtgtgcttga

SEQ ID NO: 18882 - DNA, 15 bp, Homo sapiens
ggatcagtgtgcttg

SEQ ID NO: 18883 - DNA, 15 bp, Homo sapiens
gggatcagtgtgctt

SEQ ID NO: 18884 - DNA, 15 bp, Homo sapiens
cgggatcagtgtgct

SEQ ID NO: 18885 - DNA, 15 bp, Homo sapiens
acgggatcagtgtgc

SEQ ID NO: 18886 - DNA, 15 bp, Homo sapiens
gacgggatcagtgtg

SEQ ID NO: 18887 - DNA, 15 bp, Homo sapiens
ggacgggatcagtgt

SEQ ID NO: 18888 - DNA, 15 bp, Homo sapiens
gggacgggatcagtg

SEQ ID NO: 18889 - DNA, 15 bp, Homo sapiens
agggacgggatcagt

SEQ ID NO: 18890 - DNA, 15 bp, Homo sapiens
cagggacgggatcag

SEQ ID NO: 18891 - DNA, 15 bp, Homo sapiens
tcagggacgggatca

SEQ ID NO: 18892 - DNA, 15 bp, Homo sapiens
gtcagggacgggatc

SEQ ID NO: 18893 - DNA, 15 bp, Homo sapiens
ggtcagggacgggat

SEQ ID NO: 18894 - DNA, 15 bp, Homo sapiens
gggtcagggacggga

SEQ ID NO: 18895 - DNA, 15 bp, Homo sapiens
tgggtcagggacggg

SEQ ID NO: 18896 - DNA, 15 bp, Homo sapiens
gtgggtcagggacgg

SEQ ID NO: 18897 - DNA, 15 bp, Homo sapiens
cgtgggtcagggacg

SEQ ID NO: 18898 - DNA, 15 bp, Homo sapiens
tcgtgggtcagggac

SEQ ID NO: 18899 - DNA, 15 bp, Homo sapiens
ctcgtgggtcaggga

SEQ ID NO: 18900 - DNA, 15 bp, Homo sapiens
gctcgtgggtcaggg

SEQ ID NO: 18901 - DNA, 15 bp, Homo sapiens
agctcgtgggtcagg

SEQ ID NO: 18902 - DNA, 15 bp, Homo sapiens
cagctcgtgggtcag

SEQ ID NO: 18903 - DNA, 15 bp, Homo sapiens
acagctcgtgggtca

SEQ ID NO: 18904 - DNA, 15 bp, Homo sapiens
gacagctcgtgggtc

SEQ ID NO: 18905 - DNA, 15 bp, Homo sapiens
tgacagctcgtgggt

SEQ ID NO: 18906 - DNA, 15 bp, Homo sapiens
ttgacagctcgtggg

SEQ ID NO: 18907 - DNA, 15 bp, Homo sapiens
gttgacagctcgtgg

SEQ ID NO: 18908 - DNA, 15 bp, Homo sapiens
ggttgacagctcgtg

SEQ ID NO: 18909 - DNA, 15 bp, Homo sapiens
tggttgacagctcgt

SEQ ID NO: 18910 - DNA, 15 bp, Homo sapiens
ttggttgacagctcg

SEQ ID NO: 18911 - DNA, 15 bp, Homo sapiens
cttggttgacagctc

SEQ ID NO: 18912 - DNA, 15 bp, Homo sapiens
tcttggttgacagct

SEQ ID NO: 18913 - DNA, 15 bp, Homo sapiens
atcttggttgacagc

SEQ ID NO: 18914 - DNA, 15 bp, Homo sapiens
tatcttggttgacag

SEQ ID NO: 18915 - DNA, 15 bp, Homo sapiens
ttatcttggttgaca

SEQ ID NO: 18916 - DNA, 15 bp, Homo sapiens
tttatcttggttgac

SEQ ID NO: 18917 - DNA, 15 bp, Homo sapiens
ttttatcttggttga

SEQ ID NO: 18918 - DNA, 15 bp, Homo sapiens
tttttatcttggttg

SEQ ID NO: 18919 - DNA, 15 bp, Homo sapiens
ctttttatcttggtt

SEQ ID NO: 18920 - DNA, 15 bp, Homo sapiens
tctttttatcttggt

SEQ ID NO: 18921 - DNA, 15 bp, Homo sapiens
ttctttttatcttgg

SEQ ID NO: 18922 - DNA, 15 bp, Homo sapiens
gttctttttatcttg

SEQ ID NO: 18923 - DNA, 15 bp, Homo sapiens
tgttctttttatctt

SEQ ID NO: 18924 - DNA, 15 bp, Homo sapiens
atgttctttttatct

SEQ ID NO: 18925 - DNA, 15 bp, Homo sapiens
catgttctttttatc

SEQ ID NO: 18926 - DNA, 15 bp, Homo sapiens
gcatgttctttttat

SEQ ID NO: 18927 - DNA, 15 bp, Homo sapiens
agcatgttcttttta

SEQ ID NO: 18928 - DNA, 15 bp, Homo sapiens
cagcatgttcttttt

SEQ ID NO: 18929 - DNA, 15 bp, Homo sapiens
acagcatgttctttt

SEQ ID NO: 18930 - DNA, 15 bp, Homo sapiens
aacagcatgttcttt

SEQ ID NO: 18931 - DNA, 15 bp, Homo sapiens
aaacagcatgttctt

SEQ ID NO: 18932 - DNA, 15 bp, Homo sapiens
aaaacagcatgttct

SEQ ID NO: 18933 - DNA, 15 bp, Homo sapiens
gaaaacagcatgttc

SEQ ID NO: 18934 - DNA, 15 bp, Homo sapiens
agaaaacagcatgtt

SEQ ID NO: 18935 - DNA, 15 bp, Homo sapiens
cagaaaacagcatgt

SEQ ID NO: 18936 - DNA, 15 bp, Homo sapiens
acagaaaacagcatg

SEQ ID NO: 18937 - DNA, 15 bp, Homo sapiens
tacagaaaacagcat

SEQ ID NO: 18938 - DNA, 15 bp, Homo sapiens
ttacagaaaacagca

SEQ ID NO: 18939 - DNA, 15 bp, Homo sapiens
cttacagaaaacagc

SEQ ID NO: 18940 - DNA, 15 bp, Homo sapiens
acttacagaaaacag

SEQ ID NO: 18941 - DNA, 15 bp, Homo sapiens
tacttacagaaaaca

SEQ ID NO: 18942 - DNA, 15 bp, Homo sapiens
gtacttacagaaaac

SEQ ID NO: 18943 - DNA, 15 bp, Homo sapiens
agtacttacagaaaa

SEQ ID NO: 18944 - DNA, 15 bp, Homo sapiens
aagtacttacagaaa

SEQ ID NO: 18945 - DNA, 15 bp, Homo sapiens
aaagtacttacagaa

SEQ ID NO: 18946 - DNA, 15 bp, Homo sapiens
taaagtacttacaga

SEQ ID NO: 18947 - DNA, 15 bp, Homo sapiens
ataaagtacttacag

SEQ ID NO: 18948 - DNA, 15 bp, Homo sapiens
cataaagtacttaca

SEQ ID NO: 18949 - DNA, 15 bp, Homo sapiens
tcataaagtacttac

SEQ ID NO: 18950 - DNA, 15 bp, Homo sapiens
ttcataaagtactta

SEQ ID NO: 18951 - DNA, 15 bp, Homo sapiens
tttcataaagtactt

SEQ ID NO: 18952 - DNA, 15 bp, Homo sapiens
atttcataaagtact

SEQ ID NO: 18953 - DNA, 15 bp, Homo sapiens
catttcataaagtac

SEQ ID NO: 18954 - DNA, 15 bp, Homo sapiens
acatttcataaagta

SEQ ID NO: 18955 - DNA, 15 bp, Homo sapiens
cacatttcataaagt

SEQ ID NO: 18956 - DNA, 15 bp, Homo sapiens
acacatttcataaag

SEQ ID NO: 18957 - DNA, 15 bp, Homo sapiens
aacacatttcataaa

SEQ ID NO: 18958 - DNA, 15 bp, Homo sapiens
aaacacatttcataa

SEQ ID NO: 18959 - DNA, 15 bp, Homo sapiens
aaaacacatttcata

SEQ ID NO: 18960 - DNA, 15 bp, Homo sapiens
aaaaacacatttcat

SEQ ID NO: 18961 - DNA, 15 bp, Homo sapiens
taaaaacacatttca

SEQ ID NO: 18962 - DNA, 15 bp, Homo sapiens
ataaaaacacatttc

SEQ ID NO: 18963 - DNA, 15 bp, Homo sapiens
aataaaaacacattt

SEQ ID NO: 18964 - DNA, 15 bp, Homo sapiens
aaataaaaacacatt

SEQ ID NO: 18965 - DNA, 15 bp, Homo sapiens
taaataaaaacacat

SEQ ID NO: 18966 - DNA, 15 bp, Homo sapiens
gtaaataaaaacaca

SEQ ID NO: 18967 - DNA, 15 bp, Homo sapiens
tgtaaataaaaacac

SEQ ID NO: 18968 - DNA, 15 bp, Homo sapiens
ctgtaaataaaaaca

SEQ ID NO: 18969 - DNA, 15 bp, Homo sapiens
tctgtaaataaaaac

SEQ ID NO: 18970 - DNA, 15 bp, Homo sapiens
gtctgtaaataaaaa

SEQ ID NO: 18971 - DNA, 15 bp, Homo sapiens
tgtctgtaaataaaa

SEQ ID NO: 18972 - DNA, 15 bp, Homo sapiens
atgtctgtaaataaa

SEQ ID NO: 18973 - DNA, 15 bp, Homo sapiens
aatgtctgtaaataa

SEQ ID NO: 18974 - DNA, 15 bp, Homo sapiens
aaatgtctgtaaata

SEQ ID NO: 18975 - DNA, 15 bp, Homo sapiens
gaaatgtctgtaaat

SEQ ID NO: 18976 - DNA, 15 bp, Homo sapiens
ggaaatgtctgtaaa

SEQ ID NO: 18977 - DNA, 15 bp, Homo sapiens
tggaaatgtctgtaa

SEQ ID NO: 18978 - DNA, 15 bp, Homo sapiens
ttggaaatgtctgta

SEQ ID NO: 18979 - DNA, 15 bp, Homo sapiens
tttggaaatgtctgt

SEQ ID NO: 18980 - DNA, 15 bp, Homo sapiens
ctttggaaatgtctg

SEQ ID NO: 18981 - DNA, 15 bp, Homo sapiens
gctttggaaatgtct

SEQ ID NO: 18982 - DNA, 15 bp, Homo sapiens
ggctttggaaatgtc

SEQ ID NO: 18983 - DNA, 15 bp, Homo sapiens
aggctttggaaatgt

SEQ ID NO: 18984 - DNA, 15 bp, Homo sapiens
taggctttggaaatg

SEQ ID NO: 18985 - DNA, 15 bp, Homo sapiens
ttaggctttggaaat

SEQ ID NO: 18986 - DNA, 15 bp, Homo sapiens
attaggctttggaaa

SEQ ID NO: 18987 - DNA, 15 bp, Homo sapiens
gattaggctttggaa

SEQ ID NO: 18988 - DNA, 15 bp, Homo sapiens
tgattaggctttgga

SEQ ID NO: 18989 - DNA, 15 bp, Homo sapiens
ttgattaggctttgg

SEQ ID NO: 18990 - DNA, 15 bp, Homo sapiens
tttgattaggctttg

SEQ ID NO: 18991 - DNA, 15 bp, Homo sapiens
atttgattaggcttt

SEQ ID NO: 18992 - DNA, 15 bp, Homo sapiens
catttgattaggctt

SEQ ID NO: 18993 - DNA, 15 bp, Homo sapiens
acatttgattaggct

SEQ ID NO: 18994 - DNA, 15 bp, Homo sapiens
aacatttgattaggc

SEQ ID NO: 18995 - DNA, 15 bp, Homo sapiens
taacatttgattagg

SEQ ID NO: 18996 - DNA, 15 bp, Homo sapiens
ataacatttgattag

SEQ ID NO: 18997 - DNA, 15 bp, Homo sapiens
cataacatttgatta

SEQ ID NO: 18998 - DNA, 15 bp, Homo sapiens
acataacatttgatt

SEQ ID NO: 18999 - DNA, 15 bp, Homo sapiens
aacataacatttgat

SEQ ID NO: 19000 - DNA, 15 bp, Homo sapiens
aaacataacatttga

SEQ ID NO: 19001 - DNA, 15 bp, Homo sapiens
aaaacataacatttg

SEQ ID NO: 19002 - DNA, 15 bp, Homo sapiens
aaaaacataacattt

SEQ ID NO: 19003 - DNA, 15 bp, Homo sapiens
gaaaaacataacatt

SEQ ID NO: 19004 - DNA, 15 bp, Homo sapiens
tgaaaaacataacat

SEQ ID NO: 19005 - DNA, 15 bp, Homo sapiens
gtgaaaaacataaca

SEQ ID NO: 19006 - DNA, 15 bp, Homo sapiens
agtgaaaaacataac

SEQ ID NO: 19007 - DNA, 15 bp, Homo sapiens
cagtgaaaaacataa

SEQ ID NO: 19008 - DNA, 15 bp, Homo sapiens
gcagtgaaaaacata

SEQ ID NO: 19009 - DNA, 15 bp, Homo sapiens
ggcagtgaaaaacat

SEQ ID NO: 19010 - DNA, 15 bp, Homo sapiens
tggcagtgaaaaaca

SEQ ID NO: 19011 - DNA, 15 bp, Homo sapiens
ttggcagtgaaaaac

SEQ ID NO: 19012 - DNA, 15 bp, Homo sapiens
gttggcagtgaaaaa

SEQ ID NO: 19013 - DNA, 15 bp, Homo sapiens
ggttggcagtgaaaa

SEQ ID NO: 19014 - DNA, 15 bp, Homo sapiens
tggttggcagtgaaa

SEQ ID NO: 19015 - DNA, 15 bp, Homo sapiens
atggttggcagtgaa

SEQ ID NO: 19016 - DNA, 15 bp, Homo sapiens
gatggttggcagtga

SEQ ID NO: 19017 - DNA, 15 bp, Homo sapiens
tgatggttggcagtg

SEQ ID NO: 19018 - DNA, 15 bp, Homo sapiens
gtgatggttggcagt

SEQ ID NO: 19019 - DNA, 15 bp, Homo sapiens
agtgatggttggcag

SEQ ID NO: 19020 - DNA, 15 bp, Homo sapiens
cagtgatggttggca

SEQ ID NO: 19021 - DNA, 15 bp, Homo sapiens
ccagtgatggttggc

SEQ ID NO: 19022 - DNA, 15 bp, Homo sapiens
gccagtgatggttgg

SEQ ID NO: 19023 - DNA, 15 bp, Homo sapiens
agccagtgatggttg

SEQ ID NO: 19024 - DNA, 15 bp, Homo sapiens
tagccagtgatggtt

SEQ ID NO: 19025 - DNA, 15 bp, Homo sapiens
atagccagtgatggt

SEQ ID NO: 19026 - DNA, 15 bp, Homo sapiens
gatagccagtgatgg

SEQ ID NO: 19027 - DNA, 15 bp, Homo sapiens
tgatagccagtgatg

SEQ ID NO: 19028 - DNA, 15 bp, Homo sapiens
atgatagccagtgat

SEQ ID NO: 19029 - DNA, 15 bp, Homo sapiens
aatgatagccagtga

SEQ ID NO: 19030 - DNA, 15 bp, Homo sapiens
gaatgatagccagtg

SEQ ID NO: 19031 - DNA, 15 bp, Homo sapiens
agaatgatagccagt

SEQ ID NO: 19032 - DNA, 15 bp, Homo sapiens
tagaatgatagccag

SEQ ID NO: 19033 - DNA, 15 bp, Homo sapiens
ttagaatgatagcca

SEQ ID NO: 19034 - DNA, 15 bp, Homo sapiens
tttagaatgatagcc

SEQ ID NO: 19035 - DNA, 15 bp, Homo sapiens
ctttagaatgatagc

SEQ ID NO: 19036 - DNA, 15 bp, Homo sapiens
cctttagaatgatag

SEQ ID NO: 19037 - DNA, 15 bp, Homo sapiens
tcctttagaatgata

SEQ ID NO: 19038 - DNA, 15 bp, Homo sapiens
atcctttagaatgat

SEQ ID NO: 19039 - DNA, 15 bp, Homo sapiens
tatcctttagaatga

SEQ ID NO: 19040 - DNA, 15 bp, Homo sapiens
ttatcctttagaatg

SEQ ID NO: 19041 - DNA, 15 bp, Homo sapiens
attatcctttagaat

SEQ ID NO: 19042 - DNA, 15 bp, Homo sapiens
gattatcctttagaa

SEQ ID NO: 19043 - DNA, 15 bp, Homo sapiens
tgattatcctttaga

SEQ ID NO: 19044 - DNA, 15 bp, Homo sapiens
gtgattatcctttag

SEQ ID NO: 19045 - DNA, 15 bp, Homo sapiens
tgtgattatccttta

SEQ ID NO: 19046 - DNA, 15 bp, Homo sapiens
gtgtgattatccttt

SEQ ID NO: 19047 - DNA, 15 bp, Homo sapiens
agtgtgattatcctt

SEQ ID NO: 19048 - DNA, 15 bp, Homo sapiens
aagtgtgattatcct

SEQ ID NO: 19049 - DNA, 15 bp, Homo sapiens
aaagtgtgattatcc

SEQ ID NO: 19050 - DNA, 15 bp, Homo sapiens
aaaagtgtgattatc

SEQ ID NO: 19051 - DNA, 15 bp, Homo sapiens
gaaaagtgtgattat

SEQ ID NO: 19052 - DNA, 15 bp, Homo sapiens
tgaaaagtgtgatta

SEQ ID NO: 19053 - DNA, 15 bp, Homo sapiens
atgaaaagtgtgatt

SEQ ID NO: 19054 - DNA, 15 bp, Homo sapiens
catgaaaagtgtgat

SEQ ID NO: 19055 - DNA, 15 bp, Homo sapiens
ccatgaaaagtgtga

SEQ ID NO: 19056 - DNA, 15 bp, Homo sapiens
accatgaaaagtgtg

SEQ ID NO: 19057 - DNA, 15 bp, Homo sapiens
gaccatgaaaagtgt

SEQ ID NO: 19058 - DNA, 15 bp, Homo sapiens
tgaccatgaaaagtg

SEQ ID NO: 19059 - DNA, 15 bp, Homo sapiens
ctgaccatgaaaagt

SEQ ID NO: 19060 - DNA, 15 bp, Homo sapiens
actgaccatgaaaag

SEQ ID NO: 19061 - DNA, 15 bp, Homo sapiens
gactgaccatgaaaa

SEQ ID NO: 19062 - DNA, 15 bp, Homo sapiens
agactgaccatgaaa

SEQ ID NO: 19063 - DNA, 15 bp, Homo sapiens
aagactgaccatgaa

SEQ ID NO: 19064 - DNA, 15 bp, Homo sapiens
taagactgaccatga

SEQ ID NO: 19065 - DNA, 15 bp, Homo sapiens
ctaagactgaccatg

SEQ ID NO: 19066 - DNA, 15 bp, Homo sapiens
cctaagactgaccat

SEQ ID NO: 19067 - DNA, 15 bp, Homo sapiens
acctaagactgacca

SEQ ID NO: 19068 - DNA, 15 bp, Homo sapiens
cacctaagactgacc

SEQ ID NO: 19069 - DNA, 15 bp, Homo sapiens
acacctaagactgac

SEQ ID NO: 19070 - DNA, 15 bp, Homo sapiens
gacacctaagactga

SEQ ID NO: 19071 - DNA, 15 bp, Homo sapiens
tgacacctaagactg

SEQ ID NO: 19072 - DNA, 15 bp, Homo sapiens
ctgacacctaagact

SEQ ID NO: 19073 - DNA, 15 bp, Homo sapiens
tctgacacctaagac

SEQ ID NO: 19074 - DNA, 15 bp, Homo sapiens
ttctgacacctaaga

SEQ ID NO: 19075 - DNA, 15 bp, Homo sapiens
attctgacacctaag

SEQ ID NO: 19076 - DNA, 15 bp, Homo sapiens
tattctgacacctaa

SEQ ID NO: 19077 - DNA, 15 bp, Homo sapiens
atattctgacaccta

SEQ ID NO: 19078 - DNA, 15 bp, Homo sapiens
catattctgacacct

SEQ ID NO: 19079 - DNA, 15 bp, Homo sapiens
ccatattctgacacc

SEQ ID NO: 19080 - DNA, 15 bp, Homo sapiens
gccatattctgacac

SEQ ID NO: 19081 - DNA, 15 bp, Homo sapiens
tgccatattctgaca

SEQ ID NO: 19082 - DNA, 15 bp, Homo sapiens
ctgccatattctgac

SEQ ID NO: 19083 - DNA, 15 bp, Homo sapiens
actgccatattctga

SEQ ID NO: 19084 - DNA, 15 bp, Homo sapiens
tactgccatattctg

SEQ ID NO: 19085 - DNA, 15 bp, Homo sapiens
ttactgccatattct

SEQ ID NO: 19086 - DNA, 15 bp, Homo sapiens
gttactgccatattc

SEQ ID NO: 19087 - DNA, 15 bp, Homo sapiens
tgttactgccatatt

SEQ ID NO: 19088 - DNA, 15 bp, Homo sapiens
atgttactgccatat

SEQ ID NO: 19089 - DNA, 15 bp, Homo sapiens
tatgttactgccata

SEQ ID NO: 19090 - DNA, 15 bp, Homo sapiens
ttatgttactgccat

SEQ ID NO: 19091 - DNA, 15 bp, Homo sapiens
gttatgttactgcca

SEQ ID NO: 19092 - DNA, 15 bp, Homo sapiens
cgttatgttactgcc

SEQ ID NO: 19093 - DNA, 15 bp, Homo sapiens
acgttatgttactgc

SEQ ID NO: 19094 - DNA, 15 bp, Homo sapiens
cacgttatgttactg

SEQ ID NO: 19095 - DNA, 15 bp, Homo sapiens
acacgttatgttact

SEQ ID NO: 19096 - DNA, 15 bp, Homo sapiens
cacacgttatgttac

SEQ ID NO: 19097 - DNA, 15 bp, Homo sapiens
tcacacgttatgtta

SEQ ID NO: 19098 - DNA, 15 bp, Homo sapiens
gtcacacgttatgtt

SEQ ID NO: 19099 - DNA, 15 bp, Homo sapiens
agtcacacgttatgt

SEQ ID NO: 19100 - DNA, 15 bp, Homo sapiens
aagtcacacgttatg

SEQ ID NO: 19101 - DNA, 15 bp, Homo sapiens
taagtcacacgttat

SEQ ID NO: 19102 - DNA, 15 bp, Homo sapiens
ctaagtcacacgtta

SEQ ID NO: 19103 - DNA, 15 bp, Homo sapiens
tctaagtcacacgtt

SEQ ID NO: 19104 - DNA, 15 bp, Homo sapiens
atctaagtcacacgt

SEQ ID NO: 19105 - DNA, 15 bp, Homo sapiens
catctaagtcacacg

SEQ ID NO: 19106 - DNA, 15 bp, Homo sapiens
acatctaagtcacac

SEQ ID NO: 19107 - DNA, 15 bp, Homo sapiens
gacatctaagtcaca

SEQ ID NO: 19108 - DNA, 15 bp, Homo sapiens
agacatctaagtcac

SEQ ID NO: 19109 - DNA, 15 bp, Homo sapiens
aagacatctaagtca

SEQ ID NO: 19110 - DNA, 15 bp, Homo sapiens
aaagacatctaagtc

SEQ ID NO: 19111 - DNA, 15 bp, Homo sapiens
aaaagacatctaagt

SEQ ID NO: 19112 - DNA, 15 bp, Homo sapiens
taaaagacatctaag

SEQ ID NO: 19113 - DNA, 15 bp, Homo sapiens
ttaaaagacatctaa

SEQ ID NO: 19114 - DNA, 15 bp, Homo sapiens
attaaaagacatcta

SEQ ID NO: 19115 - DNA, 15 bp, Homo sapiens
aattaaaagacatct

SEQ ID NO: 19116 - DNA, 15 bp, Homo sapiens
caattaaaagacatc

SEQ ID NO: 19117 - DNA, 15 bp, Homo sapiens
ccaattaaaagacat

SEQ ID NO: 19118 - DNA, 15 bp, Homo sapiens
gccaattaaaagaca

SEQ ID NO: 19119 - DNA, 15 bp, Homo sapiens
tgccaattaaaagac

SEQ ID NO: 19120 - DNA, 15 bp, Homo sapiens
ttgccaattaaaaga

SEQ ID NO: 19121 - DNA, 15 bp, Homo sapiens
cttgccaattaaaag

SEQ ID NO: 19122 - DNA, 15 bp, Homo sapiens
acttgccaattaaaa

SEQ ID NO: 19123 - DNA, 15 bp, Homo sapiens
aacttgccaattaaa

SEQ ID NO: 19124 - DNA, 15 bp, Homo sapiens
aaacttgccaattaa

SEQ ID NO: 19125 - DNA, 15 bp, Homo sapiens
aaaacttgccaatta

SEQ ID NO: 19126 - DNA, 15 bp, Homo sapiens
caaaacttgccaatt

SEQ ID NO: 19127 - DNA, 15 bp, Homo sapiens
ccaaaacttgccaat

SEQ ID NO: 19128 - DNA, 15 bp, Homo sapiens
cccaaaacttgccaa

SEQ ID NO: 19129 - DNA, 15 bp, Homo sapiens
ccccaaaacttgcca

SEQ ID NO: 19130 - DNA, 15 bp, Homo sapiens
cccccaaaacttgcc

SEQ ID NO: 19131 - DNA, 15 bp, Homo sapiens
tcccccaaaacttgc

SEQ ID NO: 19132 - DNA, 15 bp, Homo sapiens
gtcccccaaaacttg

SEQ ID NO: 19133 - DNA, 15 bp, Homo sapiens
ggtcccccaaaactt

SEQ ID NO: 19134 - DNA, 15 bp, Homo sapiens
tggtcccccaaaact

SEQ ID NO: 19135 - DNA, 15 bp, Homo sapiens
ttggtcccccaaaac

SEQ ID NO: 19136 - DNA, 15 bp, Homo sapiens
tttggtcccccaaaa

SEQ ID NO: 19137 - DNA, 15 bp, Homo sapiens
ttttggtcccccaaa

SEQ ID NO: 19138 - DNA, 15 bp, Homo sapiens
tttttggtcccccaa

SEQ ID NO: 19139 - DNA, 15 bp, Homo sapiens
ttttttggtccccca

SEQ ID NO: 19140 - DNA, 15 bp, Homo sapiens
attttttggtccccc

SEQ ID NO: 19141 - DNA, 15 bp, Homo sapiens
tattttttggtcccc

SEQ ID NO: 19142 - DNA, 15 bp, Homo sapiens
ttattttttggtccc

SEQ ID NO: 19143 - DNA, 15 bp, Homo sapiens
attattttttggtcc

SEQ ID NO: 19144 - DNA, 15 bp, Homo sapiens
cattattttttggtc

SEQ ID NO: 19145 - DNA, 15 bp, Homo sapiens
tcattattttttggt

SEQ ID NO: 19146 - DNA, 15 bp, Homo sapiens
gtcattattttttgg

SEQ ID NO: 19147 - DNA, 15 bp, Homo sapiens
agtcattattttttg

SEQ ID NO: 19148 - DNA, 15 bp, Homo sapiens
tagtcattatttttt

SEQ ID NO: 19149 - DNA, 15 bp, Homo sapiens
ctagtcattattttt

SEQ ID NO: 19150 - DNA, 15 bp, Homo sapiens
gctagtcattatttt

SEQ ID NO: 19151 - DNA, 15 bp, Homo sapiens
agctagtcattattt

SEQ ID NO: 19152 - DNA, 15 bp, Homo sapiens
aagctagtcattatt

SEQ ID NO: 19153 - DNA, 15 bp, Homo sapiens
taagctagtcattat

SEQ ID NO: 19154 - DNA, 15 bp, Homo sapiens
ataagctagtcatta

SEQ ID NO: 19155 - DNA, 15 bp, Homo sapiens
tataagctagtcatt

SEQ ID NO: 19156 - DNA, 15 bp, Homo sapiens
gtataagctagtcat

SEQ ID NO: 19157 - DNA, 15 bp, Homo sapiens
tgtataagctagtca

SEQ ID NO: 19158 - DNA, 15 bp, Homo sapiens
atgtataagctagtc

SEQ ID NO: 19159 - DNA, 15 bp, Homo sapiens
gatgtataagctagt

SEQ ID NO: 19160 - DNA, 15 bp, Homo sapiens
agatgtataagctag

SEQ ID NO: 19161 - DNA, 15 bp, Homo sapiens
aagatgtataagcta

SEQ ID NO: 19162 - DNA, 15 bp, Homo sapiens
gaagatgtataagct

SEQ ID NO: 19163 - DNA, 15 bp, Homo sapiens
tgaagatgtataagc

SEQ ID NO: 19164 - DNA, 15 bp, Homo sapiens
ttgaagatgtataag

SEQ ID NO: 19165 - DNA, 15 bp, Homo sapiens
tttgaagatgtataa

SEQ ID NO: 19166 - DNA, 15 bp, Homo sapiens
gtttgaagatgtata

SEQ ID NO: 19167 - DNA, 15 bp, Homo sapiens
agtttgaagatgtat

SEQ ID NO: 19168 - DNA, 15 bp, Homo sapiens
gagtttgaagatgta

SEQ ID NO: 19169 - DNA, 15 bp, Homo sapiens
agagtttgaagatgt

SEQ ID NO: 19170 - DNA, 15 bp, Homo sapiens
aagagtttgaagatg

SEQ ID NO: 19171 - DNA, 15 bp, Homo sapiens
taagagtttgaagat

SEQ ID NO: 19172 - DNA, 15 bp, Homo sapiens
gtaagagtttgaaga

SEQ ID NO: 19173 - DNA, 15 bp, Homo sapiens
ggtaagagtttgaag

SEQ ID NO: 19174 - DNA, 15 bp, Homo sapiens
aggtaagagtttgaa

SEQ ID NO: 19175 - DNA, 15 bp, Homo sapiens
caggtaagagtttga

SEQ ID NO: 19176 - DNA, 15 bp, Homo sapiens
gcaggtaagagtttg

SEQ ID NO: 19177 - DNA, 15 bp, Homo sapiens
tgcaggtaagagttt

SEQ ID NO: 19178 - DNA, 15 bp, Homo sapiens
ttgcaggtaagagtt

SEQ ID NO: 19179 - DNA, 15 bp, Homo sapiens
tttgcaggtaagagt

SEQ ID NO: 19180 - DNA, 15 bp, Homo sapiens
gtttgcaggtaagag

SEQ ID NO: 19181 - DNA, 15 bp, Homo sapiens
tgtttgcaggtaaga

SEQ ID NO: 19182 - DNA, 15 bp, Homo sapiens
atgtttgcaggtaag

SEQ ID NO: 19183 - DNA, 15 bp, Homo sapiens
tatgtttgcaggtaa

SEQ ID NO: 19184 - DNA, 15 bp, Homo sapiens
ctatgtttgcaggta

SEQ ID NO: 19185 - DNA, 15 bp, Homo sapiens
actatgtttgcaggt

SEQ ID NO: 19186 - DNA, 15 bp, Homo sapiens
aactatgtttgcagg

SEQ ID NO: 19187 - DNA, 15 bp, Homo sapiens
caactatgtttgcag

SEQ ID NO: 19188 - DNA, 15 bp, Homo sapiens
tcaactatgtttgca

SEQ ID NO: 19189 - DNA, 15 bp, Homo sapiens
ttcaactatgtttgc

SEQ ID NO: 19190 - DNA, 15 bp, Homo sapiens
tttcaactatgtttg

SEQ ID NO: 19191 - DNA, 15 bp, Homo sapiens
ttttcaactatgttt

SEQ ID NO: 19192 - DNA, 15 bp, Homo sapiens
cttttcaactatgtt

SEQ ID NO: 19193 - DNA, 15 bp, Homo sapiens
acttttcaactatgt

SEQ ID NO: 19194 - DNA, 15 bp, Homo sapiens
tacttttcaactatg

SEQ ID NO: 19195 - DNA, 15 bp, Homo sapiens
ctacttttcaactat

SEQ ID NO: 19196 - DNA, 15 bp, Homo sapiens
tctacttttcaacta

SEQ ID NO: 19197 - DNA, 15 bp, Homo sapiens
atctacttttcaact

SEQ ID NO: 19198 - DNA, 15 bp, Homo sapiens
aatctacttttcaac

SEQ ID NO: 19199 - DNA, 15 bp, Homo sapiens
aaatctacttttcaa

SEQ ID NO: 19200 - DNA, 15 bp, Homo sapiens
caaatctacttttca

SEQ ID NO: 19201 - DNA, 15 bp, Homo sapiens
acaaatctacttttc

SEQ ID NO: 19202 - DNA, 15 bp, Homo sapiens
aacaaatctactttt

SEQ ID NO: 19203 - DNA, 15 bp, Homo sapiens
aaacaaatctacttt

SEQ ID NO: 19204 - DNA, 15 bp, Homo sapiens
caaacaaatctactt

SEQ ID NO: 19205 - DNA, 15 bp, Homo sapiens
ccaaacaaatctact

SEQ ID NO: 19206 - DNA, 15 bp, Homo sapiens
tccaaacaaatctac

SEQ ID NO: 19207 - DNA, 15 bp, Homo sapiens
ttccaaacaaatcta

SEQ ID NO: 19208 - DNA, 15 bp, Homo sapiens
tttccaaacaaatct

SEQ ID NO: 19209 - DNA, 15 bp, Homo sapiens
ttttccaaacaaatc

SEQ ID NO: 19210 - DNA, 15 bp, Homo sapiens
cttttccaaacaaat

SEQ ID NO: 19211 - DNA, 15 bp, Homo sapiens
gcttttccaaacaaa

SEQ ID NO: 19212 - DNA, 15 bp, Homo sapiens
ggcttttccaaacaa

SEQ ID NO: 19213 - DNA, 15 bp, Homo sapiens
aggcttttccaaaca

SEQ ID NO: 19214 - DNA, 15 bp, Homo sapiens
aaggcttttccaaac

SEQ ID NO: 19215 - DNA, 15 bp, Homo sapiens
taaggcttttccaaa

SEQ ID NO: 19216 - DNA, 15 bp, Homo sapiens
ctaaggcttttccaa

SEQ ID NO: 19217 - DNA, 15 bp, Homo sapiens
gctaaggcttttcca

SEQ ID NO: 19218 - DNA, 15 bp, Homo sapiens
ggctaaggcttttcc

SEQ ID NO: 19219 - DNA, 15 bp, Homo sapiens
tggctaaggcttttc

SEQ ID NO: 19220 - DNA, 15 bp, Homo sapiens
ttggctaaggctttt

SEQ ID NO: 19221 - DNA, 15 bp, Homo sapiens
attggctaaggcttt

SEQ ID NO: 19222 - DNA, 15 bp, Homo sapiens
tattggctaaggctt

SEQ ID NO: 19223 - DNA, 15 bp, Homo sapiens
ttattggctaaggct

SEQ ID NO: 19224 - DNA, 15 bp, Homo sapiens
tttattggctaaggc

SEQ ID NO: 19225 - DNA, 15 bp, Homo sapiens
ctttattggctaagg

SEQ ID NO: 19226 - DNA, 15 bp, Homo sapiens
cctttattggctaag

SEQ ID NO: 19227 - DNA, 15 bp, Homo sapiens
ccctttattggctaa

SEQ ID NO: 19228 - DNA, 15 bp, Homo sapiens
accctttattggcta

SEQ ID NO: 19229 - DNA, 15 bp, Homo sapiens
taccctttattggct

SEQ ID NO: 19230 - DNA, 15 bp, Homo sapiens
ataccctttattggc

SEQ ID NO: 19231 - DNA, 15 bp, Homo sapiens
aataccctttattgg

SEQ ID NO: 19232 - DNA, 15 bp, Homo sapiens
aaataccctttattg

SEQ ID NO: 19233 - DNA, 15 bp, Homo sapiens
aaaataccctttatt

SEQ ID NO: 19234 - DNA, 15 bp, Homo sapiens
gaaaataccctttat

SEQ ID NO: 19235 - DNA, 15 bp, Homo sapiens
tgaaaatacccttta

SEQ ID NO: 19236 - DNA, 15 bp, Homo sapiens
ttgaaaatacccttt

SEQ ID NO: 19237 - DNA, 15 bp, Homo sapiens
tttgaaaataccctt

SEQ ID NO: 19238 - DNA, 15 bp, Homo sapiens
ttttgaaaataccct

SEQ ID NO: 19239 - DNA, 15 bp, Homo sapiens
attttgaaaataccc

SEQ ID NO: 19240 - DNA, 15 bp, Homo sapiens
cattttgaaaatacc

SEQ ID NO: 19241 - DNA, 15 bp, Homo sapiens
tcattttgaaaatac

SEQ ID NO: 19242 - DNA, 15 bp, Homo sapiens
atcattttgaaaata

SEQ ID NO: 19243 - DNA, 15 bp, Homo sapiens
catcattttgaaaat

SEQ ID NO: 19244 - DNA, 15 bp, Homo sapiens
acatcattttgaaaa

SEQ ID NO: 19245 - DNA, 15 bp, Homo sapiens
tacatcattttgaaa

SEQ ID NO: 19246 - DNA, 15 bp, Homo sapiens
ctacatcattttgaa

SEQ ID NO: 19247 - DNA, 15 bp, Homo sapiens
tctacatcattttga

SEQ ID NO: 19248 - DNA, 15 bp, Homo sapiens
atctacatcattttg

SEQ ID NO: 19249 - DNA, 15 bp, Homo sapiens
catctacatcatttt

SEQ ID NO: 19250 - DNA, 15 bp, Homo sapiens
tcatctacatcattt

SEQ ID NO: 19251 - DNA, 15 bp, Homo sapiens
gtcatctacatcatt

SEQ ID NO: 19252 - DNA, 15 bp, Homo sapiens
tgtcatctacatcat

SEQ ID NO: 19253 - DNA, 15 bp, Homo sapiens
ctgtcatctacatca

SEQ ID NO: 19254 - DNA, 15 bp, Homo sapiens
gctgtcatctacatc

SEQ ID NO: 19255 - DNA, 15 bp, Homo sapiens
agctgtcatctacat

SEQ ID NO: 19256 - DNA, 15 bp, Homo sapiens
cagctgtcatctaca

SEQ ID NO: 19257 - DNA, 15 bp, Homo sapiens
gcagctgtcatctac

SEQ ID NO: 19258 - DNA, 15 bp, Homo sapiens
agcagctgtcatcta

SEQ ID NO: 19259 - DNA, 15 bp, Homo sapiens
tagcagctgtcatct

SEQ ID NO: 19260 - DNA, 15 bp, Homo sapiens
atagcagctgtcatc

SEQ ID NO: 19261 - DNA, 15 bp, Homo sapiens
aatagcagctgtcat

SEQ ID NO: 19262 - DNA, 15 bp, Homo sapiens
aaatagcagctgtca

SEQ ID NO: 19263 - DNA, 15 bp, Homo sapiens
caaatagcagctgtc

SEQ ID NO: 19264 - DNA, 15 bp, Homo sapiens
acaaatagcagctgt

SEQ ID NO: 19265 - DNA, 15 bp, Homo sapiens
tacaaatagcagctg

SEQ ID NO: 19266 - DNA, 15 bp, Homo sapiens
atacaaatagcagct

SEQ ID NO: 19267 - DNA, 15 bp, Homo sapiens
catacaaatagcagc

SEQ ID NO: 19268 - DNA, 15 bp, Homo sapiens
acatacaaatagcag

SEQ ID NO: 19269 - DNA, 15 bp, Homo sapiens
cacatacaaatagca

SEQ ID NO: 19270 - DNA, 15 bp, Homo sapiens
ccacatacaaatagc

SEQ ID NO: 19271 - DNA, 15 bp, Homo sapiens
accacatacaaatag

SEQ ID NO: 19272 - DNA, 15 bp, Homo sapiens
aaccacatacaaata

SEQ ID NO: 19273 - DNA, 15 bp, Homo sapiens
gaaccacatacaaat

SEQ ID NO: 19274 - DNA, 15 bp, Homo sapiens
tgaaccacatacaaa

SEQ ID NO: 19275 - DNA, 15 bp, Homo sapiens
gtgaaccacatacaa

SEQ ID NO: 19276 - DNA, 15 bp, Homo sapiens
tgtgaaccacataca

SEQ ID NO: 19277 - DNA, 15 bp, Homo sapiens
ttgtgaaccacatac

SEQ ID NO: 19278 - DNA, 15 bp, Homo sapiens
attgtgaaccacata

SEQ ID NO: 19279 - DNA, 15 bp, Homo sapiens
tattgtgaaccacat

SEQ ID NO: 19280 - DNA, 15 bp, Homo sapiens
ttattgtgaaccaca

SEQ ID NO: 19281 - DNA, 15 bp, Homo sapiens
tttattgtgaaccac

SEQ ID NO: 19282 - DNA, 15 bp, Homo sapiens
ttttattgtgaacca

SEQ ID NO: 19283 - DNA, 15 bp, Homo sapiens
tttttattgtgaacc

SEQ ID NO: 19284 - DNA, 15 bp, Homo sapiens
ctttttattgtgaac

SEQ ID NO: 19285 - DNA, 15 bp, Homo sapiens
cctttttattgtgaa

SEQ ID NO: 19286 - DNA, 15 bp, Homo sapiens
acctttttattgtga

SEQ ID NO: 19287 - DNA, 15 bp, Homo sapiens
cacctttttattgtg

SEQ ID NO: 19288 - DNA, 15 bp, Homo sapiens
gcacctttttattgt

SEQ ID NO: 19289 - DNA, 15 bp, Homo sapiens
cgcacctttttattg

SEQ ID NO: 19290 - DNA, 15 bp, Homo sapiens
acgcacctttttatt

SEQ ID NO: 19291 - DNA, 15 bp, Homo sapiens
cacgcacctttttat

SEQ ID NO: 19292 - DNA, 15 bp, Homo sapiens
acacgcaccttttta

SEQ ID NO: 19293 - DNA, 15 bp, Homo sapiens
aacacgcaccttttt

SEQ ID NO: 19294 - DNA, 15 bp, Homo sapiens
aaacacgcacctttt

SEQ ID NO: 19295 - DNA, 15 bp, Homo sapiens
taaacacgcaccttt

SEQ ID NO: 19296 - DNA, 15 bp, Homo sapiens
ctaaacacgcacctt

SEQ ID NO: 19297 - DNA, 15 bp, Homo sapiens
tctaaacacgcacct

SEQ ID NO: 19298 - DNA, 15 bp, Homo sapiens
ctctaaacacgcacc

SEQ ID NO: 19299 - DNA, 15 bp, Homo sapiens
tctctaaacacgcac

SEQ ID NO: 19300 - DNA, 15 bp, Homo sapiens
ctctctaaacacgca

SEQ ID NO: 19301 - DNA, 15 bp, Homo sapiens
tctctctaaacacgc

SEQ ID NO: 19302 - DNA, 15 bp, Homo sapiens
ctctctctaaacacg

SEQ ID NO: 19303 - DNA, 15 bp, Homo sapiens
tctctctctaaacac

SEQ ID NO: 19304 - DNA, 15 bp, Homo sapiens
ctctctctctaaaca

SEQ ID NO: 19305 - DNA, 15 bp, Homo sapiens
tctctctctctaaac

SEQ ID NO: 19306 - DNA, 15 bp, Homo sapiens
ctctctctctctaaa

SEQ ID NO: 19307 - DNA, 15 bp, Homo sapiens
tctctctctctctaa

SEQ ID NO: 19308 - DNA, 15 bp, Homo sapiens
ttctctctctctcta

SEQ ID NO: 19309 - DNA, 15 bp, Homo sapiens
tttctctctctctct

SEQ ID NO: 19310 - DNA, 15 bp, Homo sapiens
ctttctctctctctc

SEQ ID NO: 19311 - DNA, 15 bp, Homo sapiens
gctttctctctctct

SEQ ID NO: 19312 - DNA, 15 bp, Homo sapiens
tgctttctctctctc

SEQ ID NO: 19313 - DNA, 15 bp, Homo sapiens
ttgctttctctctct

SEQ ID NO: 19314 - DNA, 15 bp, Homo sapiens
tttgctttctctctc

SEQ ID NO: 19315 - DNA, 15 bp, Homo sapiens
gtttgctttctctct

SEQ ID NO: 19316 - DNA, 15 bp, Homo sapiens
tgtttgctttctctc

SEQ ID NO: 19317 - DNA, 15 bp, Homo sapiens
atgtttgctttctct

SEQ ID NO: 19318 - DNA, 15 bp, Homo sapiens
catgtttgctttctc

SEQ ID NO: 19319 - DNA, 15 bp, Homo sapiens
ccatgtttgctttct

SEQ ID NO: 19320 - DNA, 15 bp, Homo sapiens
gccatgtttgctttc

SEQ ID NO: 19321 - DNA, 15 bp, Homo sapiens
tgccatgtttgcttt

SEQ ID NO: 19322 - DNA, 15 bp, Homo sapiens
ttgccatgtttgctt

SEQ ID NO: 19323 - DNA, 15 bp, Homo sapiens
tttgccatgtttgct

SEQ ID NO: 19324 - DNA, 15 bp, Homo sapiens
gtttgccatgtttgc

SEQ ID NO: 19325 - DNA, 15 bp, Homo sapiens
ggtttgccatgtttg

SEQ ID NO: 19326 - DNA, 15 bp, Homo sapiens
tggtttgccatgttt

SEQ ID NO: 19327 - DNA, 15 bp, Homo sapiens
atggtttgccatgtt

SEQ ID NO: 19328 - DNA, 15 bp, Homo sapiens
aatggtttgccatgt

SEQ ID NO: 19329 - DNA, 15 bp, Homo sapiens
taatggtttgccatg

SEQ ID NO: 19330 - DNA, 15 bp, Homo sapiens
ttaatggtttgccat

SEQ ID NO: 19331 - DNA, 15 bp, Homo sapiens
attaatggtttgcca

SEQ ID NO: 19332 - DNA, 15 bp, Homo sapiens
tattaatggtttgcc

SEQ ID NO: 19333 - DNA, 15 bp, Homo sapiens
ttattaatggtttgc

SEQ ID NO: 19334 - DNA, 15 bp, Homo sapiens
attattaatggtttg

SEQ ID NO: 19335 - DNA, 15 bp, Homo sapiens
cattattaatggttt

SEQ ID NO: 19336 - DNA, 15 bp, Homo sapiens
ccattattaatggtt

SEQ ID NO: 19337 - DNA, 15 bp, Homo sapiens
accattattaatggt

SEQ ID NO: 19338 - DNA, 15 bp, Homo sapiens
caccattattaatgg

SEQ ID NO: 19339 - DNA, 15 bp, Homo sapiens
tcaccattattaatg

SEQ ID NO: 19340 - DNA, 15 bp, Homo sapiens
ctcaccattattaat

SEQ ID NO: 19341 - DNA, 15 bp, Homo sapiens
actcaccattattaa

SEQ ID NO: 19342 - DNA, 15 bp, Homo sapiens
gactcaccattatta

SEQ ID NO: 19343 - DNA, 15 bp, Homo sapiens
agactcaccattatt

SEQ ID NO: 19344 - DNA, 15 bp, Homo sapiens
tagactcaccattat

SEQ ID NO: 19345 - DNA, 15 bp, Homo sapiens
ctagactcaccatta

SEQ ID NO: 19346 - DNA, 15 bp, Homo sapiens
cctagactcaccatt

SEQ ID NO: 19347 - DNA, 15 bp, Homo sapiens
acctagactcaccat

SEQ ID NO: 19348 - DNA, 15 bp, Homo sapiens
cacctagactcacca

SEQ ID NO: 19349 - DNA, 15 bp, Homo sapiens
gcacctagactcacc

SEQ ID NO: 19350 - DNA, 15 bp, Homo sapiens
tgcacctagactcac

SEQ ID NO: 19351 - DNA, 15 bp, Homo sapiens
ttgcacctagactca

SEQ ID NO: 19352 - DNA, 15 bp, Homo sapiens
tttgcacctagactc

SEQ ID NO: 19353 - DNA, 15 bp, Homo sapiens
ctttgcacctagact

SEQ ID NO: 19354 - DNA, 15 bp, Homo sapiens
actttgcacctagac

SEQ ID NO: 19355 - DNA, 15 bp, Homo sapiens
tactttgcacctaga

SEQ ID NO: 19356 - DNA, 15 bp, Homo sapiens
atactttgcacctag

SEQ ID NO: 19357 - DNA, 15 bp, Homo sapiens
tatactttgcaccta

SEQ ID NO: 19358 - DNA, 15 bp, Homo sapiens
atatactttgcacct

SEQ ID NO: 19359 - DNA, 15 bp, Homo sapiens
catatactttgcacc

SEQ ID NO: 19360 - DNA, 15 bp, Homo sapiens
tcatatactttgcac

SEQ ID NO: 19361 - DNA, 15 bp, Homo sapiens
ttcatatactttgca

SEQ ID NO: 19362 - DNA, 15 bp, Homo sapiens
attcatatactttgc

SEQ ID NO: 19363 - DNA, 15 bp, Homo sapiens
cattcatatactttg

SEQ ID NO: 19364 - DNA, 15 bp, Homo sapiens
acattcatatacttt

SEQ ID NO: 19365 - DNA, 15 bp, Homo sapiens
aacattcatatactt

SEQ ID NO: 19366 - DNA, 15 bp, Homo sapiens
gaacattcatatact

SEQ ID NO: 19367 - DNA, 15 bp, Homo sapiens
tgaacattcatatac

SEQ ID NO: 19368 - DNA, 15 bp, Homo sapiens
atgaacattcatata

SEQ ID NO: 19369 - DNA, 15 bp, Homo sapiens
aatgaacattcatat

SEQ ID NO: 19370 - DNA, 15 bp, Homo sapiens
aaatgaacattcata

SEQ ID NO: 19371 - DNA, 15 bp, Homo sapiens
aaaatgaacattcat

SEQ ID NO: 19372 - DNA, 15 bp, Homo sapiens
taaaatgaacattca

SEQ ID NO: 19373 - DNA, 15 bp, Homo sapiens
gtaaaatgaacattc

SEQ ID NO: 19374 - DNA, 15 bp, Homo sapiens
agtaaaatgaacatt

SEQ ID NO: 19375 - DNA, 15 bp, Homo sapiens
tagtaaaatgaacat

SEQ ID NO: 19376 - DNA, 15 bp, Homo sapiens
atagtaaaatgaaca

SEQ ID NO: 19377 - DNA, 15 bp, Homo sapiens
aatagtaaaatgaac

SEQ ID NO: 19378 - DNA, 15 bp, Homo sapiens
aaatagtaaaatgaa

SEQ ID NO: 19379 - DNA, 15 bp, Homo sapiens
gaaatagtaaaatga

SEQ ID NO: 19380 - DNA, 15 bp, Homo sapiens
tgaaatagtaaaatg

SEQ ID NO: 19381 - DNA, 15 bp, Homo sapiens
gtgaaatagtaaaat

SEQ ID NO: 19382 - DNA, 15 bp, Homo sapiens
agtgaaatagtaaaa

SEQ ID NO: 19383 - DNA, 15 bp, Homo sapiens
aagtgaaatagtaaa

SEQ ID NO: 19384 - DNA, 15 bp, Homo sapiens
aaagtgaaatagtaa

SEQ ID NO: 19385 - DNA, 15 bp, Homo sapiens
aaaagtgaaatagta

SEQ ID NO: 19386 - DNA, 15 bp, Homo sapiens
aaaaagtgaaatagt

SEQ ID NO: 19387 - DNA, 15 bp, Homo sapiens
gaaaaagtgaaatag

SEQ ID NO: 19388 - DNA, 15 bp, Homo sapiens
agaaaaagtgaaata

SEQ ID NO: 19389 - DNA, 15 bp, Homo sapiens
tagaaaaagtgaaat

SEQ ID NO: 19390 - DNA, 15 bp, Homo sapiens
atagaaaaagtgaaa

SEQ ID NO: 19391 - DNA, 15 bp, Homo sapiens
aatagaaaaagtgaa

SEQ ID NO: 19392 - DNA, 15 bp, Homo sapiens
caatagaaaaagtga

SEQ ID NO: 19393 - DNA, 15 bp, Homo sapiens
tcaatagaaaaagtg

SEQ ID NO: 19394 - DNA, 15 bp, Homo sapiens
atcaatagaaaaagt

SEQ ID NO: 19395 - DNA, 15 bp, Homo sapiens
catcaatagaaaaag

SEQ ID NO: 19396 - DNA, 15 bp, Homo sapiens
acatcaatagaaaaa

SEQ ID NO: 19397 - DNA, 15 bp, Homo sapiens
cacatcaatagaaaa

SEQ ID NO: 19398 - DNA, 15 bp, Homo sapiens
tcacatcaatagaaa

SEQ ID NO: 19399 - DNA, 15 bp, Homo sapiens
ttcacatcaatagaa

SEQ ID NO: 19400 - DNA, 15 bp, Homo sapiens
tttcacatcaataga

SEQ ID NO: 19401 - DNA, 15 bp, Homo sapiens
ttttcacatcaatag

SEQ ID NO: 19402 - DNA, 15 bp, Homo sapiens
tttttcacatcaata

SEQ ID NO: 19403 - DNA, 15 bp, Homo sapiens
atttttcacatcaat

SEQ ID NO: 19404 - DNA, 15 bp, Homo sapiens
aatttttcacatcaa

SEQ ID NO: 19405 - DNA, 15 bp, Homo sapiens
gaatttttcacatca

SEQ ID NO: 19406 - DNA, 15 bp, Homo sapiens
agaatttttcacatc

SEQ ID NO: 19407 - DNA, 15 bp, Homo sapiens
aagaatttttcacat

SEQ ID NO: 19408 - DNA, 15 bp, Homo sapiens
aaagaatttttcaca

SEQ ID NO: 19409 - DNA, 15 bp, Homo sapiens
caaagaatttttcac

SEQ ID NO: 19410 - DNA, 15 bp, Homo sapiens
tcaaagaatttttca

SEQ ID NO: 19411 - DNA, 15 bp, Homo sapiens
ttcaaagaatttttc

SEQ ID NO: 19412 - DNA, 15 bp, Homo sapiens
attcaaagaattttt

SEQ ID NO: 19413 - DNA, 15 bp, Homo sapiens
tattcaaagaatttt

SEQ ID NO: 19414 - DNA, 15 bp, Homo sapiens
ctattcaaagaattt

SEQ ID NO: 19415 - DNA, 15 bp, Homo sapiens
actattcaaagaatt

SEQ ID NO: 19416 - DNA, 15 bp, Homo sapiens
cactattcaaagaat

SEQ ID NO: 19417 - DNA, 15 bp, Homo sapiens
tcactattcaaagaa

SEQ ID NO: 19418 - DNA, 15 bp, Homo sapiens
ctcactattcaaaga

SEQ ID NO: 19419 - DNA, 15 bp, Homo sapiens
cctcactattcaaag

SEQ ID NO: 19420 - DNA, 15 bp, Homo sapiens
tcctcactattcaaa

SEQ ID NO: 19421 - DNA, 15 bp, Homo sapiens
ttcctcactattcaa

SEQ ID NO: 19422 - DNA, 15 bp, Homo sapiens
tttcctcactattca

SEQ ID NO: 19423 - DNA, 15 bp, Homo sapiens
atttcctcactattc

SEQ ID NO: 19424 - DNA, 15 bp, Homo sapiens
catttcctcactatt

SEQ ID NO: 19425 - DNA, 15 bp, Homo sapiens
tcatttcctcactat

SEQ ID NO: 19426 - DNA, 15 bp, Homo sapiens
atcatttcctcacta

SEQ ID NO: 19427 - DNA, 15 bp, Homo sapiens
aatcatttcctcact

SEQ ID NO: 19428 - DNA, 15 bp, Homo sapiens
aaatcatttcctcac

SEQ ID NO: 19429 - DNA, 15 bp, Homo sapiens
aaaatcatttcctca

SEQ ID NO: 19430 - DNA, 15 bp, Homo sapiens
taaaatcatttcctc

SEQ ID NO: 19431 - DNA, 15 bp, Homo sapiens
ttaaaatcatttcct

SEQ ID NO: 19432 - DNA, 15 bp, Homo sapiens
cttaaaatcatttcc

SEQ ID NO: 19433 - DNA, 15 bp, Homo sapiens
acttaaaatcatttc

SEQ ID NO: 19434 - DNA, 15 bp, Homo sapiens
aacttaaaatcattt

SEQ ID NO: 19435 - DNA, 15 bp, Homo sapiens
caacttaaaatcatt

SEQ ID NO: 19436 - DNA, 15 bp, Homo sapiens
ccaacttaaaatcat

SEQ ID NO: 19437 - DNA, 15 bp, Homo sapiens
cccaacttaaaatca

SEQ ID NO: 19438 - DNA, 15 bp, Homo sapiens
ccccaacttaaaatc

SEQ ID NO: 19439 - DNA, 15 bp, Homo sapiens
tccccaacttaaaat

SEQ ID NO: 19440 - DNA, 15 bp, Homo sapiens
gtccccaacttaaaa

SEQ ID NO: 19441 - DNA, 15 bp, Homo sapiens
tgtccccaacttaaa

SEQ ID NO: 19442 - DNA, 15 bp, Homo sapiens
atgtccccaacttaa

SEQ ID NO: 19443 - DNA, 15 bp, Homo sapiens
aatgtccccaactta

SEQ ID NO: 19444 - DNA, 15 bp, Homo sapiens
aaatgtccccaactt

SEQ ID NO: 19445 - DNA, 15 bp, Homo sapiens
caaatgtccccaact

SEQ ID NO: 19446 - DNA, 15 bp, Homo sapiens
acaaatgtccccaac

SEQ ID NO: 19447 - DNA, 15 bp, Homo sapiens
cacaaatgtccccaa

SEQ ID NO: 19448 - DNA, 15 bp, Homo sapiens
ccacaaatgtcccca

SEQ ID NO: 19449 - DNA, 15 bp, Homo sapiens
cccacaaatgtcccc

SEQ ID NO: 19450 - DNA, 15 bp, Homo sapiens
acccacaaatgtccc

SEQ ID NO: 19451 - DNA, 15 bp, Homo sapiens
aacccacaaatgtcc

SEQ ID NO: 19452 - DNA, 15 bp, Homo sapiens
aaacccacaaatgtc

SEQ ID NO: 19453 - DNA, 15 bp, Homo sapiens
caaacccacaaatgt

SEQ ID NO: 19454 - DNA, 15 bp, Homo sapiens
acaaacccacaaatg

SEQ ID NO: 19455 - DNA, 15 bp, Homo sapiens
tacaaacccacaaat

SEQ ID NO: 19456 - DNA, 15 bp, Homo sapiens
atacaaacccacaaa

SEQ ID NO: 19457 - DNA, 15 bp, Homo sapiens
catacaaacccacaa

SEQ ID NO: 19458 - DNA, 15 bp, Homo sapiens
tcatacaaacccaca

SEQ ID NO: 19459 - DNA, 15 bp, Homo sapiens
ctcatacaaacccac

SEQ ID NO: 19460 - DNA, 15 bp, Homo sapiens
tctcatacaaaccca

SEQ ID NO: 19461 - DNA, 15 bp, Homo sapiens
ttctcatacaaaccc

SEQ ID NO: 19462 - DNA, 15 bp, Homo sapiens
gttctcatacaaacc

SEQ ID NO: 19463 - DNA, 15 bp, Homo sapiens
ggttctcatacaaac

SEQ ID NO: 19464 - DNA, 15 bp, Homo sapiens
aggttctcatacaaa

SEQ ID NO: 19465 - DNA, 15 bp, Homo sapiens
caggttctcatacaa

SEQ ID NO: 19466 - DNA, 15 bp, Homo sapiens
tcaggttctcataca

SEQ ID NO: 19467 - DNA, 15 bp, Homo sapiens
gtcaggttctcatac

SEQ ID NO: 19468 - DNA, 15 bp, Homo sapiens
agtcaggttctcata

SEQ ID NO: 19469 - DNA, 15 bp, Homo sapiens
tagtcaggttctcat

SEQ ID NO: 19470 - DNA, 15 bp, Homo sapiens
gtagtcaggttctca

SEQ ID NO: 19471 - DNA, 15 bp, Homo sapiens
agtagtcaggttctc

SEQ ID NO: 19472 - DNA, 15 bp, Homo sapiens
tagtagtcaggttct

SEQ ID NO: 19473 - DNA, 15 bp, Homo sapiens
gtagtagtcaggttc

SEQ ID NO: 19474 - DNA, 15 bp, Homo sapiens
ggtagtagtcaggtt

SEQ ID NO: 19475 - DNA, 15 bp, Homo sapiens
gggtagtagtcaggt

SEQ ID NO: 19476 - DNA, 15 bp, Homo sapiens
tgggtagtagtcagg

SEQ ID NO: 19477 - DNA, 15 bp, Homo sapiens
atgggtagtagtcag

SEQ ID NO: 19478 - DNA, 15 bp, Homo sapiens
tatgggtagtagtca

SEQ ID NO: 19479 - DNA, 15 bp, Homo sapiens
ctatgggtagtagtc

SEQ ID NO: 19480 - DNA, 15 bp, Homo sapiens
actatgggtagtagt

SEQ ID NO: 19481 - DNA, 15 bp, Homo sapiens
tactatgggtagtag

SEQ ID NO: 19482 - DNA, 15 bp, Homo sapiens
ttactatgggtagta

SEQ ID NO: 19483 - DNA, 15 bp, Homo sapiens
cttactatgggtagt

SEQ ID NO: 19484 - DNA, 15 bp, Homo sapiens
acttactatgggtag

SEQ ID NO: 19485 - DNA, 15 bp, Homo sapiens
tacttactatgggta

SEQ ID NO: 19486 - DNA, 15 bp, Homo sapiens
ttacttactatgggt

SEQ ID NO: 19487 - DNA, 15 bp, Homo sapiens
tttacttactatggg

SEQ ID NO: 19488 - DNA, 15 bp, Homo sapiens
atttacttactatgg

SEQ ID NO: 19489 - DNA, 15 bp, Homo sapiens
tatttacttactatg

SEQ ID NO: 19490 - DNA, 15 bp, Homo sapiens
ctatttacttactat

SEQ ID NO: 19491 - DNA, 15 bp, Homo sapiens
tctatttacttacta

SEQ ID NO: 19492 - DNA, 15 bp, Homo sapiens
ctctatttacttact

SEQ ID NO: 19493 - DNA, 15 bp, Homo sapiens
cctctatttacttac

SEQ ID NO: 19494 - DNA, 15 bp, Homo sapiens
acctctatttactta

SEQ ID NO: 19495 - DNA, 15 bp, Homo sapiens
tacctctatttactt

SEQ ID NO: 19496 - DNA, 15 bp, Homo sapiens
gtacctctatttact

SEQ ID NO: 19497 - DNA, 15 bp, Homo sapiens
ggtacctctatttac

SEQ ID NO: 19498 - DNA, 15 bp, Homo sapiens
gggtacctctattta

SEQ ID NO: 19499 - DNA, 15 bp, Homo sapiens
agggtacctctattt

SEQ ID NO: 19500 - DNA, 15 bp, Homo sapiens
cagggtacctctatt

SEQ ID NO: 19501 - DNA, 15 bp, Homo sapiens
tcagggtacctctat

SEQ ID NO: 19502 - DNA, 15 bp, Homo sapiens
ttcagggtacctcta

SEQ ID NO: 19503 - DNA, 15 bp, Homo sapiens
tttcagggtacctct

SEQ ID NO: 19504 - DNA, 15 bp, Homo sapiens
ttttcagggtacctc

SEQ ID NO: 19505 - DNA, 15 bp, Homo sapiens
attttcagggtacct

SEQ ID NO: 19506 - DNA, 15 bp, Homo sapiens
tattttcagggtacc

SEQ ID NO: 19507 - DNA, 15 bp, Homo sapiens
ctattttcagggtac

SEQ ID NO: 19508 - DNA, 15 bp, Homo sapiens
actattttcagggta

SEQ ID NO: 19509 - DNA, 15 bp, Homo sapiens
cactattttcagggt

SEQ ID NO: 19510 - DNA, 15 bp, Homo sapiens
tcactattttcaggg

SEQ ID NO: 19511 - DNA, 15 bp, Homo sapiens
ttcactattttcagg

SEQ ID NO: 19512 - DNA, 15 bp, Homo sapiens
cttcactattttcag

SEQ ID NO: 19513 - DNA, 15 bp, Homo sapiens
gcttcactattttca

SEQ ID NO: 19514 - DNA, 15 bp, Homo sapiens
ggcttcactattttc

SEQ ID NO: 19515 - DNA, 15 bp, Homo sapiens
tggcttcactatttt

SEQ ID NO: 19516 - DNA, 15 bp, Homo sapiens
atggcttcactattt

SEQ ID NO: 19517 - DNA, 15 bp, Homo sapiens
catggcttcactatt

SEQ ID NO: 19518 - DNA, 15 bp, Homo sapiens
acatggcttcactat

SEQ ID NO: 19519 - DNA, 15 bp, Homo sapiens
gacatggcttcacta

SEQ ID NO: 19520 - DNA, 15 bp, Homo sapiens
ggacatggcttcact

SEQ ID NO: 19521 - DNA, 15 bp, Homo sapiens
aggacatggcttcac

SEQ ID NO: 19522 - DNA, 15 bp, Homo sapiens
aaggacatggcttca

SEQ ID NO: 19523 - DNA, 15 bp, Homo sapiens
gaaggacatggcttc

SEQ ID NO: 19524 - DNA, 15 bp, Homo sapiens
agaaggacatggctt

SEQ ID NO: 19525 - DNA, 15 bp, Homo sapiens
gagaaggacatggct

SEQ ID NO: 19526 - DNA, 15 bp, Homo sapiens
agagaaggacatggc

SEQ ID NO: 19527 - DNA, 15 bp, Homo sapiens
aagagaaggacatgg

SEQ ID NO: 19528 - DNA, 15 bp, Homo sapiens
taagagaaggacatg

SEQ ID NO: 19529 - DNA, 15 bp, Homo sapiens
ataagagaaggacat

SEQ ID NO: 19530 - DNA, 15 bp, Homo sapiens
tataagagaaggaca

SEQ ID NO: 19531 - DNA, 15 bp, Homo sapiens
ttataagagaaggac

SEQ ID NO: 19532 - DNA, 15 bp, Homo sapiens
gttataagagaagga

SEQ ID NO: 19533 - DNA, 15 bp, Homo sapiens
tgttataagagaagg

SEQ ID NO: 19534 - DNA, 15 bp, Homo sapiens
gtgttataagagaag

SEQ ID NO: 19535 - DNA, 15 bp, Homo sapiens
agtgttataagagaa

SEQ ID NO: 19536 - DNA, 15 bp, Homo sapiens
tagtgttataagaga

SEQ ID NO: 19537 - DNA, 15 bp, Homo sapiens
ctagtgttataagag

SEQ ID NO: 19538 - DNA, 15 bp, Homo sapiens
cctagtgttataaga

SEQ ID NO: 19539 - DNA, 15 bp, Homo sapiens
tcctagtgttataag

SEQ ID NO: 19540 - DNA, 15 bp, Homo sapiens
ttcctagtgttataa

SEQ ID NO: 19541 - DNA, 15 bp, Homo sapiens
attcctagtgttata

SEQ ID NO: 19542 - DNA, 15 bp, Homo sapiens
aattcctagtgttat

SEQ ID NO: 19543 - DNA, 15 bp, Homo sapiens
taattcctagtgtta

SEQ ID NO: 19544 - DNA, 15 bp, Homo sapiens
ttaattcctagtgtt

SEQ ID NO: 19545 - DNA, 15 bp, Homo sapiens
tttaattcctagtgt

SEQ ID NO: 19546 - DNA, 15 bp, Homo sapiens
ctttaattcctagtg

SEQ ID NO: 19547 - DNA, 15 bp, Homo sapiens
actttaattcctagt

SEQ ID NO: 19548 - DNA, 15 bp, Homo sapiens
cactttaattcctag

SEQ ID NO: 19549 - DNA, 15 bp, Homo sapiens
ccactttaattccta

SEQ ID NO: 19550 - DNA, 15 bp, Homo sapiens
gccactttaattcct

SEQ ID NO: 19551 - DNA, 15 bp, Homo sapiens
tgccactttaattcc

SEQ ID NO: 19552 - DNA, 15 bp, Homo sapiens
atgccactttaattc

SEQ ID NO: 19553 - DNA, 15 bp, Homo sapiens
catgccactttaatt

SEQ ID NO: 19554 - DNA, 15 bp, Homo sapiens
ccatgccactttaat

SEQ ID NO: 19555 - DNA, 15 bp, Homo sapiens
cccatgccactttaa

SEQ ID NO: 19556 - DNA, 15 bp, Homo sapiens
tcccatgccacttta

SEQ ID NO: 19557 - DNA, 15 bp, Homo sapiens
ctcccatgccacttt

SEQ ID NO: 19558 - DNA, 15 bp, Homo sapiens
tctcccatgccactt

SEQ ID NO: 19559 - DNA, 15 bp, Homo sapiens
ctctcccatgccact

SEQ ID NO: 19560 - DNA, 15 bp, Homo sapiens
tctctcccatgccac

SEQ ID NO: 19561 - DNA, 15 bp, Homo sapiens
gtctctcccatgcca

SEQ ID NO: 19562 - DNA, 15 bp, Homo sapiens
agtctctcccatgcc

SEQ ID NO: 19563 - DNA, 15 bp, Homo sapiens
cagtctctcccatgc

SEQ ID NO: 19564 - DNA, 15 bp, Homo sapiens
gcagtctctcccatg

SEQ ID NO: 19565 - DNA, 15 bp, Homo sapiens
agcagtctctcccat

SEQ ID NO: 19566 - DNA, 15 bp, Homo sapiens
gagcagtctctccca

SEQ ID NO: 19567 - DNA, 15 bp, Homo sapiens
tgagcagtctctccc

SEQ ID NO: 19568 - DNA, 15 bp, Homo sapiens
gtgagcagtctctcc

SEQ ID NO: 19569 - DNA, 15 bp, Homo sapiens
tgtgagcagtctctc

SEQ ID NO: 19570 - DNA, 15 bp, Homo sapiens
atgtgagcagtctct

SEQ ID NO: 19571 - DNA, 15 bp, Homo sapiens
aatgtgagcagtctc

SEQ ID NO: 19572 - DNA, 15 bp, Homo sapiens
aaatgtgagcagtct

SEQ ID NO: 19573 - DNA, 15 bp, Homo sapiens
caaatgtgagcagtc

SEQ ID NO: 19574 - DNA, 15 bp, Homo sapiens
tcaaatgtgagcagt

SEQ ID NO: 19575 - DNA, 15 bp, Homo sapiens
atcaaatgtgagcag

SEQ ID NO: 19576 - DNA, 15 bp, Homo sapiens
aatcaaatgtgagca

SEQ ID NO: 19577 - DNA, 15 bp, Homo sapiens
aaatcaaatgtgagc

SEQ ID NO: 19578 - DNA, 15 bp, Homo sapiens
gaaatcaaatgtgag

SEQ ID NO: 19579 - DNA, 15 bp, Homo sapiens
agaaatcaaatgtga

SEQ ID NO: 19580 - DNA, 15 bp, Homo sapiens
aagaaatcaaatgtg

SEQ ID NO: 19581 - DNA, 15 bp, Homo sapiens
aaagaaatcaaatgt

SEQ ID NO: 19582 - DNA, 15 bp, Homo sapiens
caaagaaatcaaatg

SEQ ID NO: 19583 - DNA, 15 bp, Homo sapiens
ccaaagaaatcaaat

SEQ ID NO: 19584 - DNA, 15 bp, Homo sapiens
accaaagaaatcaaa

SEQ ID NO: 19585 - DNA, 15 bp, Homo sapiens
aaccaaagaaatcaa

SEQ ID NO: 19586 - DNA, 15 bp, Homo sapiens
aaaccaaagaaatca

SEQ ID NO: 19587 - DNA, 15 bp, Homo sapiens
aaaaccaaagaaatc

SEQ ID NO: 19588 - DNA, 15 bp, Homo sapiens
aaaaaccaaagaaat

SEQ ID NO: 19589 - DNA, 15 bp, Homo sapiens
caaaaaccaaagaaa

SEQ ID NO: 19590 - DNA, 15 bp, Homo sapiens
ccaaaaaccaaagaa

SEQ ID NO: 19591 - DNA, 15 bp, Homo sapiens
tccaaaaaccaaaga

SEQ ID NO: 19592 - DNA, 15 bp, Homo sapiens
gtccaaaaaccaaag

SEQ ID NO: 19593 - DNA, 15 bp, Homo sapiens
ggtccaaaaaccaaa

SEQ ID NO: 19594 - DNA, 15 bp, Homo sapiens
gggtccaaaaaccaa

SEQ ID NO: 19595 - DNA, 15 bp, Homo sapiens
agggtccaaaaacca

SEQ ID NO: 19596 - DNA, 15 bp, Homo sapiens
cagggtccaaaaacc

SEQ ID NO: 19597 - DNA, 15 bp, Homo sapiens
acagggtccaaaaac

SEQ ID NO: 19598 - DNA, 15 bp, Homo sapiens
gacagggtccaaaaa

SEQ ID NO: 19599 - DNA, 15 bp, Homo sapiens
tgacagggtccaaaa

SEQ ID NO: 19600 - DNA, 15 bp, Homo sapiens
gtgacagggtccaaa

SEQ ID NO: 19601 - DNA, 15 bp, Homo sapiens
tgtgacagggtccaa

SEQ ID NO: 19602 - DNA, 15 bp, Homo sapiens
atgtgacagggtcca

SEQ ID NO: 19603 - DNA, 15 bp, Homo sapiens
catgtgacagggtcc

SEQ ID NO: 19604 - DNA, 15 bp, Homo sapiens
tcatgtgacagggtc

SEQ ID NO: 19605 - DNA, 15 bp, Homo sapiens
ctcatgtgacagggt

SEQ ID NO: 19606 - DNA, 15 bp, Homo sapiens
actcatgtgacaggg

SEQ ID NO: 19607 - DNA, 15 bp, Homo sapiens
tactcatgtgacagg

SEQ ID NO: 19608 - DNA, 15 bp, Homo sapiens
ctactcatgtgacag

SEQ ID NO: 19609 - DNA, 15 bp, Homo sapiens
cctactcatgtgaca

SEQ ID NO: 19610 - DNA, 15 bp, Homo sapiens
ccctactcatgtgac

SEQ ID NO: 19611 - DNA, 15 bp, Homo sapiens
cccctactcatgtga

SEQ ID NO: 19612 - DNA, 15 bp, Homo sapiens
acccctactcatgtg

SEQ ID NO: 19613 - DNA, 15 bp, Homo sapiens
aacccctactcatgt

SEQ ID NO: 19614 - DNA, 15 bp, Homo sapiens
caacccctactcatg

SEQ ID NO: 19615 - DNA, 15 bp, Homo sapiens
acaacccctactcat

SEQ ID NO: 19616 - DNA, 15 bp, Homo sapiens
gacaacccctactca

SEQ ID NO: 19617 - DNA, 15 bp, Homo sapiens
tgacaacccctactc

SEQ ID NO: 19618 - DNA, 15 bp, Homo sapiens
ttgacaacccctact

SEQ ID NO: 19619 - DNA, 15 bp, Homo sapiens
cttgacaacccctac

SEQ ID NO: 19620 - DNA, 15 bp, Homo sapiens
tcttgacaaccccta

SEQ ID NO: 19621 - DNA, 15 bp, Homo sapiens
atcttgacaacccct

SEQ ID NO: 19622 - DNA, 15 bp, Homo sapiens
tatcttgacaacccc

SEQ ID NO: 19623 - DNA, 15 bp, Homo sapiens
ctatcttgacaaccc

SEQ ID NO: 19624 - DNA, 15 bp, Homo sapiens
gctatcttgacaacc

SEQ ID NO: 19625 - DNA, 15 bp, Homo sapiens
ggctatcttgacaac

SEQ ID NO: 19626 - DNA, 15 bp, Homo sapiens
gggctatcttgacaa

SEQ ID NO: 19627 - DNA, 15 bp, Homo sapiens
tgggctatcttgaca

SEQ ID NO: 19628 - DNA, 15 bp, Homo sapiens
atgggctatcttgac

SEQ ID NO: 19629 - DNA, 15 bp, Homo sapiens
catgggctatcttga

SEQ ID NO: 19630 - DNA, 15 bp, Homo sapiens
ccatgggctatcttg

SEQ ID NO: 19631 - DNA, 15 bp, Homo sapiens
cccatgggctatctt

SEQ ID NO: 19632 - DNA, 15 bp, Homo sapiens
ccccatgggctatct

SEQ ID NO: 19633 - DNA, 15 bp, Homo sapiens
gccccatgggctatc

SEQ ID NO: 19634 - DNA, 15 bp, Homo sapiens
agccccatgggctat

SEQ ID NO: 19635 - DNA, 15 bp, Homo sapiens
tagccccatgggcta

SEQ ID NO: 19636 - DNA, 15 bp, Homo sapiens
ctagccccatgggct

SEQ ID NO: 19637 - DNA, 15 bp, Homo sapiens
actagccccatgggc

SEQ ID NO: 19638 - DNA, 15 bp, Homo sapiens
aactagccccatggg

SEQ ID NO: 19639 - DNA, 15 bp, Homo sapiens
caactagccccatgg

SEQ ID NO: 19640 - DNA, 15 bp, Homo sapiens
gcaactagccccatg

SEQ ID NO: 19641 - DNA, 15 bp, Homo sapiens
ggcaactagccccat

SEQ ID NO: 19642 - DNA, 15 bp, Homo sapiens
cggcaactagcccca

SEQ ID NO: 19643 - DNA, 15 bp, Homo sapiens
acggcaactagcccc

SEQ ID NO: 19644 - DNA, 15 bp, Homo sapiens
aacggcaactagccc

SEQ ID NO: 19645 - DNA, 15 bp, Homo sapiens
aaacggcaactagcc

SEQ ID NO: 19646 - DNA, 15 bp, Homo sapiens
gaaacggcaactagc

SEQ ID NO: 19647 - DNA, 15 bp, Homo sapiens
agaaacggcaactag

SEQ ID NO: 19648 - DNA, 15 bp, Homo sapiens
tagaaacggcaacta

SEQ ID NO: 19649 - DNA, 15 bp, Homo sapiens
atagaaacggcaact

SEQ ID NO: 19650 - DNA, 15 bp, Homo sapiens
aatagaaacggcaac

SEQ ID NO: 19651 - DNA, 15 bp, Homo sapiens
taatagaaacggcaa

SEQ ID NO: 19652 - DNA, 15 bp, Homo sapiens
gtaatagaaacggca

SEQ ID NO: 19653 - DNA, 15 bp, Homo sapiens
tgtaatagaaacggc

SEQ ID NO: 19654 - DNA, 15 bp, Homo sapiens
ctgtaatagaaacgg

SEQ ID NO: 19655 - DNA, 15 bp, Homo sapiens
actgtaatagaaacg

SEQ ID NO: 19656 - DNA, 15 bp, Homo sapiens
cactgtaatagaaac

SEQ ID NO: 19657 - DNA, 15 bp, Homo sapiens
tcactgtaatagaaa

SEQ ID NO: 19658 - DNA, 15 bp, Homo sapiens
ctcactgtaatagaa

SEQ ID NO: 19659 - DNA, 15 bp, Homo sapiens
tctcactgtaataga

SEQ ID NO: 19660 - DNA, 15 bp, Homo sapiens
ttctcactgtaatag

SEQ ID NO: 19661 - DNA, 15 bp, Homo sapiens
tttctcactgtaata

SEQ ID NO: 19662 - DNA, 15 bp, Homo sapiens
ttttctcactgtaat

SEQ ID NO: 19663 - DNA, 15 bp, Homo sapiens
cttttctcactgtaa

SEQ ID NO: 19664 - DNA, 15 bp, Homo sapiens
acttttctcactgta

SEQ ID NO: 19665 - DNA, 15 bp, Homo sapiens
tacttttctcactgt

SEQ ID NO: 19666 - DNA, 15 bp, Homo sapiens
ctacttttctcactg

SEQ ID NO: 19667 - DNA, 15 bp, Homo sapiens
cctacttttctcact

SEQ ID NO: 19668 - DNA, 15 bp, Homo sapiens
ccctacttttctcac

SEQ ID NO: 19669 - DNA, 15 bp, Homo sapiens
cccctacttttctca

SEQ ID NO: 19670 - DNA, 15 bp, Homo sapiens
gcccctacttttctc

SEQ ID NO: 19671 - DNA, 15 bp, Homo sapiens
ggcccctacttttct

SEQ ID NO: 19672 - DNA, 15 bp, Homo sapiens
aggcccctacttttc

SEQ ID NO: 19673 - DNA, 15 bp, Homo sapiens
aaggcccctactttt

SEQ ID NO: 19674 - DNA, 15 bp, Homo sapiens
caaggcccctacttt

SEQ ID NO: 19675 - DNA, 15 bp, Homo sapiens
tcaaggcccctactt

SEQ ID NO: 19676 - DNA, 15 bp, Homo sapiens
ctcaaggcccctact

SEQ ID NO: 19677 - DNA, 15 bp, Homo sapiens
actcaaggcccctac

SEQ ID NO: 19678 - DNA, 15 bp, Homo sapiens
aactcaaggccccta

SEQ ID NO: 19679 - DNA, 15 bp, Homo sapiens
caactcaaggcccct

SEQ ID NO: 19680 - DNA, 15 bp, Homo sapiens
acaactcaaggcccc

SEQ ID NO: 19681 - DNA, 15 bp, Homo sapiens
aacaactcaaggccc

SEQ ID NO: 19682 - DNA, 15 bp, Homo sapiens
caacaactcaaggcc

SEQ ID NO: 19683 - DNA, 15 bp, Homo sapiens
ccaacaactcaaggc

SEQ ID NO: 19684 - DNA, 15 bp, Homo sapiens
tccaacaactcaagg

SEQ ID NO: 19685 - DNA, 15 bp, Homo sapiens
ctccaacaactcaag

SEQ ID NO: 19686 - DNA, 15 bp, Homo sapiens
gctccaacaactcaa

SEQ ID NO: 19687 - DNA, 15 bp, Homo sapiens
ggctccaacaactca

SEQ ID NO: 19688 - DNA, 15 bp, Homo sapiens
tggctccaacaactc

SEQ ID NO: 19689 - DNA, 15 bp, Homo sapiens
ctggctccaacaact

SEQ ID NO: 19690 - DNA, 15 bp, Homo sapiens
tctggctccaacaac

SEQ ID NO: 19691 - DNA, 15 bp, Homo sapiens
ttctggctccaacaa

SEQ ID NO: 19692 - DNA, 15 bp, Homo sapiens
cttctggctccaaca

SEQ ID NO: 19693 - DNA, 15 bp, Homo sapiens
acttctggctccaac

SEQ ID NO: 19694 - DNA, 15 bp, Homo sapiens
cacttctggctccaa

SEQ ID NO: 19695 - DNA, 15 bp, Homo sapiens
ccacttctggctcca

SEQ ID NO: 19696 - DNA, 15 bp, Homo sapiens
tccacttctggctcc

SEQ ID NO: 19697 - DNA, 15 bp, Homo sapiens
ctccacttctggctc

SEQ ID NO: 19698 - DNA, 15 bp, Homo sapiens
tctccacttctggct

SEQ ID NO: 19699 - DNA, 15 bp, Homo sapiens
ttctccacttctggc

SEQ ID NO: 19700 - DNA, 15 bp, Homo sapiens
attctccacttctgg

SEQ ID NO: 19701 - DNA, 15 bp, Homo sapiens
cattctccacttctg

SEQ ID NO: 19702 - DNA, 15 bp, Homo sapiens
gcattctccacttct

SEQ ID NO: 19703 - DNA, 15 bp, Homo sapiens
agcattctccacttc

SEQ ID NO: 19704 - DNA, 15 bp, Homo sapiens
aagcattctccactt

SEQ ID NO: 19705 - DNA, 15 bp, Homo sapiens
taagcattctccact

SEQ ID NO: 19706 - DNA, 15 bp, Homo sapiens
ctaagcattctccac

SEQ ID NO: 19707 - DNA, 15 bp, Homo sapiens
tctaagcattctcca

SEQ ID NO: 19708 - DNA, 15 bp, Homo sapiens
ctctaagcattctcc

SEQ ID NO: 19709 - DNA, 15 bp, Homo sapiens
actctaagcattctc

SEQ ID NO: 19710 - DNA, 15 bp, Homo sapiens
aactctaagcattct

SEQ ID NO: 19711 - DNA, 15 bp, Homo sapiens
caactctaagcattc

SEQ ID NO: 19712 - DNA, 15 bp, Homo sapiens
tcaactctaagcatt

SEQ ID NO: 19713 - DNA, 15 bp, Homo sapiens
ttcaactctaagcat

SEQ ID NO: 19714 - DNA, 15 bp, Homo sapiens
gttcaactctaagca

SEQ ID NO: 19715 - DNA, 15 bp, Homo sapiens
agttcaactctaagc

SEQ ID NO: 19716 - DNA, 15 bp, Homo sapiens
tagttcaactctaag

SEQ ID NO: 19717 - DNA, 15 bp, Homo sapiens
atagttcaactctaa

SEQ ID NO: 19718 - DNA, 15 bp, Homo sapiens
tatagttcaactcta

SEQ ID NO: 19719 - DNA, 15 bp, Homo sapiens
atatagttcaactct

SEQ ID NO: 19720 - DNA, 15 bp, Homo sapiens
catatagttcaactc

SEQ ID NO: 19721 - DNA, 15 bp, Homo sapiens
tcatatagttcaact

SEQ ID NO: 19722 - DNA, 15 bp, Homo sapiens
ctcatatagttcaac

SEQ ID NO: 19723 - DNA, 15 bp, Homo sapiens
actcatatagttcaa

SEQ ID NO: 19724 - DNA, 15 bp, Homo sapiens
aactcatatagttca

SEQ ID NO: 19725 - DNA, 15 bp, Homo sapiens
aaactcatatagttc

SEQ ID NO: 19726 - DNA, 15 bp, Homo sapiens
caaactcatatagtt

SEQ ID NO: 19727 - DNA, 15 bp, Homo sapiens
tcaaactcatatagt

SEQ ID NO: 19728 - DNA, 15 bp, Homo sapiens
ttcaaactcatatag

SEQ ID NO: 19729 - DNA, 15 bp, Homo sapiens
tttcaaactcatata

SEQ ID NO: 19730 - DNA, 15 bp, Homo sapiens
ttttcaaactcatat

SEQ ID NO: 19731 - DNA, 15 bp, Homo sapiens
tttttcaaactcata

SEQ ID NO: 19732 - DNA, 15 bp, Homo sapiens
atttttcaaactcat

SEQ ID NO: 19733 - DNA, 15 bp, Homo sapiens
aatttttcaaactca

SEQ ID NO: 19734 - DNA, 15 bp, Homo sapiens
caatttttcaaactc

SEQ ID NO: 19735 - DNA, 15 bp, Homo sapiens
ccaatttttcaaact

SEQ ID NO: 19736 - DNA, 15 bp, Homo sapiens
cccaatttttcaaac

SEQ ID NO: 19737 - DNA, 15 bp, Homo sapiens
tcccaatttttcaaa

SEQ ID NO: 19738 - DNA, 15 bp, Homo sapiens
ttcccaatttttcaa

SEQ ID NO: 19739 - DNA, 15 bp, Homo sapiens
gttcccaatttttca

SEQ ID NO: 19740 - DNA, 15 bp, Homo sapiens
tgttcccaatttttc

SEQ ID NO: 19741 - DNA, 15 bp, Homo sapiens
gtgttcccaattttt

SEQ ID NO: 19742 - DNA, 15 bp, Homo sapiens
tgtgttcccaatttt

SEQ ID NO: 19743 - DNA, 15 bp, Homo sapiens
ctgtgttcccaattt

SEQ ID NO: 19744 - DNA, 15 bp, Homo sapiens
tctgtgttcccaatt

SEQ ID NO: 19745 - DNA, 15 bp, Homo sapiens
ctctgtgttcccaat

SEQ ID NO: 19746 - DNA, 15 bp, Homo sapiens
cctctgtgttcccaa

SEQ ID NO: 19747 - DNA, 15 bp, Homo sapiens
ccctctgtgttccca

SEQ ID NO: 19748 - DNA, 15 bp, Homo sapiens
cccctctgtgttccc

SEQ ID NO: 19749 - DNA, 15 bp, Homo sapiens
acccctctgtgttcc

SEQ ID NO: 19750 - DNA, 15 bp, Homo sapiens
aacccctctgtgttc

SEQ ID NO: 19751 - DNA, 15 bp, Homo sapiens
taacccctctgtgtt

SEQ ID NO: 19752 - DNA, 15 bp, Homo sapiens
ttaacccctctgtgt

SEQ ID NO: 19753 - DNA, 15 bp, Homo sapiens
cttaacccctctgtg

SEQ ID NO: 19754 - DNA, 15 bp, Homo sapiens
tcttaacccctctgt

SEQ ID NO: 19755 - DNA, 15 bp, Homo sapiens
ctcttaacccctctg

SEQ ID NO: 19756 - DNA, 15 bp, Homo sapiens
gctcttaacccctct

SEQ ID NO: 19757 - DNA, 15 bp, Homo sapiens
tgctcttaacccctc

SEQ ID NO: 19758 - DNA, 15 bp, Homo sapiens
gtgctcttaacccct

SEQ ID NO: 19759 - DNA, 15 bp, Homo sapiens
agtgctcttaacccc

SEQ ID NO: 19760 - DNA, 15 bp, Homo sapiens
cagtgctcttaaccc

SEQ ID NO: 19761 - DNA, 15 bp, Homo sapiens
gcagtgctcttaacc

SEQ ID NO: 19762 - DNA, 15 bp, Homo sapiens
agcagtgctcttaac

SEQ ID NO: 19763 - DNA, 15 bp, Homo sapiens
aagcagtgctcttaa

SEQ ID NO: 19764 - DNA, 15 bp, Homo sapiens
caagcagtgctctta

SEQ ID NO: 19765 - DNA, 15 bp, Homo sapiens
tcaagcagtgctctt

SEQ ID NO: 19766 - DNA, 15 bp, Homo sapiens
ttcaagcagtgctct

SEQ ID NO: 19767 - DNA, 15 bp, Homo sapiens
cttcaagcagtgctc

SEQ ID NO: 19768 - DNA, 15 bp, Homo sapiens
tcttcaagcagtgct

SEQ ID NO: 19769 - DNA, 15 bp, Homo sapiens
atcttcaagcagtgc

SEQ ID NO: 19770 - DNA, 15 bp, Homo sapiens
catcttcaagcagtg

SEQ ID NO: 19771 - DNA, 15 bp, Homo sapiens
ccatcttcaagcagt

SEQ ID NO: 19772 - DNA, 15 bp, Homo sapiens
accatcttcaagcag

SEQ ID NO: 19773 - DNA, 15 bp, Homo sapiens
gaccatcttcaagca

SEQ ID NO: 19774 - DNA, 15 bp, Homo sapiens
agaccatcttcaagc

SEQ ID NO: 19775 - DNA, 15 bp, Homo sapiens
cagaccatcttcaag

SEQ ID NO: 19776 - DNA, 15 bp, Homo sapiens
gcagaccatcttcaa

SEQ ID NO: 19777 - DNA, 15 bp, Homo sapiens
tgcagaccatcttca

SEQ ID NO: 19778 - DNA, 15 bp, Homo sapiens
ttgcagaccatcttc

SEQ ID NO: 19779 - DNA, 15 bp, Homo sapiens
cttgcagaccatctt

SEQ ID NO: 19780 - DNA, 15 bp, Homo sapiens
gcttgcagaccatct

SEQ ID NO: 19781 - DNA, 15 bp, Homo sapiens
ggcttgcagaccatc

SEQ ID NO: 19782 - DNA, 15 bp, Homo sapiens
cggcttgcagaccat

SEQ ID NO: 19783 - DNA, 15 bp, Homo sapiens
ccggcttgcagacca

SEQ ID NO: 19784 - DNA, 15 bp, Homo sapiens
cccggcttgcagacc

SEQ ID NO: 19785 - DNA, 15 bp, Homo sapiens
gcccggcttgcagac

SEQ ID NO: 19786 - DNA, 15 bp, Homo sapiens
agcccggcttgcaga

SEQ ID NO: 19787 - DNA, 15 bp, Homo sapiens
gagcccggcttgcag

SEQ ID NO: 19788 - DNA, 15 bp, Homo sapiens
tgagcccggcttgca

SEQ ID NO: 19789 - DNA, 15 bp, Homo sapiens
ttgagcccggcttgc

SEQ ID NO: 19790 - DNA, 15 bp, Homo sapiens
tttgagcccggcttg

SEQ ID NO: 19791 - DNA, 15 bp, Homo sapiens
atttgagcccggctt

SEQ ID NO: 19792 - DNA, 15 bp, Homo sapiens
tatttgagcccggct

SEQ ID NO: 19793 - DNA, 15 bp, Homo sapiens
ctatttgagcccggc

SEQ ID NO: 19794 - DNA, 15 bp, Homo sapiens
tctatttgagcccgg

SEQ ID NO: 19795 - DNA, 15 bp, Homo sapiens
ttctatttgagcccg

SEQ ID NO: 19796 - DNA, 15 bp, Homo sapiens
tttctatttgagccc

SEQ ID NO: 19797 - DNA, 15 bp, Homo sapiens
atttctatttgagcc

SEQ ID NO: 19798 - DNA, 15 bp, Homo sapiens
gatttctatttgagc

SEQ ID NO: 19799 - DNA, 15 bp, Homo sapiens
agatttctatttgag

SEQ ID NO: 19800 - DNA, 15 bp, Homo sapiens
tagatttctatttga

SEQ ID NO: 19801 - DNA, 15 bp, Homo sapiens
ctagatttctatttg

SEQ ID NO: 19802 - DNA, 15 bp, Homo sapiens
cctagatttctattt

SEQ ID NO: 19803 - DNA, 15 bp, Homo sapiens
acctagatttctatt

SEQ ID NO: 19804 - DNA, 15 bp, Homo sapiens
cacctagatttctat

SEQ ID NO: 19805 - DNA, 15 bp, Homo sapiens
ccacctagatttcta

SEQ ID NO: 19806 - DNA, 15 bp, Homo sapiens
cccacctagatttct

SEQ ID NO: 19807 - DNA, 15 bp, Homo sapiens
acccacctagatttc

SEQ ID NO: 19808 - DNA, 15 bp, Homo sapiens
gacccacctagattt

SEQ ID NO: 19809 - DNA, 15 bp, Homo sapiens
tgacccacctagatt

SEQ ID NO: 19810 - DNA, 15 bp, Homo sapiens
ctgacccacctagat

SEQ ID NO: 19811 - DNA, 15 bp, Homo sapiens
actgacccacctaga

SEQ ID NO: 19812 - DNA, 15 bp, Homo sapiens
tactgacccacctag

SEQ ID NO: 19813 - DNA, 15 bp, Homo sapiens
gtactgacccaccta

SEQ ID NO: 19814 - DNA, 15 bp, Homo sapiens
tgtactgacccacct

SEQ ID NO: 19815 - DNA, 15 bp, Homo sapiens
ctgtactgacccacc

SEQ ID NO: 19816 - DNA, 15 bp, Homo sapiens
tctgtactgacccac

SEQ ID NO: 19817 - DNA, 15 bp, Homo sapiens
ctctgtactgaccca

SEQ ID NO: 19818 - DNA, 15 bp, Homo sapiens
gctctgtactgaccc

SEQ ID NO: 19819 - DNA, 15 bp, Homo sapiens
agctctgtactgacc

SEQ ID NO: 19820 - DNA, 15 bp, Homo sapiens
cagctctgtactgac

SEQ ID NO: 19821 - DNA, 15 bp, Homo sapiens
gcagctctgtactga

SEQ ID NO: 19822 - DNA, 15 bp, Homo sapiens
ggcagctctgtactg

SEQ ID NO: 19823 - DNA, 15 bp, Homo sapiens
aggcagctctgtact

SEQ ID NO: 19824 - DNA, 15 bp, Homo sapiens
caggcagctctgtac

SEQ ID NO: 19825 - DNA, 15 bp, Homo sapiens
tcaggcagctctgta

SEQ ID NO: 19826 - DNA, 15 bp, Homo sapiens
gtcaggcagctctgt

SEQ ID NO: 19827 - DNA, 15 bp, Homo sapiens
tgtcaggcagctctg

SEQ ID NO: 19828 - DNA, 15 bp, Homo sapiens
atgtcaggcagctct

SEQ ID NO: 19829 - DNA, 15 bp, Homo sapiens
tatgtcaggcagctc

SEQ ID NO: 19830 - DNA, 15 bp, Homo sapiens
ttatgtcaggcagct

SEQ ID NO: 19831 - DNA, 15 bp, Homo sapiens
cttatgtcaggcagc

SEQ ID NO: 19832 - DNA, 15 bp, Homo sapiens
acttatgtcaggcag

SEQ ID NO: 19833 - DNA, 15 bp, Homo sapiens
tacttatgtcaggca

SEQ ID NO: 19834 - DNA, 15 bp, Homo sapiens
ttacttatgtcaggc

SEQ ID NO: 19835 - DNA, 15 bp, Homo sapiens
cttacttatgtcagg

SEQ ID NO: 19836 - DNA, 15 bp, Homo sapiens
acttacttatgtcag

SEQ ID NO: 19837 - DNA, 15 bp, Homo sapiens
tacttacttatgtca

SEQ ID NO: 19838 - DNA, 15 bp, Homo sapiens
ctacttacttatgtc

SEQ ID NO: 19839 - DNA, 15 bp, Homo sapiens
gctacttacttatgt

SEQ ID NO: 19840 - DNA, 15 bp, Homo sapiens
tgctacttacttatg

SEQ ID NO: 19841 - DNA, 15 bp, Homo sapiens
gtgctacttacttat

SEQ ID NO: 19842 - DNA, 15 bp, Homo sapiens
tgtgctacttactta

SEQ ID NO: 19843 - DNA, 15 bp, Homo sapiens
atgtgctacttactt

SEQ ID NO: 19844 - DNA, 15 bp, Homo sapiens
catgtgctacttact

SEQ ID NO: 19845 - DNA, 15 bp, Homo sapiens
ccatgtgctacttac

SEQ ID NO: 19846 - DNA, 15 bp, Homo sapiens
tccatgtgctactta

SEQ ID NO: 19847 - DNA, 15 bp, Homo sapiens
ctccatgtgctactt

SEQ ID NO: 19848 - DNA, 15 bp, Homo sapiens
gctccatgtgctact

SEQ ID NO: 19849 - DNA, 15 bp, Homo sapiens
tgctccatgtgctac

SEQ ID NO: 19850 - DNA, 15 bp, Homo sapiens
atgctccatgtgcta

SEQ ID NO: 19851 - DNA, 15 bp, Homo sapiens
aatgctccatgtgct

SEQ ID NO: 19852 - DNA, 15 bp, Homo sapiens
caatgctccatgtgc

SEQ ID NO: 19853 - DNA, 15 bp, Homo sapiens
gcaatgctccatgtg

SEQ ID NO: 19854 - DNA, 15 bp, Homo sapiens
agcaatgctccatgt

SEQ ID NO: 19855 - DNA, 15 bp, Homo sapiens
aagcaatgctccatg

SEQ ID NO: 19856 - DNA, 15 bp, Homo sapiens
caagcaatgctccat

SEQ ID NO: 19857 - DNA, 15 bp, Homo sapiens
acaagcaatgctcca

SEQ ID NO: 19858 - DNA, 15 bp, Homo sapiens
aacaagcaatgctcc

SEQ ID NO: 19859 - DNA, 15 bp, Homo sapiens
caacaagcaatgctc

SEQ ID NO: 19860 - DNA, 15 bp, Homo sapiens
acaacaagcaatgct

SEQ ID NO: 19861 - DNA, 15 bp, Homo sapiens
gacaacaagcaatgc

SEQ ID NO: 19862 - DNA, 15 bp, Homo sapiens
tgacaacaagcaatg

SEQ ID NO: 19863 - DNA, 15 bp, Homo sapiens
gtgacaacaagcaat

SEQ ID NO: 19864 - DNA, 15 bp, Homo sapiens
tgtgacaacaagcaa

SEQ ID NO: 19865 - DNA, 15 bp, Homo sapiens
ctgtgacaacaagca

SEQ ID NO: 19866 - DNA, 15 bp, Homo sapiens
actgtgacaacaagc

SEQ ID NO: 19867 - DNA, 15 bp, Homo sapiens
aactgtgacaacaag

SEQ ID NO: 19868 - DNA, 15 bp, Homo sapiens
caactgtgacaacaa

SEQ ID NO: 19869 - DNA, 15 bp, Homo sapiens
acaactgtgacaaca

SEQ ID NO: 19870 - DNA, 15 bp, Homo sapiens
tacaactgtgacaac

SEQ ID NO: 19871 - DNA, 15 bp, Homo sapiens
atacaactgtgacaa

SEQ ID NO: 19872 - DNA, 15 bp, Homo sapiens
catacaactgtgaca

SEQ ID NO: 19873 - DNA, 15 bp, Homo sapiens
ccatacaactgtgac

SEQ ID NO: 19874 - DNA, 15 bp, Homo sapiens
gccatacaactgtga

SEQ ID NO: 19875 - DNA, 15 bp, Homo sapiens
agccatacaactgtg

SEQ ID NO: 19876 - DNA, 15 bp, Homo sapiens
cagccatacaactgt

SEQ ID NO: 19877 - DNA, 15 bp, Homo sapiens
ccagccatacaactg

SEQ ID NO: 19878 - DNA, 15 bp, Homo sapiens
accagccatacaact

SEQ ID NO: 19879 - DNA, 15 bp, Homo sapiens
aaccagccatacaac

SEQ ID NO: 19880 - DNA, 15 bp, Homo sapiens
caaccagccatacaa

SEQ ID NO: 19881 - DNA, 15 bp, Homo sapiens
gcaaccagccataca

SEQ ID NO: 19882 - DNA, 15 bp, Homo sapiens
agcaaccagccatac

SEQ ID NO: 19883 - DNA, 15 bp, Homo sapiens
aagcaaccagccata

SEQ ID NO: 19884 - DNA, 15 bp, Homo sapiens
caagcaaccagccat

SEQ ID NO: 19885 - DNA, 15 bp, Homo sapiens
tcaagcaaccagcca

SEQ ID NO: 19886 - DNA, 15 bp, Homo sapiens
ttcaagcaaccagcc

SEQ ID NO: 19887 - DNA, 15 bp, Homo sapiens
gttcaagcaaccagc

SEQ ID NO: 19888 - DNA, 15 bp, Homo sapiens
tgttcaagcaaccag

SEQ ID NO: 19889 - DNA, 15 bp, Homo sapiens
ctgttcaagcaacca

SEQ ID NO: 19890 - DNA, 15 bp, Homo sapiens
actgttcaagcaacc

SEQ ID NO: 19891 - DNA, 15 bp, Homo sapiens
tactgttcaagcaac

SEQ ID NO: 19892 - DNA, 15 bp, Homo sapiens
ctactgttcaagcaa

SEQ ID NO: 19893 - DNA, 15 bp, Homo sapiens
gctactgttcaagca

SEQ ID NO: 19894 - DNA, 15 bp, Homo sapiens
ggctactgttcaagc

SEQ ID NO: 19895 - DNA, 15 bp, Homo sapiens
tggctactgttcaag

SEQ ID NO: 19896 - DNA, 15 bp, Homo sapiens
ctggctactgttcaa

SEQ ID NO: 19897 - DNA, 15 bp, Homo sapiens
actggctactgttca

SEQ ID NO: 19898 - DNA, 15 bp, Homo sapiens
cactggctactgttc

SEQ ID NO: 19899 - DNA, 15 bp, Homo sapiens
ccactggctactgtt

SEQ ID NO: 19900 - DNA, 15 bp, Homo sapiens
tccactggctactgt

SEQ ID NO: 19901 - DNA, 15 bp, Homo sapiens
ttccactggctactg

SEQ ID NO: 19902 - DNA, 15 bp, Homo sapiens
cttccactggctact

SEQ ID NO: 19903 - DNA, 15 bp, Homo sapiens
tcttccactggctac

SEQ ID NO: 19904 - DNA, 15 bp, Homo sapiens
gtcttccactggcta

SEQ ID NO: 19905 - DNA, 15 bp, Homo sapiens
ggtcttccactggct

SEQ ID NO: 19906 - DNA, 15 bp, Homo sapiens
aggtcttccactggc

SEQ ID NO: 19907 - DNA, 15 bp, Homo sapiens
taggtcttccactgg

SEQ ID NO: 19908 - DNA, 15 bp, Homo sapiens
ctaggtcttccactg

SEQ ID NO: 19909 - DNA, 15 bp, Homo sapiens
actaggtcttccact

SEQ ID NO: 19910 - DNA, 15 bp, Homo sapiens
tactaggtcttccac

SEQ ID NO: 19911 - DNA, 15 bp, Homo sapiens
ctactaggtcttcca

SEQ ID NO: 19912 - DNA, 15 bp, Homo sapiens
tctactaggtcttcc

SEQ ID NO: 19913 - DNA, 15 bp, Homo sapiens
ttctactaggtcttc

SEQ ID NO: 19914 - DNA, 15 bp, Homo sapiens
attctactaggtctt

SEQ ID NO: 19915 - DNA, 15 bp, Homo sapiens
cattctactaggtct

SEQ ID NO: 19916 - DNA, 15 bp, Homo sapiens
acattctactaggtc

SEQ ID NO: 19917 - DNA, 15 bp, Homo sapiens
cacattctactaggt

SEQ ID NO: 19918 - DNA, 15 bp, Homo sapiens
acacattctactagg

SEQ ID NO: 19919 - DNA, 15 bp, Homo sapiens
tacacattctactag

SEQ ID NO: 19920 - DNA, 15 bp, Homo sapiens
ctacacattctacta

SEQ ID NO: 19921 - DNA, 15 bp, Homo sapiens
tctacacattctact

SEQ ID NO: 19922 - DNA, 15 bp, Homo sapiens
ctctacacattctac

SEQ ID NO: 19923 - DNA, 15 bp, Homo sapiens
tctctacacattcta

SEQ ID NO: 19924 - DNA, 15 bp, Homo sapiens
ttctctacacattct

SEQ ID NO: 19925 - DNA, 15 bp, Homo sapiens
attctctacacattc

SEQ ID NO: 19926 - DNA, 15 bp, Homo sapiens
gattctctacacatt

SEQ ID NO: 19927 - DNA, 15 bp, Homo sapiens
agattctctacacat

SEQ ID NO: 19928 - DNA, 15 bp, Homo sapiens
cagattctctacaca

SEQ ID NO: 19929 - DNA, 15 bp, Homo sapiens
ccagattctctacac

SEQ ID NO: 19930 - DNA, 15 bp, Homo sapiens
cccagattctctaca

SEQ ID NO: 19931 - DNA, 15 bp, Homo sapiens
acccagattctctac

SEQ ID NO: 19932 - DNA, 15 bp, Homo sapiens
cacccagattctcta

SEQ ID NO: 19933 - DNA, 15 bp, Homo sapiens
gcacccagattctct

SEQ ID NO: 19934 - DNA, 15 bp, Homo sapiens
ggcacccagattctc

SEQ ID NO: 19935 - DNA, 15 bp, Homo sapiens
gggcacccagattct

SEQ ID NO: 19936 - DNA, 15 bp, Homo sapiens
agggcacccagattc

SEQ ID NO: 19937 - DNA, 15 bp, Homo sapiens
tagggcacccagatt

SEQ ID NO: 19938 - DNA, 15 bp, Homo sapiens
ctagggcacccagat

SEQ ID NO: 19939 - DNA, 15 bp, Homo sapiens
actagggcacccaga

SEQ ID NO: 19940 - DNA, 15 bp, Homo sapiens
gactagggcacccag

SEQ ID NO: 19941 - DNA, 15 bp, Homo sapiens
tgactagggcaccca

SEQ ID NO: 19942 - DNA, 15 bp, Homo sapiens
ttgactagggcaccc

SEQ ID NO: 19943 - DNA, 15 bp, Homo sapiens
tttgactagggcacc

SEQ ID NO: 19944 - DNA, 15 bp, Homo sapiens
ttttgactagggcac

SEQ ID NO: 19945 - DNA, 15 bp, Homo sapiens
tttttgactagggca

SEQ ID NO: 19946 - DNA, 15 bp, Homo sapiens
gtttttgactagggc

SEQ ID NO: 19947 - DNA, 15 bp, Homo sapiens
ggtttttgactaggg

SEQ ID NO: 19948 - DNA, 15 bp, Homo sapiens
tggtttttgactagg

SEQ ID NO: 19949 - DNA, 15 bp, Homo sapiens
ctggtttttgactag

SEQ ID NO: 19950 - DNA, 15 bp, Homo sapiens
gctggtttttgacta

SEQ ID NO: 19951 - DNA, 15 bp, Homo sapiens
cgctggtttttgact

SEQ ID NO: 19952 - DNA, 15 bp, Homo sapiens
acgctggtttttgac

SEQ ID NO: 19953 - DNA, 15 bp, Homo sapiens
gacgctggtttttga

SEQ ID NO: 19954 - DNA, 15 bp, Homo sapiens
cgacgctggtttttg

SEQ ID NO: 19955 - DNA, 15 bp, Homo sapiens
ccgacgctggttttt

SEQ ID NO: 19956 - DNA, 15 bp, Homo sapiens
accgacgctggtttt

SEQ ID NO: 19957 - DNA, 15 bp, Homo sapiens
taccgacgctggttt

SEQ ID NO: 19958 - DNA, 15 bp, Homo sapiens
ataccgacgctggtt

SEQ ID NO: 19959 - DNA, 15 bp, Homo sapiens
aataccgacgctggt

SEQ ID NO: 19960 - DNA, 15 bp, Homo sapiens
aaataccgacgctgg

SEQ ID NO: 19961 - DNA, 15 bp, Homo sapiens
taaataccgacgctg

SEQ ID NO: 19962 - DNA, 15 bp, Homo sapiens
ttaaataccgacgct

SEQ ID NO: 19963 - DNA, 15 bp, Homo sapiens
cttaaataccgacgc

SEQ ID NO: 19964 - DNA, 15 bp, Homo sapiens
acttaaataccgacg

SEQ ID NO: 19965 - DNA, 15 bp, Homo sapiens
aacttaaataccgac

SEQ ID NO: 19966 - DNA, 15 bp, Homo sapiens
caacttaaataccga

SEQ ID NO: 19967 - DNA, 15 bp, Homo sapiens
ccaacttaaataccg

SEQ ID NO: 19968 - DNA, 15 bp, Homo sapiens
cccaacttaaatacc

SEQ ID NO: 19969 - DNA, 15 bp, Homo sapiens
tcccaacttaaatac

SEQ ID NO: 19970 - DNA, 15 bp, Homo sapiens
atcccaacttaaata

SEQ ID NO: 19971 - DNA, 15 bp, Homo sapiens
catcccaacttaaat

SEQ ID NO: 19972 - DNA, 15 bp, Homo sapiens
acatcccaacttaaa

SEQ ID NO: 19973 - DNA, 15 bp, Homo sapiens
cacatcccaacttaa

SEQ ID NO: 19974 - DNA, 15 bp, Homo sapiens
ccacatcccaactta

SEQ ID NO: 19975 - DNA, 15 bp, Homo sapiens
accacatcccaactt

SEQ ID NO: 19976 - DNA, 15 bp, Homo sapiens
taccacatcccaact

SEQ ID NO: 19977 - DNA, 15 bp, Homo sapiens
ataccacatcccaac

SEQ ID NO: 19978 - DNA, 15 bp, Homo sapiens
aataccacatcccaa

SEQ ID NO: 19979 - DNA, 15 bp, Homo sapiens
gaataccacatccca

SEQ ID NO: 19980 - DNA, 15 bp, Homo sapiens
tgaataccacatccc

SEQ ID NO: 19981 - DNA, 15 bp, Homo sapiens
atgaataccacatcc

SEQ ID NO: 19982 - DNA, 15 bp, Homo sapiens
gatgaataccacatc

SEQ ID NO: 19983 - DNA, 15 bp, Homo sapiens
agatgaataccacat

SEQ ID NO: 19984 - DNA, 15 bp, Homo sapiens
aagatgaataccaca

SEQ ID NO: 19985 - DNA, 15 bp, Homo sapiens
caagatgaataccac

SEQ ID NO: 19986 - DNA, 15 bp, Homo sapiens
acaagatgaatacca

SEQ ID NO: 19987 - DNA, 15 bp, Homo sapiens
cacaagatgaatacc

SEQ ID NO: 19988 - DNA, 15 bp, Homo sapiens
tcacaagatgaatac

SEQ ID NO: 19989 - DNA, 15 bp, Homo sapiens
gtcacaagatgaata

SEQ ID NO: 19990 - DNA, 15 bp, Homo sapiens
ggtcacaagatgaat

SEQ ID NO: 19991 - DNA, 15 bp, Homo sapiens
tggtcacaagatgaa

SEQ ID NO: 19992 - DNA, 15 bp, Homo sapiens
ctggtcacaagatga

SEQ ID NO: 19993 - DNA, 15 bp, Homo sapiens
actggtcacaagatg

SEQ ID NO: 19994 - DNA, 15 bp, Homo sapiens
aactggtcacaagat

SEQ ID NO: 19995 - DNA, 15 bp, Homo sapiens
gaactggtcacaaga

SEQ ID NO: 19996 - DNA, 15 bp, Homo sapiens
agaactggtcacaag

SEQ ID NO: 19997 - DNA, 15 bp, Homo sapiens
gagaactggtcacaa

SEQ ID NO: 19998 - DNA, 15 bp, Homo sapiens
agagaactggtcaca

SEQ ID NO: 19999 - DNA, 15 bp, Homo sapiens
tagagaactggtcac

SEQ ID NO: 20000 - DNA, 15 bp, Homo sapiens
gtagagaactggtca

SEQ ID NO: 20001 - DNA, 15 bp, Homo sapiens
agtagagaactggtc

SEQ ID NO: 20002 - DNA, 15 bp, Homo sapiens
aagtagagaactggt

SEQ ID NO: 20003 - DNA, 15 bp, Homo sapiens
gaagtagagaactgg

SEQ ID NO: 20004 - DNA, 15 bp, Homo sapiens
agaagtagagaactg

SEQ ID NO: 20005 - DNA, 15 bp, Homo sapiens
cagaagtagagaact

SEQ ID NO: 20006 - DNA, 15 bp, Homo sapiens
acagaagtagagaac

SEQ ID NO: 20007 - DNA, 15 bp, Homo sapiens
gacagaagtagagaa

SEQ ID NO: 20008 - DNA, 15 bp, Homo sapiens
ggacagaagtagaga

SEQ ID NO: 20009 - DNA, 15 bp, Homo sapiens
aggacagaagtagag

SEQ ID NO: 20010 - DNA, 15 bp, Homo sapiens
taggacagaagtaga

SEQ ID NO: 20011 - DNA, 15 bp, Homo sapiens
ctaggacagaagtag

SEQ ID NO: 20012 - DNA, 15 bp, Homo sapiens
cctaggacagaagta

SEQ ID NO: 20013 - DNA, 15 bp, Homo sapiens
ccctaggacagaagt

SEQ ID NO: 20014 - DNA, 15 bp, Homo sapiens
accctaggacagaag

SEQ ID NO: 20015 - DNA, 15 bp, Homo sapiens
taccctaggacagaa

SEQ ID NO: 20016 - DNA, 15 bp, Homo sapiens
gtaccctaggacaga

SEQ ID NO: 20017 - DNA, 15 bp, Homo sapiens
tgtaccctaggacag

SEQ ID NO: 20018 - DNA, 15 bp, Homo sapiens
ttgtaccctaggaca

SEQ ID NO: 20019 - DNA, 15 bp, Homo sapiens
tttgtaccctaggac

SEQ ID NO: 20020 - DNA, 15 bp, Homo sapiens
gtttgtaccctagga

SEQ ID NO: 20021 - DNA, 15 bp, Homo sapiens
tgtttgtaccctagg

SEQ ID NO: 20022 - DNA, 15 bp, Homo sapiens
atgtttgtaccctag

SEQ ID NO: 20023 - DNA, 15 bp, Homo sapiens
aatgtttgtacccta

SEQ ID NO: 20024 - DNA, 15 bp, Homo sapiens
caatgtttgtaccct

SEQ ID NO: 20025 - DNA, 15 bp, Homo sapiens
gcaatgtttgtaccc

SEQ ID NO: 20026 - DNA, 15 bp, Homo sapiens
agcaatgtttgtacc

SEQ ID NO: 20027 - DNA, 15 bp, Homo sapiens
cagcaatgtttgtac

SEQ ID NO: 20028 - DNA, 15 bp, Homo sapiens
gcagcaatgtttgta

SEQ ID NO: 20029 - DNA, 15 bp, Homo sapiens
agcagcaatgtttgt

SEQ ID NO: 20030 - DNA, 15 bp, Homo sapiens
cagcagcaatgtttg

SEQ ID NO: 20031 - DNA, 15 bp, Homo sapiens
ccagcagcaatgttt

SEQ ID NO: 20032 - DNA, 15 bp, Homo sapiens
cccagcagcaatgtt

SEQ ID NO: 20033 - DNA, 15 bp, Homo sapiens
tcccagcagcaatgt

SEQ ID NO: 20034 - DNA, 15 bp, Homo sapiens
ttcccagcagcaatg

SEQ ID NO: 20035 - DNA, 15 bp, Homo sapiens
tttcccagcagcaat

SEQ ID NO: 20036 - DNA, 15 bp, Homo sapiens
ctttcccagcagcaa

SEQ ID NO: 20037 - DNA, 15 bp, Homo sapiens
gctttcccagcagca

SEQ ID NO: 20038 - DNA, 15 bp, Homo sapiens
agctttcccagcagc

SEQ ID NO: 20039 - DNA, 15 bp, Homo sapiens
tagctttcccagcag

SEQ ID NO: 20040 - DNA, 15 bp, Homo sapiens
atagctttcccagca

SEQ ID NO: 20041 - DNA, 15 bp, Homo sapiens
catagctttcccagc

SEQ ID NO: 20042 - DNA, 15 bp, Homo sapiens
ccatagctttcccag

SEQ ID NO: 20043 - DNA, 15 bp, Homo sapiens
cccatagctttccca

SEQ ID NO: 20044 - DNA, 15 bp, Homo sapiens
tcccatagctttccc

SEQ ID NO: 20045 - DNA, 15 bp, Homo sapiens
ctcccatagctttcc

SEQ ID NO: 20046 - DNA, 15 bp, Homo sapiens
actcccatagctttc

SEQ ID NO: 20047 - DNA, 15 bp, Homo sapiens
cactcccatagcttt

SEQ ID NO: 20048 - DNA, 15 bp, Homo sapiens
ccactcccatagctt

SEQ ID NO: 20049 - DNA, 15 bp, Homo sapiens
accactcccatagct

SEQ ID NO: 20050 - DNA, 15 bp, Homo sapiens
caccactcccatagc

SEQ ID NO: 20051 - DNA, 15 bp, Homo sapiens
ccaccactcccatag

SEQ ID NO: 20052 - DNA, 15 bp, Homo sapiens
accaccactcccata

SEQ ID NO: 20053 - DNA, 15 bp, Homo sapiens
taccaccactcccat

SEQ ID NO: 20054 - DNA, 15 bp, Homo sapiens
ctaccaccactccca

SEQ ID NO: 20055 - DNA, 15 bp, Homo sapiens
gctaccaccactccc

SEQ ID NO: 20056 - DNA, 15 bp, Homo sapiens
tgctaccaccactcc

SEQ ID NO: 20057 - DNA, 15 bp, Homo sapiens
ttgctaccaccactc

SEQ ID NO: 20058 - DNA, 15 bp, Homo sapiens
gttgctaccaccact

SEQ ID NO: 20059 - DNA, 15 bp, Homo sapiens
agttgctaccaccac

SEQ ID NO: 20060 - DNA, 15 bp, Homo sapiens
cagttgctaccacca

SEQ ID NO: 20061 - DNA, 15 bp, Homo sapiens
ccagttgctaccacc

SEQ ID NO: 20062 - DNA, 15 bp, Homo sapiens
tccagttgctaccac

SEQ ID NO: 20063 - DNA, 15 bp, Homo sapiens
ctccagttgctacca

SEQ ID NO: 20064 - DNA, 15 bp, Homo sapiens
actccagttgctacc

SEQ ID NO: 20065 - DNA, 15 bp, Homo sapiens
aactccagttgctac

SEQ ID NO: 20066 - DNA, 15 bp, Homo sapiens
taactccagttgcta

SEQ ID NO: 20067 - DNA, 15 bp, Homo sapiens
ttaactccagttgct

SEQ ID NO: 20068 - DNA, 15 bp, Homo sapiens
gttaactccagttgc

SEQ ID NO: 20069 - DNA, 15 bp, Homo sapiens
tgttaactccagttg

SEQ ID NO: 20070 - DNA, 15 bp, Homo sapiens
gtgttaactccagtt

SEQ ID NO: 20071 - DNA, 15 bp, Homo sapiens
ggtgttaactccagt

SEQ ID NO: 20072 - DNA, 15 bp, Homo sapiens
cggtgttaactccag

SEQ ID NO: 20073 - DNA, 15 bp, Homo sapiens
tcggtgttaactcca

SEQ ID NO: 20074 - DNA, 15 bp, Homo sapiens
ttcggtgttaactcc

SEQ ID NO: 20075 - DNA, 15 bp, Homo sapiens
tttcggtgttaactc

SEQ ID NO: 20076 - DNA, 15 bp, Homo sapiens
atttcggtgttaact

SEQ ID NO: 20077 - DNA, 15 bp, Homo sapiens
aatttcggtgttaac

SEQ ID NO: 20078 - DNA, 15 bp, Homo sapiens
caatttcggtgttaa

SEQ ID NO: 20079 - DNA, 15 bp, Homo sapiens
ccaatttcggtgtta

SEQ ID NO: 20080 - DNA, 15 bp, Homo sapiens
gccaatttcggtgtt

SEQ ID NO: 20081 - DNA, 15 bp, Homo sapiens
tgccaatttcggtgt

SEQ ID NO: 20082 - DNA, 15 bp, Homo sapiens
ttgccaatttcggtg

SEQ ID NO: 20083 - DNA, 15 bp, Homo sapiens
cttgccaatttcggt

SEQ ID NO: 20084 - DNA, 15 bp, Homo sapiens
tcttgccaatttcgg

SEQ ID NO: 20085 - DNA, 15 bp, Homo sapiens
atcttgccaatttcg

SEQ ID NO: 20086 - DNA, 15 bp, Homo sapiens
gatcttgccaatttc

SEQ ID NO: 20087 - DNA, 15 bp, Homo sapiens
ggatcttgccaattt

SEQ ID NO: 20088 - DNA, 15 bp, Homo sapiens
cggatcttgccaatt

SEQ ID NO: 20089 - DNA, 15 bp, Homo sapiens
ccggatcttgccaat

SEQ ID NO: 20090 - DNA, 15 bp, Homo sapiens
cccggatcttgccaa

SEQ ID NO: 20091 - DNA, 15 bp, Homo sapiens
tcccggatcttgcca

SEQ ID NO: 20092 - DNA, 15 bp, Homo sapiens
atcccggatcttgcc

SEQ ID NO: 20093 - DNA, 15 bp, Homo sapiens
catcccggatcttgc

SEQ ID NO: 20094 - DNA, 15 bp, Homo sapiens
tcatcccggatcttg

SEQ ID NO: 20095 - DNA, 15 bp, Homo sapiens
ttcatcccggatctt

SEQ ID NO: 20096 - DNA, 15 bp, Homo sapiens
tttcatcccggatct

SEQ ID NO: 20097 - DNA, 15 bp, Homo sapiens
atttcatcccggatc

SEQ ID NO: 20098 - DNA, 15 bp, Homo sapiens
catttcatcccggat

SEQ ID NO: 20099 - DNA, 15 bp, Homo sapiens
ccatttcatcccgga

SEQ ID NO: 20100 - DNA, 15 bp, Homo sapiens
accatttcatcccgg

SEQ ID NO: 20101 - DNA, 15 bp, Homo sapiens
caccatttcatcccg

SEQ ID NO: 20102 - DNA, 15 bp, Homo sapiens
ccaccatttcatccc

SEQ ID NO: 20103 - DNA, 15 bp, Homo sapiens
gccaccatttcatcc

SEQ ID NO: 20104 - DNA, 15 bp, Homo sapiens
tgccaccatttcatc

SEQ ID NO: 20105 - DNA, 15 bp, Homo sapiens
ttgccaccatttcat

SEQ ID NO: 20106 - DNA, 15 bp, Homo sapiens
gttgccaccatttca

SEQ ID NO: 20107 - DNA, 15 bp, Homo sapiens
tgttgccaccatttc

SEQ ID NO: 20108 - DNA, 15 bp, Homo sapiens
ctgttgccaccattt

SEQ ID NO: 20109 - DNA, 15 bp, Homo sapiens
tctgttgccaccatt

SEQ ID NO: 20110 - DNA, 15 bp, Homo sapiens
ttctgttgccaccat

SEQ ID NO: 20111 - DNA, 15 bp, Homo sapiens
gttctgttgccacca

SEQ ID NO: 20112 - DNA, 15 bp, Homo sapiens
tgttctgttgccacc

SEQ ID NO: 20113 - DNA, 15 bp, Homo sapiens
ctgttctgttgccac

SEQ ID NO: 20114 - DNA, 15 bp, Homo sapiens
cctgttctgttgcca

SEQ ID NO: 20115 - DNA, 15 bp, Homo sapiens
tcctgttctgttgcc

SEQ ID NO: 20116 - DNA, 15 bp, Homo sapiens
ctcctgttctgttgc

SEQ ID NO: 20117 - DNA, 15 bp, Homo sapiens
tctcctgttctgttg

SEQ ID NO: 20118 - DNA, 15 bp, Homo sapiens
ctctcctgttctgtt

SEQ ID NO: 20119 - DNA, 15 bp, Homo sapiens
tctctcctgttctgt

SEQ ID NO: 20120 - DNA, 15 bp, Homo sapiens
ttctctcctgttctg

SEQ ID NO: 20121 - DNA, 15 bp, Homo sapiens
gttctctcctgttct

SEQ ID NO: 20122 - DNA, 15 bp, Homo sapiens
tgttctctcctgttc

SEQ ID NO: 20123 - DNA, 15 bp, Homo sapiens
gtgttctctcctgtt

SEQ ID NO: 20124 - DNA, 15 bp, Homo sapiens
ggtgttctctcctgt

SEQ ID NO: 20125 - DNA, 15 bp, Homo sapiens
gggtgttctctcctg

SEQ ID NO: 20126 - DNA, 15 bp, Homo sapiens
ggggtgttctctcct

SEQ ID NO: 20127 - DNA, 15 bp, Homo sapiens
aggggtgttctctcc

SEQ ID NO: 20128 - DNA, 15 bp, Homo sapiens
aaggggtgttctctc

SEQ ID NO: 20129 - DNA, 15 bp, Homo sapiens
gaaggggtgttctct

SEQ ID NO: 20130 - DNA, 15 bp, Homo sapiens
tgaaggggtgttctc

SEQ ID NO: 20131 - DNA, 15 bp, Homo sapiens
ctgaaggggtgttct

SEQ ID NO: 20132 - DNA, 15 bp, Homo sapiens
gctgaaggggtgttc

SEQ ID NO: 20133 - DNA, 15 bp, Homo sapiens
tgctgaaggggtgtt

SEQ ID NO: 20134 - DNA, 15 bp, Homo sapiens
ttgctgaaggggtgt

SEQ ID NO: 20135 - DNA, 15 bp, Homo sapiens
tttgctgaaggggtg

SEQ ID NO: 20136 - DNA, 15 bp, Homo sapiens
ttttgctgaaggggt

SEQ ID NO: 20137 - DNA, 15 bp, Homo sapiens
tttttgctgaagggg

SEQ ID NO: 20138 - DNA, 15 bp, Homo sapiens
gtttttgctgaaggg

SEQ ID NO: 20139 - DNA, 15 bp, Homo sapiens
agtttttgctgaagg

SEQ ID NO: 20140 - DNA, 15 bp, Homo sapiens
tagtttttgctgaag

SEQ ID NO: 20141 - DNA, 15 bp, Homo sapiens
ctagtttttgctgaa

SEQ ID NO: 20142 - DNA, 15 bp, Homo sapiens
tctagtttttgctga

SEQ ID NO: 20143 - DNA, 15 bp, Homo sapiens
atctagtttttgctg

SEQ ID NO: 20144 - DNA, 15 bp, Homo sapiens
catctagtttttgct

SEQ ID NO: 20145 - DNA, 15 bp, Homo sapiens
tcatctagtttttgc

SEQ ID NO: 20146 - DNA, 15 bp, Homo sapiens
ttcatctagtttttg

SEQ ID NO: 20147 - DNA, 15 bp, Homo sapiens
attcatctagttttt

SEQ ID NO: 20148 - DNA, 15 bp, Homo sapiens
aattcatctagtttt

SEQ ID NO: 20149 - DNA, 15 bp, Homo sapiens
aaattcatctagttt

SEQ ID NO: 20150 - DNA, 15 bp, Homo sapiens
caaattcatctagtt

SEQ ID NO: 20151 - DNA, 15 bp, Homo sapiens
ccaaattcatctagt

SEQ ID NO: 20152 - DNA, 15 bp, Homo sapiens
cccaaattcatctag

SEQ ID NO: 20153 - DNA, 15 bp, Homo sapiens
ccccaaattcatcta

SEQ ID NO: 20154 - DNA, 15 bp, Homo sapiens
tccccaaattcatct

SEQ ID NO: 20155 - DNA, 15 bp, Homo sapiens
ttccccaaattcatc

SEQ ID NO: 20156 - DNA, 15 bp, Homo sapiens
gttccccaaattcat

SEQ ID NO: 20157 - DNA, 15 bp, Homo sapiens
tgttccccaaattca

SEQ ID NO: 20158 - DNA, 15 bp, Homo sapiens
ctgttccccaaattc

SEQ ID NO: 20159 - DNA, 15 bp, Homo sapiens
gctgttccccaaatt

SEQ ID NO: 20160 - DNA, 15 bp, Homo sapiens
agctgttccccaaat

SEQ ID NO: 20161 - DNA, 15 bp, Homo sapiens
aagctgttccccaaa

SEQ ID NO: 20162 - DNA, 15 bp, Homo sapiens
aaagctgttccccaa

SEQ ID NO: 20163 - DNA, 15 bp, Homo sapiens
gaaagctgttcccca

SEQ ID NO: 20164 - DNA, 15 bp, Homo sapiens
ggaaagctgttcccc

SEQ ID NO: 20165 - DNA, 15 bp, Homo sapiens
tggaaagctgttccc

SEQ ID NO: 20166 - DNA, 15 bp, Homo sapiens
ttggaaagctgttcc

SEQ ID NO: 20167 - DNA, 15 bp, Homo sapiens
tttggaaagctgttc

SEQ ID NO: 20168 - DNA, 15 bp, Homo sapiens
ctttggaaagctgtt

SEQ ID NO: 20169 - DNA, 15 bp, Homo sapiens
actttggaaagctgt

SEQ ID NO: 20170 - DNA, 15 bp, Homo sapiens
gactttggaaagctg

SEQ ID NO: 20171 - DNA, 15 bp, Homo sapiens
tgactttggaaagct

SEQ ID NO: 20172 - DNA, 15 bp, Homo sapiens
atgactttggaaagc

SEQ ID NO: 20173 - DNA, 15 bp, Homo sapiens
gatgactttggaaag

SEQ ID NO: 20174 - DNA, 15 bp, Homo sapiens
agatgactttggaaa

SEQ ID NO: 20175 - DNA, 15 bp, Homo sapiens
gagatgactttggaa

SEQ ID NO: 20176 - DNA, 15 bp, Homo sapiens
ggagatgactttgga

SEQ ID NO: 20177 - DNA, 15 bp, Homo sapiens
gggagatgactttgg

SEQ ID NO: 20178 - DNA, 15 bp, Homo sapiens
agggagatgactttg

SEQ ID NO: 20179 - DNA, 15 bp, Homo sapiens
aagggagatgacttt

SEQ ID NO: 20180 - DNA, 15 bp, Homo sapiens
taagggagatgactt

SEQ ID NO: 20181 - DNA, 15 bp, Homo sapiens
ataagggagatgact

SEQ ID NO: 20182 - DNA, 15 bp, Homo sapiens
aataagggagatgac

SEQ ID NO: 20183 - DNA, 15 bp, Homo sapiens
aaataagggagatga

SEQ ID NO: 20184 - DNA, 15 bp, Homo sapiens
caaataagggagatg

SEQ ID NO: 20185 - DNA, 15 bp, Homo sapiens
gcaaataagggagat

SEQ ID NO: 20186 - DNA, 15 bp, Homo sapiens
tgcaaataagggaga

SEQ ID NO: 20187 - DNA, 15 bp, Homo sapiens
atgcaaataagggag

SEQ ID NO: 20188 - DNA, 15 bp, Homo sapiens
aatgcaaataaggga

SEQ ID NO: 20189 - DNA, 15 bp, Homo sapiens
caatgcaaataaggg

SEQ ID NO: 20190 - DNA, 15 bp, Homo sapiens
gcaatgcaaataagg

SEQ ID NO: 20191 - DNA, 15 bp, Homo sapiens
tgcaatgcaaataag

SEQ ID NO: 20192 - DNA, 15 bp, Homo sapiens
ctgcaatgcaaataa

SEQ ID NO: 20193 - DNA, 15 bp, Homo sapiens
actgcaatgcaaata

SEQ ID NO: 20194 - DNA, 15 bp, Homo sapiens
gactgcaatgcaaat

SEQ ID NO: 20195 - DNA, 15 bp, Homo sapiens
agactgcaatgcaaa

SEQ ID NO: 20196 - DNA, 15 bp, Homo sapiens
cagactgcaatgcaa

SEQ ID NO: 20197 - DNA, 15 bp, Homo sapiens
ccagactgcaatgca

SEQ ID NO: 20198 - DNA, 15 bp, Homo sapiens
tccagactgcaatgc

SEQ ID NO: 20199 - DNA, 15 bp, Homo sapiens
atccagactgcaatg

SEQ ID NO: 20200 - DNA, 15 bp, Homo sapiens
gatccagactgcaat

SEQ ID NO: 20201 - DNA, 15 bp, Homo sapiens
tgatccagactgcaa

SEQ ID NO: 20202 - DNA, 15 bp, Homo sapiens
atgatccagactgca

SEQ ID NO: 20203 - DNA, 15 bp, Homo sapiens
tatgatccagactgc

SEQ ID NO: 20204 - DNA, 15 bp, Homo sapiens
ttatgatccagactg

SEQ ID NO: 20205 - DNA, 15 bp, Homo sapiens
tttatgatccagact

SEQ ID NO: 20206 - DNA, 15 bp, Homo sapiens
atttatgatccagac

SEQ ID NO: 20207 - DNA, 15 bp, Homo sapiens
tatttatgatccaga

SEQ ID NO: 20208 - DNA, 15 bp, Homo sapiens
atatttatgatccag

SEQ ID NO: 20209 - DNA, 15 bp, Homo sapiens
aatatttatgatcca

SEQ ID NO: 20210 - DNA, 15 bp, Homo sapiens
caatatttatgatcc

SEQ ID NO: 20211 - DNA, 15 bp, Homo sapiens
ccaatatttatgatc

SEQ ID NO: 20212 - DNA, 15 bp, Homo sapiens
cccaatatttatgat

SEQ ID NO: 20213 - DNA, 15 bp, Homo sapiens
gcccaatatttatga

SEQ ID NO: 20214 - DNA, 15 bp, Homo sapiens
tgcccaatatttatg

SEQ ID NO: 20215 - DNA, 15 bp, Homo sapiens
gtgcccaatatttat

SEQ ID NO: 20216 - DNA, 15 bp, Homo sapiens
agtgcccaatattta

SEQ ID NO: 20217 - DNA, 15 bp, Homo sapiens
aagtgcccaatattt

SEQ ID NO: 20218 - DNA, 15 bp, Homo sapiens
gaagtgcccaatatt

SEQ ID NO: 20219 - DNA, 15 bp, Homo sapiens
tgaagtgcccaatat

SEQ ID NO: 20220 - DNA, 15 bp, Homo sapiens
ttgaagtgcccaata

SEQ ID NO: 20221 - DNA, 15 bp, Homo sapiens
attgaagtgcccaat

SEQ ID NO: 20222 - DNA, 15 bp, Homo sapiens
cattgaagtgcccaa

SEQ ID NO: 20223 - DNA, 15 bp, Homo sapiens
tcattgaagtgccca

SEQ ID NO: 20224 - DNA, 15 bp, Homo sapiens
gtcattgaagtgccc

SEQ ID NO: 20225 - DNA, 15 bp, Homo sapiens
ggtcattgaagtgcc

SEQ ID NO: 20226 - DNA, 15 bp, Homo sapiens
gggtcattgaagtgc

SEQ ID NO: 20227 - DNA, 15 bp, Homo sapiens
cgggtcattgaagtg

SEQ ID NO: 20228 - DNA, 15 bp, Homo sapiens
ccgggtcattgaagt

SEQ ID NO: 20229 - DNA, 15 bp, Homo sapiens
accgggtcattgaag

SEQ ID NO: 20230 - DNA, 15 bp, Homo sapiens
aaccgggtcattgaa

SEQ ID NO: 20231 - DNA, 15 bp, Homo sapiens
gaaccgggtcattga

SEQ ID NO: 20232 - DNA, 15 bp, Homo sapiens
tgaaccgggtcattg

SEQ ID NO: 20233 - DNA, 15 bp, Homo sapiens
atgaaccgggtcatt

SEQ ID NO: 20234 - DNA, 15 bp, Homo sapiens
catgaaccgggtcat

SEQ ID NO: 20235 - DNA, 15 bp, Homo sapiens
ccatgaaccgggtca

SEQ ID NO: 20236 - DNA, 15 bp, Homo sapiens
tccatgaaccgggtc

SEQ ID NO: 20237 - DNA, 15 bp, Homo sapiens
ctccatgaaccgggt

SEQ ID NO: 20238 - DNA, 15 bp, Homo sapiens
cctccatgaaccggg

SEQ ID NO: 20239 - DNA, 15 bp, Homo sapiens
ccctccatgaaccgg

SEQ ID NO: 20240 - DNA, 15 bp, Homo sapiens
accctccatgaaccg

SEQ ID NO: 20241 - DNA, 15 bp, Homo sapiens
gaccctccatgaacc

SEQ ID NO: 20242 - DNA, 15 bp, Homo sapiens
ggaccctccatgaac

SEQ ID NO: 20243 - DNA, 15 bp, Homo sapiens
aggaccctccatgaa

SEQ ID NO: 20244 - DNA, 15 bp, Homo sapiens
caggaccctccatga

SEQ ID NO: 20245 - DNA, 15 bp, Homo sapiens
ccaggaccctccatg

SEQ ID NO: 20246 - DNA, 15 bp, Homo sapiens
tccaggaccctccat

SEQ ID NO: 20247 - DNA, 15 bp, Homo sapiens
atccaggaccctcca

SEQ ID NO: 20248 - DNA, 15 bp, Homo sapiens
gatccaggaccctcc

SEQ ID NO: 20249 - DNA, 15 bp, Homo sapiens
tgatccaggaccctc

SEQ ID NO: 20250 - DNA, 15 bp, Homo sapiens
ctgatccaggaccct

SEQ ID NO: 20251 - DNA, 15 bp, Homo sapiens
tctgatccaggaccc

SEQ ID NO: 20252 - DNA, 15 bp, Homo sapiens
ctctgatccaggacc

SEQ ID NO: 20253 - DNA, 15 bp, Homo sapiens
cctctgatccaggac

SEQ ID NO: 20254 - DNA, 15 bp, Homo sapiens
acctctgatccagga

SEQ ID NO: 20255 - DNA, 15 bp, Homo sapiens
cacctctgatccagg

SEQ ID NO: 20256 - DNA, 15 bp, Homo sapiens
gcacctctgatccag

SEQ ID NO: 20257 - DNA, 15 bp, Homo sapiens
agcacctctgatcca

SEQ ID NO: 20258 - DNA, 15 bp, Homo sapiens
tagcacctctgatcc

SEQ ID NO: 20259 - DNA, 15 bp, Homo sapiens
atagcacctctgatc

SEQ ID NO: 20260 - DNA, 15 bp, Homo sapiens
aatagcacctctgat

SEQ ID NO: 20261 - DNA, 15 bp, Homo sapiens
aaatagcacctctga

SEQ ID NO: 20262 - DNA, 15 bp, Homo sapiens
taaatagcacctctg

SEQ ID NO: 20263 - DNA, 15 bp, Homo sapiens
gtaaatagcacctct

SEQ ID NO: 20264 - DNA, 15 bp, Homo sapiens
agtaaatagcacctc

SEQ ID NO: 20265 - DNA, 15 bp, Homo sapiens
tagtaaatagcacct

SEQ ID NO: 20266 - DNA, 15 bp, Homo sapiens
gtagtaaatagcacc

SEQ ID NO: 20267 - DNA, 15 bp, Homo sapiens
agtagtaaatagcac

SEQ ID NO: 20268 - DNA, 15 bp, Homo sapiens
aagtagtaaatagca

SEQ ID NO: 20269 - DNA, 15 bp, Homo sapiens
aaagtagtaaatagc

SEQ ID NO: 20270 - DNA, 15 bp, Homo sapiens
taaagtagtaaatag

SEQ ID NO: 20271 - DNA, 15 bp, Homo sapiens
ttaaagtagtaaata

SEQ ID NO: 20272 - DNA, 15 bp, Homo sapiens
tttaaagtagtaaat

SEQ ID NO: 20273 - DNA, 15 bp, Homo sapiens
ttttaaagtagtaaa

SEQ ID NO: 20274 - DNA, 15 bp, Homo sapiens
attttaaagtagtaa

SEQ ID NO: 20275 - DNA, 15 bp, Homo sapiens
aattttaaagtagta

SEQ ID NO: 20276 - DNA, 15 bp, Homo sapiens
caattttaaagtagt

SEQ ID NO: 20277 - DNA, 15 bp, Homo sapiens
gcaattttaaagtag

SEQ ID NO: 20278 - DNA, 15 bp, Homo sapiens
tgcaattttaaagta

SEQ ID NO: 20279 - DNA, 15 bp, Homo sapiens
ctgcaattttaaagt

SEQ ID NO: 20280 - DNA, 15 bp, Homo sapiens
actgcaattttaaag

SEQ ID NO: 20281 - DNA, 15 bp, Homo sapiens
cactgcaattttaaa

SEQ ID NO: 20282 - DNA, 15 bp, Homo sapiens
ccactgcaattttaa

SEQ ID NO: 20283 - DNA, 15 bp, Homo sapiens
gccactgcaatttta

SEQ ID NO: 20284 - DNA, 15 bp, Homo sapiens
ggccactgcaatttt

SEQ ID NO: 20285 - DNA, 15 bp, Homo sapiens
gggccactgcaattt

SEQ ID NO: 20286 - DNA, 15 bp, Homo sapiens
agggccactgcaatt

SEQ ID NO: 20287 - DNA, 15 bp, Homo sapiens
cagggccactgcaat

SEQ ID NO: 20288 - DNA, 15 bp, Homo sapiens
ccagggccactgcaa

SEQ ID NO: 20289 - DNA, 15 bp, Homo sapiens
gccagggccactgca

SEQ ID NO: 20290 - DNA, 15 bp, Homo sapiens
agccagggccactgc

SEQ ID NO: 20291 - DNA, 15 bp, Homo sapiens
cagccagggccactg

SEQ ID NO: 20292 - DNA, 15 bp, Homo sapiens
acagccagggccact

SEQ ID NO: 20293 - DNA, 15 bp, Homo sapiens
tacagccagggccac

SEQ ID NO: 20294 - DNA, 15 bp, Homo sapiens
ctacagccagggcca

SEQ ID NO: 20295 - DNA, 15 bp, Homo sapiens
gctacagccagggcc

SEQ ID NO: 20296 - DNA, 15 bp, Homo sapiens
tgctacagccagggc

SEQ ID NO: 20297 - DNA, 15 bp, Homo sapiens
ctgctacagccaggg

SEQ ID NO: 20298 - DNA, 15 bp, Homo sapiens
gctgctacagccagg

SEQ ID NO: 20299 - DNA, 15 bp, Homo sapiens
ggctgctacagccag

SEQ ID NO: 20300 - DNA, 15 bp, Homo sapiens
tggctgctacagcca

SEQ ID NO: 20301 - DNA, 15 bp, Homo sapiens
atggctgctacagcc

SEQ ID NO: 20302 - DNA, 15 bp, Homo sapiens
aatggctgctacagc

SEQ ID NO: 20303 - DNA, 15 bp, Homo sapiens
gaatggctgctacag

SEQ ID NO: 20304 - DNA, 15 bp, Homo sapiens
ggaatggctgctaca

SEQ ID NO: 20305 - DNA, 15 bp, Homo sapiens
aggaatggctgctac

SEQ ID NO: 20306 - DNA, 15 bp, Homo sapiens
caggaatggctgcta

SEQ ID NO: 20307 - DNA, 15 bp, Homo sapiens
tcaggaatggctgct

SEQ ID NO: 20308 - DNA, 15 bp, Homo sapiens
ttcaggaatggctgc

SEQ ID NO: 20309 - DNA, 15 bp, Homo sapiens
cttcaggaatggctg

SEQ ID NO: 20310 - DNA, 15 bp, Homo sapiens
ccttcaggaatggct

SEQ ID NO: 20311 - DNA, 15 bp, Homo sapiens
accttcaggaatggc

SEQ ID NO: 20312 - DNA, 15 bp, Homo sapiens
gaccttcaggaatgg

SEQ ID NO: 20313 - DNA, 15 bp, Homo sapiens
agaccttcaggaatg

SEQ ID NO: 20314 - DNA, 15 bp, Homo sapiens
cagaccttcaggaat

SEQ ID NO: 20315 - DNA, 15 bp, Homo sapiens
gcagaccttcaggaa

SEQ ID NO: 20316 - DNA, 15 bp, Homo sapiens
ggcagaccttcagga

SEQ ID NO: 20317 - DNA, 15 bp, Homo sapiens
aggcagaccttcagg

SEQ ID NO: 20318 - DNA, 15 bp, Homo sapiens
caggcagaccttcag

SEQ ID NO: 20319 - DNA, 15 bp, Homo sapiens
gcaggcagaccttca

SEQ ID NO: 20320 - DNA, 15 bp, Homo sapiens
tgcaggcagaccttc

SEQ ID NO: 20321 - DNA, 15 bp, Homo sapiens
ctgcaggcagacctt

SEQ ID NO: 20322 - DNA, 15 bp, Homo sapiens
actgcaggcagacct

SEQ ID NO: 20323 - DNA, 15 bp, Homo sapiens
gactgcaggcagacc

SEQ ID NO: 20324 - DNA, 15 bp, Homo sapiens
tgactgcaggcagac

SEQ ID NO: 20325 - DNA, 15 bp, Homo sapiens
atgactgcaggcaga

SEQ ID NO: 20326 - DNA, 15 bp, Homo sapiens
gatgactgcaggcag

SEQ ID NO: 20327 - DNA, 15 bp, Homo sapiens
tgatgactgcaggca

SEQ ID NO: 20328 - DNA, 15 bp, Homo sapiens
gtgatgactgcaggc

SEQ ID NO: 20329 - DNA, 15 bp, Homo sapiens
ggtgatgactgcagg

SEQ ID NO: 20330 - DNA, 15 bp, Homo sapiens
tggtgatgactgcag

SEQ ID NO: 20331 - DNA, 15 bp, Homo sapiens
gtggtgatgactgca

SEQ ID NO: 20332 - DNA, 15 bp, Homo sapiens
ggtggtgatgactgc

SEQ ID NO: 20333 - DNA, 15 bp, Homo sapiens
aggtggtgatgactg

SEQ ID NO: 20334 - DNA, 15 bp, Homo sapiens
caggtggtgatgact

SEQ ID NO: 20335 - DNA, 15 bp, Homo sapiens
gcaggtggtgatgac

SEQ ID NO: 20336 - DNA, 15 bp, Homo sapiens
ggcaggtggtgatga

SEQ ID NO: 20337 - DNA, 15 bp, Homo sapiens
aggcaggtggtgatg

SEQ ID NO: 20338 - DNA, 15 bp, Homo sapiens
caggcaggtggtgat

SEQ ID NO: 20339 - DNA, 15 bp, Homo sapiens
ccaggcaggtggtga

SEQ ID NO: 20340 - DNA, 15 bp, Homo sapiens
gccaggcaggtggtg

SEQ ID NO: 20341 - DNA, 15 bp, Homo sapiens
agccaggcaggtggt

SEQ ID NO: 20342 - DNA, 15 bp, Homo sapiens
gagccaggcaggtgg

SEQ ID NO: 20343 - DNA, 15 bp, Homo sapiens
agagccaggcaggtg

SEQ ID NO: 20344 - DNA, 15 bp, Homo sapiens
aagagccaggcaggt

SEQ ID NO: 20345 - DNA, 15 bp, Homo sapiens
caagagccaggcagg

SEQ ID NO: 20346 - DNA, 15 bp, Homo sapiens
ccaagagccaggcag

SEQ ID NO: 20347 - DNA, 15 bp, Homo sapiens
tccaagagccaggca

SEQ ID NO: 20348 - DNA, 15 bp, Homo sapiens
ttccaagagccaggc

SEQ ID NO: 20349 - DNA, 15 bp, Homo sapiens
gttccaagagccagg

SEQ ID NO: 20350 - DNA, 15 bp, Homo sapiens
agttccaagagccag

SEQ ID NO: 20351 - DNA, 15 bp, Homo sapiens
gagttccaagagcca

SEQ ID NO: 20352 - DNA, 15 bp, Homo sapiens
cgagttccaagagcc

SEQ ID NO: 20353 - DNA, 15 bp, Homo sapiens
gcgagttccaagagc

SEQ ID NO: 20354 - DNA, 15 bp, Homo sapiens
tgcgagttccaagag

SEQ ID NO: 20355 - DNA, 15 bp, Homo sapiens
ctgcgagttccaaga

SEQ ID NO: 20356 - DNA, 15 bp, Homo sapiens
tctgcgagttccaag

SEQ ID NO: 20357 - DNA, 15 bp, Homo sapiens
ttctgcgagttccaa

SEQ ID NO: 20358 - DNA, 15 bp, Homo sapiens
attctgcgagttcca

SEQ ID NO: 20359 - DNA, 15 bp, Homo sapiens
cattctgcgagttcc

SEQ ID NO: 20360 - DNA, 15 bp, Homo sapiens
ccattctgcgagttc

SEQ ID NO: 20361 - DNA, 15 bp, Homo sapiens
gccattctgcgagtt

SEQ ID NO: 20362 - DNA, 15 bp, Homo sapiens
tgccattctgcgagt

SEQ ID NO: 20363 - DNA, 15 bp, Homo sapiens
ttgccattctgcgag

SEQ ID NO: 20364 - DNA, 15 bp, Homo sapiens
tttgccattctgcga

SEQ ID NO: 20365 - DNA, 15 bp, Homo sapiens
ctttgccattctgcg

SEQ ID NO: 20366 - DNA, 15 bp, Homo sapiens
tctttgccattctgc

SEQ ID NO: 20367 - DNA, 15 bp, Homo sapiens
ttctttgccattctg

SEQ ID NO: 20368 - DNA, 15 bp, Homo sapiens
tttctttgccattct

SEQ ID NO: 20369 - DNA, 15 bp, Homo sapiens
ttttctttgccattc

SEQ ID NO: 20370 - DNA, 15 bp, Homo sapiens
tttttctttgccatt

SEQ ID NO: 20371 - DNA, 15 bp, Homo sapiens
atttttctttgccat

SEQ ID NO: 20372 - DNA, 15 bp, Homo sapiens
catttttctttgcca

SEQ ID NO: 20373 - DNA, 15 bp, Homo sapiens
gcatttttctttgcc

SEQ ID NO: 20374 - DNA, 15 bp, Homo sapiens
ggcatttttctttgc

SEQ ID NO: 20375 - DNA, 15 bp, Homo sapiens
tggcatttttctttg

SEQ ID NO: 20376 - DNA, 15 bp, Homo sapiens
atggcatttttcttt

SEQ ID NO: 20377 - DNA, 15 bp, Homo sapiens
aatggcatttttctt

SEQ ID NO: 20378 - DNA, 15 bp, Homo sapiens
caatggcatttttct

SEQ ID NO: 20379 - DNA, 15 bp, Homo sapiens
acaatggcatttttc

SEQ ID NO: 20380 - DNA, 15 bp, Homo sapiens
aacaatggcattttt

SEQ ID NO: 20381 - DNA, 15 bp, Homo sapiens
gaacaatggcatttt

SEQ ID NO: 20382 - DNA, 15 bp, Homo sapiens
cgaacaatggcattt

SEQ ID NO: 20383 - DNA, 15 bp, Homo sapiens
tcgaacaatggcatt

SEQ ID NO: 20384 - DNA, 15 bp, Homo sapiens
ttcgaacaatggcat

SEQ ID NO: 20385 - DNA, 15 bp, Homo sapiens
cttcgaacaatggca

SEQ ID NO: 20386 - DNA, 15 bp, Homo sapiens
gcttcgaacaatggc

SEQ ID NO: 20387 - DNA, 15 bp, Homo sapiens
ggcttcgaacaatgg

SEQ ID NO: 20388 - DNA, 15 bp, Homo sapiens
aggcttcgaacaatg

SEQ ID NO: 20389 - DNA, 15 bp, Homo sapiens
gaggcttcgaacaat

SEQ ID NO: 20390 - DNA, 15 bp, Homo sapiens
ggaggcttcgaacaa

SEQ ID NO: 20391 - DNA, 15 bp, Homo sapiens
gggaggcttcgaaca

SEQ ID NO: 20392 - DNA, 15 bp, Homo sapiens
cgggaggcttcgaac

SEQ ID NO: 20393 - DNA, 15 bp, Homo sapiens
acgggaggcttcgaa

SEQ ID NO: 20394 - DNA, 15 bp, Homo sapiens
gacgggaggcttcga

SEQ ID NO: 20395 - DNA, 15 bp, Homo sapiens
agacgggaggcttcg

SEQ ID NO: 20396 - DNA, 15 bp, Homo sapiens
cagacgggaggcttc

SEQ ID NO: 20397 - DNA, 15 bp, Homo sapiens
acagacgggaggctt

SEQ ID NO: 20398 - DNA, 15 bp, Homo sapiens
cacagacgggaggct

SEQ ID NO: 20399 - DNA, 15 bp, Homo sapiens
ccacagacgggaggc

SEQ ID NO: 20400 - DNA, 15 bp, Homo sapiens
tccacagacgggagg

SEQ ID NO: 20401 - DNA, 15 bp, Homo sapiens
ttccacagacgggag

SEQ ID NO: 20402 - DNA, 15 bp, Homo sapiens
tttccacagacggga

SEQ ID NO: 20403 - DNA, 15 bp, Homo sapiens
gtttccacagacggg

SEQ ID NO: 20404 - DNA, 15 bp, Homo sapiens
ggtttccacagacgg

SEQ ID NO: 20405 - DNA, 15 bp, Homo sapiens
gggtttccacagacg

SEQ ID NO: 20406 - DNA, 15 bp, Homo sapiens
agggtttccacagac

SEQ ID NO: 20407 - DNA, 15 bp, Homo sapiens
aagggtttccacaga

SEQ ID NO: 20408 - DNA, 15 bp, Homo sapiens
caagggtttccacag

SEQ ID NO: 20409 - DNA, 15 bp, Homo sapiens
ccaagggtttccaca

SEQ ID NO: 20410 - DNA, 15 bp, Homo sapiens
accaagggtttccac

SEQ ID NO: 20411 - DNA, 15 bp, Homo sapiens
aaccaagggtttcca

SEQ ID NO: 20412 - DNA, 15 bp, Homo sapiens
caaccaagggtttcc

SEQ ID NO: 20413 - DNA, 15 bp, Homo sapiens
acaaccaagggtttc

SEQ ID NO: 20414 - DNA, 15 bp, Homo sapiens
tacaaccaagggttt

SEQ ID NO: 20415 - DNA, 15 bp, Homo sapiens
gtacaaccaagggtt

SEQ ID NO: 20416 - DNA, 15 bp, Homo sapiens
agtacaaccaagggt

SEQ ID NO: 20417 - DNA, 15 bp, Homo sapiens
aagtacaaccaaggg

SEQ ID NO: 20418 - DNA, 15 bp, Homo sapiens
gaagtacaaccaagg

SEQ ID NO: 20419 - DNA, 15 bp, Homo sapiens
agaagtacaaccaag

SEQ ID NO: 20420 - DNA, 15 bp, Homo sapiens
cagaagtacaaccaa

SEQ ID NO: 20421 - DNA, 15 bp, Homo sapiens
acagaagtacaacca

SEQ ID NO: 20422 - DNA, 15 bp, Homo sapiens
aacagaagtacaacc

SEQ ID NO: 20423 - DNA, 15 bp, Homo sapiens
taacagaagtacaac

SEQ ID NO: 20424 - DNA, 15 bp, Homo sapiens
ataacagaagtacaa

SEQ ID NO: 20425 - DNA, 15 bp, Homo sapiens
gataacagaagtaca

SEQ ID NO: 20426 - DNA, 15 bp, Homo sapiens
agataacagaagtac

SEQ ID NO: 20427 - DNA, 15 bp, Homo sapiens
cagataacagaagta

SEQ ID NO: 20428 - DNA, 15 bp, Homo sapiens
gcagataacagaagt

SEQ ID NO: 20429 - DNA, 15 bp, Homo sapiens
agcagataacagaag

SEQ ID NO: 20430 - DNA, 15 bp, Homo sapiens
gagcagataacagaa

SEQ ID NO: 20431 - DNA, 15 bp, Homo sapiens
tgagcagataacaga

SEQ ID NO: 20432 - DNA, 15 bp, Homo sapiens
ctgagcagataacag

SEQ ID NO: 20433 - DNA, 15 bp, Homo sapiens
tctgagcagataaca

SEQ ID NO: 20434 - DNA, 15 bp, Homo sapiens
gtctgagcagataac

SEQ ID NO: 20435 - DNA, 15 bp, Homo sapiens
tgtctgagcagataa

SEQ ID NO: 20436 - DNA, 15 bp, Homo sapiens
ttgtctgagcagata

SEQ ID NO: 20437 - DNA, 15 bp, Homo sapiens
cttgtctgagcagat

SEQ ID NO: 20438 - DNA, 15 bp, Homo sapiens
tcttgtctgagcaga

SEQ ID NO: 20439 - DNA, 15 bp, Homo sapiens
gtcttgtctgagcag

SEQ ID NO: 20440 - DNA, 15 bp, Homo sapiens
agtcttgtctgagca

SEQ ID NO: 20441 - DNA, 15 bp, Homo sapiens
cagtcttgtctgagc

SEQ ID NO: 20442 - DNA, 15 bp, Homo sapiens
ccagtcttgtctgag

SEQ ID NO: 20443 - DNA, 15 bp, Homo sapiens
accagtcttgtctga

SEQ ID NO: 20444 - DNA, 15 bp, Homo sapiens
taccagtcttgtctg

SEQ ID NO: 20445 - DNA, 15 bp, Homo sapiens
gtaccagtcttgtct

SEQ ID NO: 20446 - DNA, 15 bp, Homo sapiens
tgtaccagtcttgtc

SEQ ID NO: 20447 - DNA, 15 bp, Homo sapiens
gtgtaccagtcttgt

SEQ ID NO: 20448 - DNA, 15 bp, Homo sapiens
agtgtaccagtcttg

SEQ ID NO: 20449 - DNA, 15 bp, Homo sapiens
aagtgtaccagtctt

SEQ ID NO: 20450 - DNA, 15 bp, Homo sapiens
taagtgtaccagtct

SEQ ID NO: 20451 - DNA, 15 bp, Homo sapiens
gtaagtgtaccagtc

SEQ ID NO: 20452 - DNA, 15 bp, Homo sapiens
tgtaagtgtaccagt

SEQ ID NO: 20453 - DNA, 15 bp, Homo sapiens
ttgtaagtgtaccag

SEQ ID NO: 20454 - DNA, 15 bp, Homo sapiens
gttgtaagtgtacca

SEQ ID NO: 20455 - DNA, 15 bp, Homo sapiens
tgttgtaagtgtacc

SEQ ID NO: 20456 - DNA, 15 bp, Homo sapiens
ttgttgtaagtgtac

SEQ ID NO: 20457 - DNA, 15 bp, Homo sapiens
tttgttgtaagtgta

SEQ ID NO: 20458 - DNA, 15 bp, Homo sapiens
gtttgttgtaagtgt

SEQ ID NO: 20459 - DNA, 15 bp, Homo sapiens
ggtttgttgtaagtg

SEQ ID NO: 20460 - DNA, 15 bp, Homo sapiens
tggtttgttgtaagt

SEQ ID NO: 20461 - DNA, 15 bp, Homo sapiens
ctggtttgttgtaag

SEQ ID NO: 20462 - DNA, 15 bp, Homo sapiens
tctggtttgttgtaa

SEQ ID NO: 20463 - DNA, 15 bp, Homo sapiens
atctggtttgttgta

SEQ ID NO: 20464 - DNA, 15 bp, Homo sapiens
catctggtttgttgt

SEQ ID NO: 20465 - DNA, 15 bp, Homo sapiens
acatctggtttgttg

SEQ ID NO: 20466 - DNA, 15 bp, Homo sapiens
gacatctggtttgtt

SEQ ID NO: 20467 - DNA, 15 bp, Homo sapiens
tgacatctggtttgt

SEQ ID NO: 20468 - DNA, 15 bp, Homo sapiens
ctgacatctggtttg

SEQ ID NO: 20469 - DNA, 15 bp, Homo sapiens
actgacatctggttt

SEQ ID NO: 20470 - DNA, 15 bp, Homo sapiens
gactgacatctggtt

SEQ ID NO: 20471 - DNA, 15 bp, Homo sapiens
agactgacatctggt

SEQ ID NO: 20472 - DNA, 15 bp, Homo sapiens
cagactgacatctgg

SEQ ID NO: 20473 - DNA, 15 bp, Homo sapiens
gcagactgacatctg

SEQ ID NO: 20474 - DNA, 15 bp, Homo sapiens
tgcagactgacatct

SEQ ID NO: 20475 - DNA, 15 bp, Homo sapiens
ctgcagactgacatc

SEQ ID NO: 20476 - DNA, 15 bp, Homo sapiens
cctgcagactgacat

SEQ ID NO: 20477 - DNA, 15 bp, Homo sapiens
ccctgcagactgaca

SEQ ID NO: 20478 - DNA, 15 bp, Homo sapiens
accctgcagactgac

SEQ ID NO: 20479 - DNA, 15 bp, Homo sapiens
taccctgcagactga

SEQ ID NO: 20480 - DNA, 15 bp, Homo sapiens
ttaccctgcagactg

SEQ ID NO: 20481 - DNA, 15 bp, Homo sapiens
cttaccctgcagact

SEQ ID NO: 20482 - DNA, 15 bp, Homo sapiens
tcttaccctgcagac

SEQ ID NO: 20483 - DNA, 15 bp, Homo sapiens
ctcttaccctgcaga

SEQ ID NO: 20484 - DNA, 15 bp, Homo sapiens
cctcttaccctgcag

SEQ ID NO: 20485 - DNA, 15 bp, Homo sapiens
tcctcttaccctgca

SEQ ID NO: 20486 - DNA, 15 bp, Homo sapiens
ctcctcttaccctgc

SEQ ID NO: 20487 - DNA, 15 bp, Homo sapiens
actcctcttaccctg

SEQ ID NO: 20488 - DNA, 15 bp, Homo sapiens
tactcctcttaccct

SEQ ID NO: 20489 - DNA, 15 bp, Homo sapiens
ttactcctcttaccc

SEQ ID NO: 20490 - DNA, 15 bp, Homo sapiens
attactcctcttacc

SEQ ID NO: 20491 - DNA, 15 bp, Homo sapiens
aattactcctcttac

SEQ ID NO: 20492 - DNA, 15 bp, Homo sapiens
aaattactcctctta

SEQ ID NO: 20493 - DNA, 15 bp, Homo sapiens
taaattactcctctt

SEQ ID NO: 20494 - DNA, 15 bp, Homo sapiens
ctaaattactcctct

SEQ ID NO: 20495 - DNA, 15 bp, Homo sapiens
tctaaattactcctc

SEQ ID NO: 20496 - DNA, 15 bp, Homo sapiens
ttctaaattactcct

SEQ ID NO: 20497 - DNA, 15 bp, Homo sapiens
attctaaattactcc

SEQ ID NO: 20498 - DNA, 15 bp, Homo sapiens
tattctaaattactc

SEQ ID NO: 20499 - DNA, 15 bp, Homo sapiens
atattctaaattact

SEQ ID NO: 20500 - DNA, 15 bp, Homo sapiens
aatattctaaattac

SEQ ID NO: 20501 - DNA, 15 bp, Homo sapiens
gaatattctaaatta

SEQ ID NO: 20502 - DNA, 15 bp, Homo sapiens
ggaatattctaaatt

SEQ ID NO: 20503 - DNA, 15 bp, Homo sapiens
cggaatattctaaat

SEQ ID NO: 20504 - DNA, 15 bp, Homo sapiens
acggaatattctaaa

SEQ ID NO: 20505 - DNA, 15 bp, Homo sapiens
cacggaatattctaa

SEQ ID NO: 20506 - DNA, 15 bp, Homo sapiens
acacggaatattcta

SEQ ID NO: 20507 - DNA, 15 bp, Homo sapiens
gacacggaatattct

SEQ ID NO: 20508 - DNA, 15 bp, Homo sapiens
cgacacggaatattc

SEQ ID NO: 20509 - DNA, 15 bp, Homo sapiens
acgacacggaatatt

SEQ ID NO: 20510 - DNA, 15 bp, Homo sapiens
cacgacacggaatat

SEQ ID NO: 20511 - DNA, 15 bp, Homo sapiens
ccacgacacggaata

SEQ ID NO: 20512 - DNA, 15 bp, Homo sapiens
accacgacacggaat

SEQ ID NO: 20513 - DNA, 15 bp, Homo sapiens
aaccacgacacggaa

SEQ ID NO: 20514 - DNA, 15 bp, Homo sapiens
gaaccacgacacgga

SEQ ID NO: 20515 - DNA, 15 bp, Homo sapiens
agaaccacgacacgg

SEQ ID NO: 20516 - DNA, 15 bp, Homo sapiens
aagaaccacgacacg

SEQ ID NO: 20517 - DNA, 15 bp, Homo sapiens
aaagaaccacgacac

SEQ ID NO: 20518 - DNA, 15 bp, Homo sapiens
caaagaaccacgaca

SEQ ID NO: 20519 - DNA, 15 bp, Homo sapiens
acaaagaaccacgac

SEQ ID NO: 20520 - DNA, 15 bp, Homo sapiens
aacaaagaaccacga

SEQ ID NO: 20521 - DNA, 15 bp, Homo sapiens
gaacaaagaaccacg

SEQ ID NO: 20522 - DNA, 15 bp, Homo sapiens
tgaacaaagaaccac

SEQ ID NO: 20523 - DNA, 15 bp, Homo sapiens
atgaacaaagaacca

SEQ ID NO: 20524 - DNA, 15 bp, Homo sapiens
gatgaacaaagaacc

SEQ ID NO: 20525 - DNA, 15 bp, Homo sapiens
ggatgaacaaagaac

SEQ ID NO: 20526 - DNA, 15 bp, Homo sapiens
aggatgaacaaagaa

SEQ ID NO: 20527 - DNA, 15 bp, Homo sapiens
taggatgaacaaaga

SEQ ID NO: 20528 - DNA, 15 bp, Homo sapiens
gtaggatgaacaaag

SEQ ID NO: 20529 - DNA, 15 bp, Homo sapiens
ggtaggatgaacaaa

SEQ ID NO: 20530 - DNA, 15 bp, Homo sapiens
tggtaggatgaacaa

SEQ ID NO: 20531 - DNA, 15 bp, Homo sapiens
ttggtaggatgaaca

SEQ ID NO: 20532 - DNA, 15 bp, Homo sapiens
attggtaggatgaac

SEQ ID NO: 20533 - DNA, 15 bp, Homo sapiens
tattggtaggatgaa

SEQ ID NO: 20534 - DNA, 15 bp, Homo sapiens
atattggtaggatga

SEQ ID NO: 20535 - DNA, 15 bp, Homo sapiens
catattggtaggatg

SEQ ID NO: 20536 - DNA, 15 bp, Homo sapiens
gcatattggtaggat

SEQ ID NO: 20537 - DNA, 15 bp, Homo sapiens
ggcatattggtagga

SEQ ID NO: 20538 - DNA, 15 bp, Homo sapiens
aggcatattggtagg

SEQ ID NO: 20539 - DNA, 15 bp, Homo sapiens
aaggcatattggtag

SEQ ID NO: 20540 - DNA, 15 bp, Homo sapiens
gaaggcatattggta

SEQ ID NO: 20541 - DNA, 15 bp, Homo sapiens
tgaaggcatattggt

SEQ ID NO: 20542 - DNA, 15 bp, Homo sapiens
atgaaggcatattgg

SEQ ID NO: 20543 - DNA, 15 bp, Homo sapiens
catgaaggcatattg

SEQ ID NO: 20544 - DNA, 15 bp, Homo sapiens
gcatgaaggcatatt

SEQ ID NO: 20545 - DNA, 15 bp, Homo sapiens
ggcatgaaggcatat

SEQ ID NO: 20546 - DNA, 15 bp, Homo sapiens
tggcatgaaggcata

SEQ ID NO: 20547 - DNA, 15 bp, Homo sapiens
atggcatgaaggcat

SEQ ID NO: 20548 - DNA, 15 bp, Homo sapiens
gatggcatgaaggca

SEQ ID NO: 20549 - DNA, 15 bp, Homo sapiens
tgatggcatgaaggc

SEQ ID NO: 20550 - DNA, 15 bp, Homo sapiens
ttgatggcatgaagg

SEQ ID NO: 20551 - DNA, 15 bp, Homo sapiens
tttgatggcatgaag

SEQ ID NO: 20552 - DNA, 15 bp, Homo sapiens
ttttgatggcatgaa

SEQ ID NO: 20553 - DNA, 15 bp, Homo sapiens
gttttgatggcatga

SEQ ID NO: 20554 - DNA, 15 bp, Homo sapiens
agttttgatggcatg

SEQ ID NO: 20555 - DNA, 15 bp, Homo sapiens
aagttttgatggcat

SEQ ID NO: 20556 - DNA, 15 bp, Homo sapiens
aaagttttgatggca

SEQ ID NO: 20557 - DNA, 15 bp, Homo sapiens
aaaagttttgatggc

SEQ ID NO: 20558 - DNA, 15 bp, Homo sapiens
caaaagttttgatgg

SEQ ID NO: 20559 - DNA, 15 bp, Homo sapiens
tcaaaagttttgatg

SEQ ID NO: 20560 - DNA, 15 bp, Homo sapiens
atcaaaagttttgat

SEQ ID NO: 20561 - DNA, 15 bp, Homo sapiens
aatcaaaagttttga

SEQ ID NO: 20562 - DNA, 15 bp, Homo sapiens
aaatcaaaagttttg

SEQ ID NO: 20563 - DNA, 15 bp, Homo sapiens
caaatcaaaagtttt

SEQ ID NO: 20564 - DNA, 15 bp, Homo sapiens
acaaatcaaaagttt

SEQ ID NO: 20565 - DNA, 15 bp, Homo sapiens
tacaaatcaaaagtt

SEQ ID NO: 20566 - DNA, 15 bp, Homo sapiens
ttacaaatcaaaagt

SEQ ID NO: 20567 - DNA, 15 bp, Homo sapiens
attacaaatcaaaag

SEQ ID NO: 20568 - DNA, 15 bp, Homo sapiens
aattacaaatcaaaa

SEQ ID NO: 20569 - DNA, 15 bp, Homo sapiens
aaattacaaatcaaa

SEQ ID NO: 20570 - DNA, 15 bp, Homo sapiens
gaaattacaaatcaa

SEQ ID NO: 20571 - DNA, 15 bp, Homo sapiens
tgaaattacaaatca

SEQ ID NO: 20572 - DNA, 15 bp, Homo sapiens
atgaaattacaaatc

SEQ ID NO: 20573 - DNA, 15 bp, Homo sapiens
tatgaaattacaaat

SEQ ID NO: 20574 - DNA, 15 bp, Homo sapiens
gtatgaaattacaaa

SEQ ID NO: 20575 - DNA, 15 bp, Homo sapiens
tgtatgaaattacaa

SEQ ID NO: 20576 - DNA, 15 bp, Homo sapiens
atgtatgaaattaca

SEQ ID NO: 20577 - DNA, 15 bp, Homo sapiens
aatgtatgaaattac

SEQ ID NO: 20578 - DNA, 15 bp, Homo sapiens
aaatgtatgaaatta

SEQ ID NO: 20579 - DNA, 15 bp, Homo sapiens
gaaatgtatgaaatt

SEQ ID NO: 20580 - DNA, 15 bp, Homo sapiens
agaaatgtatgaaat

SEQ ID NO: 20581 - DNA, 15 bp, Homo sapiens
cagaaatgtatgaaa

SEQ ID NO: 20582 - DNA, 15 bp, Homo sapiens
acagaaatgtatgaa

SEQ ID NO: 20583 - DNA, 15 bp, Homo sapiens
cacagaaatgtatga

SEQ ID NO: 20584 - DNA, 15 bp, Homo sapiens
ccacagaaatgtatg

SEQ ID NO: 20585 - DNA, 15 bp, Homo sapiens
cccacagaaatgtat

SEQ ID NO: 20586 - DNA, 15 bp, Homo sapiens
gcccacagaaatgta

SEQ ID NO: 20587 - DNA, 15 bp, Homo sapiens
agcccacagaaatgt

SEQ ID NO: 20588 - DNA, 15 bp, Homo sapiens
cagcccacagaaatg

SEQ ID NO: 20589 - DNA, 15 bp, Homo sapiens
acagcccacagaaat

SEQ ID NO: 20590 - DNA, 15 bp, Homo sapiens
tacagcccacagaaa

SEQ ID NO: 20591 - DNA, 15 bp, Homo sapiens
atacagcccacagaa

SEQ ID NO: 20592 - DNA, 15 bp, Homo sapiens
catacagcccacaga

SEQ ID NO: 20593 - DNA, 15 bp, Homo sapiens
acatacagcccacag

SEQ ID NO: 20594 - DNA, 15 bp, Homo sapiens
tacatacagcccaca

SEQ ID NO: 20595 - DNA, 15 bp, Homo sapiens
atacatacagcccac

SEQ ID NO: 20596 - DNA, 15 bp, Homo sapiens
tatacatacagccca

SEQ ID NO: 20597 - DNA, 15 bp, Homo sapiens
ctatacatacagccc

SEQ ID NO: 20598 - DNA, 15 bp, Homo sapiens
gctatacatacagcc

SEQ ID NO: 20599 - DNA, 15 bp, Homo sapiens
ggctatacatacagc

SEQ ID NO: 20600 - DNA, 15 bp, Homo sapiens
aggctatacatacag

SEQ ID NO: 20601 - DNA, 15 bp, Homo sapiens
caggctatacataca

SEQ ID NO: 20602 - DNA, 15 bp, Homo sapiens
tcaggctatacatac

SEQ ID NO: 20603 - DNA, 15 bp, Homo sapiens
ctcaggctatacata

SEQ ID NO: 20604 - DNA, 15 bp, Homo sapiens
gctcaggctatacat

SEQ ID NO: 20605 - DNA, 15 bp, Homo sapiens
agctcaggctataca

SEQ ID NO: 20606 - DNA, 15 bp, Homo sapiens
aagctcaggctatac

SEQ ID NO: 20607 - DNA, 15 bp, Homo sapiens
taagctcaggctata

SEQ ID NO: 20608 - DNA, 15 bp, Homo sapiens
ttaagctcaggctat

SEQ ID NO: 20609 - DNA, 15 bp, Homo sapiens
attaagctcaggcta

SEQ ID NO: 20610 - DNA, 15 bp, Homo sapiens
aattaagctcaggct

SEQ ID NO: 20611 - DNA, 15 bp, Homo sapiens
aaattaagctcaggc

SEQ ID NO: 20612 - DNA, 15 bp, Homo sapiens
gaaattaagctcagg

SEQ ID NO: 20613 - DNA, 15 bp, Homo sapiens
agaaattaagctcag

SEQ ID NO: 20614 - DNA, 15 bp, Homo sapiens
tagaaattaagctca

SEQ ID NO: 20615 - DNA, 15 bp, Homo sapiens
ttagaaattaagctc

SEQ ID NO: 20616 - DNA, 15 bp, Homo sapiens
attagaaattaagct

SEQ ID NO: 20617 - DNA, 15 bp, Homo sapiens
tattagaaattaagc

SEQ ID NO: 20618 - DNA, 15 bp, Homo sapiens
atattagaaattaag

SEQ ID NO: 20619 - DNA, 15 bp, Homo sapiens
aatattagaaattaa

SEQ ID NO: 20620 - DNA, 15 bp, Homo sapiens
aaatattagaaatta

SEQ ID NO: 20621 - DNA, 15 bp, Homo sapiens
caaatattagaaatt

SEQ ID NO: 20622 - DNA, 15 bp, Homo sapiens
tcaaatattagaaat

SEQ ID NO: 20623 - DNA, 15 bp, Homo sapiens
ctcaaatattagaaa

SEQ ID NO: 20624 - DNA, 15 bp, Homo sapiens
tctcaaatattagaa

SEQ ID NO: 20625 - DNA, 15 bp, Homo sapiens
ctctcaaatattaga

SEQ ID NO: 20626 - DNA, 15 bp, Homo sapiens
cctctcaaatattag

SEQ ID NO: 20627 - DNA, 15 bp, Homo sapiens
tcctctcaaatatta

SEQ ID NO: 20628 - DNA, 15 bp, Homo sapiens
atcctctcaaatatt

SEQ ID NO: 20629 - DNA, 15 bp, Homo sapiens
gatcctctcaaatat

SEQ ID NO: 20630 - DNA, 15 bp, Homo sapiens
agatcctctcaaata

SEQ ID NO: 20631 - DNA, 15 bp, Homo sapiens
tagatcctctcaaat

SEQ ID NO: 20632 - DNA, 15 bp, Homo sapiens
ttagatcctctcaaa

SEQ ID NO: 20633 - DNA, 15 bp, Homo sapiens
attagatcctctcaa

SEQ ID NO: 20634 - DNA, 15 bp, Homo sapiens
gattagatcctctca

SEQ ID NO: 20635 - DNA, 15 bp, Homo sapiens
tgattagatcctctc

SEQ ID NO: 20636 - DNA, 15 bp, Homo sapiens
atgattagatcctct

SEQ ID NO: 20637 - DNA, 15 bp, Homo sapiens
aatgattagatcctc

SEQ ID NO: 20638 - DNA, 15 bp, Homo sapiens
aaatgattagatcct

SEQ ID NO: 20639 - DNA, 15 bp, Homo sapiens
taaatgattagatcc

SEQ ID NO: 20640 - DNA, 15 bp, Homo sapiens
ttaaatgattagatc

SEQ ID NO: 20641 - DNA, 15 bp, Homo sapiens
attaaatgattagat

SEQ ID NO: 20642 - DNA, 15 bp, Homo sapiens
aattaaatgattaga

SEQ ID NO: 20643 - DNA, 15 bp, Homo sapiens
gaattaaatgattag

SEQ ID NO: 20644 - DNA, 15 bp, Homo sapiens
ggaattaaatgatta

SEQ ID NO: 20645 - DNA, 15 bp, Homo sapiens
aggaattaaatgatt

SEQ ID NO: 20646 - DNA, 15 bp, Homo sapiens
taggaattaaatgat

SEQ ID NO: 20647 - DNA, 15 bp, Homo sapiens
ttaggaattaaatga

SEQ ID NO: 20648 - DNA, 15 bp, Homo sapiens
tttaggaattaaatg

SEQ ID NO: 20649 - DNA, 15 bp, Homo sapiens
ttttaggaattaaat

SEQ ID NO: 20650 - DNA, 15 bp, Homo sapiens
gttttaggaattaaa

SEQ ID NO: 20651 - DNA, 15 bp, Homo sapiens
agttttaggaattaa

SEQ ID NO: 20652 - DNA, 15 bp, Homo sapiens
aagttttaggaatta

SEQ ID NO: 20653 - DNA, 15 bp, Homo sapiens
aaagttttaggaatt

SEQ ID NO: 20654 - DNA, 15 bp, Homo sapiens
gaaagttttaggaat

SEQ ID NO: 20655 - DNA, 15 bp, Homo sapiens
tgaaagttttaggaa

SEQ ID NO: 20656 - DNA, 15 bp, Homo sapiens
gtgaaagttttagga

SEQ ID NO: 20657 - DNA, 15 bp, Homo sapiens
tgtgaaagttttagg

SEQ ID NO: 20658 - DNA, 15 bp, Homo sapiens
ttgtgaaagttttag

SEQ ID NO: 20659 - DNA, 15 bp, Homo sapiens
tttgtgaaagtttta

SEQ ID NO: 20660 - DNA, 15 bp, Homo sapiens
ttttgtgaaagtttt

SEQ ID NO: 20661 - DNA, 15 bp, Homo sapiens
attttgtgaaagttt

SEQ ID NO: 20662 - DNA, 15 bp, Homo sapiens
tattttgtgaaagtt

SEQ ID NO: 20663 - DNA, 15 bp, Homo sapiens
gtattttgtgaaagt

SEQ ID NO: 20664 - DNA, 15 bp, Homo sapiens
tgtattttgtgaaag

SEQ ID NO: 20665 - DNA, 15 bp, Homo sapiens
ctgtattttgtgaaa

SEQ ID NO: 20666 - DNA, 15 bp, Homo sapiens
cctgtattttgtgaa

SEQ ID NO: 20667 - DNA, 15 bp, Homo sapiens
tcctgtattttgtga

SEQ ID NO: 20668 - DNA, 15 bp, Homo sapiens
atcctgtattttgtg

SEQ ID NO: 20669 - DNA, 15 bp, Homo sapiens
tatcctgtattttgt

SEQ ID NO: 20670 - DNA, 15 bp, Homo sapiens
atatcctgtattttg

SEQ ID NO: 20671 - DNA, 15 bp, Homo sapiens
gatatcctgtatttt

SEQ ID NO: 20672 - DNA, 15 bp, Homo sapiens
agatatcctgtattt

SEQ ID NO: 20673 - DNA, 15 bp, Homo sapiens
cagatatcctgtatt

SEQ ID NO: 20674 - DNA, 15 bp, Homo sapiens
acagatatcctgtat

SEQ ID NO: 20675 - DNA, 15 bp, Homo sapiens
tacagatatcctgta

SEQ ID NO: 20676 - DNA, 15 bp, Homo sapiens
atacagatatcctgt

SEQ ID NO: 20677 - DNA, 15 bp, Homo sapiens
catacagatatcctg

SEQ ID NO: 20678 - DNA, 15 bp, Homo sapiens
ccatacagatatcct

SEQ ID NO: 20679 - DNA, 15 bp, Homo sapiens
gccatacagatatcc

SEQ ID NO: 20680 - DNA, 15 bp, Homo sapiens
agccatacagatatc

SEQ ID NO: 20681 - DNA, 15 bp, Homo sapiens
cagccatacagatat

SEQ ID NO: 20682 - DNA, 15 bp, Homo sapiens
tcagccatacagata

SEQ ID NO: 20683 - DNA, 15 bp, Homo sapiens
atcagccatacagat

SEQ ID NO: 20684 - DNA, 15 bp, Homo sapiens
tatcagccatacaga

SEQ ID NO: 20685 - DNA, 15 bp, Homo sapiens
atatcagccatacag

SEQ ID NO: 20686 - DNA, 15 bp, Homo sapiens
tatatcagccataca

SEQ ID NO: 20687 - DNA, 15 bp, Homo sapiens
gtatatcagccatac

SEQ ID NO: 20688 - DNA, 15 bp, Homo sapiens
agtatatcagccata

SEQ ID NO: 20689 - DNA, 15 bp, Homo sapiens
aagtatatcagccat

SEQ ID NO: 20690 - DNA, 15 bp, Homo sapiens
caagtatatcagcca

SEQ ID NO: 20691 - DNA, 15 bp, Homo sapiens
acaagtatatcagcc

SEQ ID NO: 20692 - DNA, 15 bp, Homo sapiens
tacaagtatatcagc

SEQ ID NO: 20693 - DNA, 15 bp, Homo sapiens
atacaagtatatcag

SEQ ID NO: 20694 - DNA, 15 bp, Homo sapiens
aatacaagtatatca

SEQ ID NO: 20695 - DNA, 15 bp, Homo sapiens
taatacaagtatatc

SEQ ID NO: 20696 - DNA, 15 bp, Homo sapiens
ctaatacaagtatat

SEQ ID NO: 20697 - DNA, 15 bp, Homo sapiens
tctaatacaagtata

SEQ ID NO: 20698 - DNA, 15 bp, Homo sapiens
atctaatacaagtat

SEQ ID NO: 20699 - DNA, 15 bp, Homo sapiens
catctaatacaagta

SEQ ID NO: 20700 - DNA, 15 bp, Homo sapiens
acatctaatacaagt

SEQ ID NO: 20701 - DNA, 15 bp, Homo sapiens
tacatctaatacaag

SEQ ID NO: 20702 - DNA, 15 bp, Homo sapiens
ttacatctaatacaa

SEQ ID NO: 20703 - DNA, 15 bp, Homo sapiens
cttacatctaataca

SEQ ID NO: 20704 - DNA, 15 bp, Homo sapiens
tcttacatctaatac

SEQ ID NO: 20705 - DNA, 15 bp, Homo sapiens
ctcttacatctaata

SEQ ID NO: 20706 - DNA, 15 bp, Homo sapiens
tctcttacatctaat

SEQ ID NO: 20707 - DNA, 15 bp, Homo sapiens
ttctcttacatctaa

SEQ ID NO: 20708 - DNA, 15 bp, Homo sapiens
attctcttacatcta

SEQ ID NO: 20709 - DNA, 15 bp, Homo sapiens
aattctcttacatct

SEQ ID NO: 20710 - DNA, 15 bp, Homo sapiens
taattctcttacatc

SEQ ID NO: 20711 - DNA, 15 bp, Homo sapiens
ctaattctcttacat

SEQ ID NO: 20712 - DNA, 15 bp, Homo sapiens
tctaattctcttaca

SEQ ID NO: 20713 - DNA, 15 bp, Homo sapiens
ctctaattctcttac

SEQ ID NO: 20714 - DNA, 15 bp, Homo sapiens
tctctaattctctta

SEQ ID NO: 20715 - DNA, 15 bp, Homo sapiens
ttctctaattctctt

SEQ ID NO: 20716 - DNA, 15 bp, Homo sapiens
tttctctaattctct

SEQ ID NO: 20717 - DNA, 15 bp, Homo sapiens
atttctctaattctc

SEQ ID NO: 20718 - DNA, 15 bp, Homo sapiens
aatttctctaattct

SEQ ID NO: 20719 - DNA, 15 bp, Homo sapiens
taatttctctaattc

SEQ ID NO: 20720 - DNA, 15 bp, Homo sapiens
ataatttctctaatt

SEQ ID NO: 20721 - DNA, 15 bp, Homo sapiens
tataatttctctaat

SEQ ID NO: 20722 - DNA, 15 bp, Homo sapiens
atataatttctctaa

SEQ ID NO: 20723 - DNA, 15 bp, Homo sapiens
aatataatttctcta

SEQ ID NO: 20724 - DNA, 15 bp, Homo sapiens
aaatataatttctct

SEQ ID NO: 20725 - DNA, 15 bp, Homo sapiens
aaaatataatttctc

SEQ ID NO: 20726 - DNA, 15 bp, Homo sapiens
gaaaatataatttct

SEQ ID NO: 20727 - DNA, 15 bp, Homo sapiens
ggaaaatataatttc

SEQ ID NO: 20728 - DNA, 15 bp, Homo sapiens
aggaaaatataattt

SEQ ID NO: 20729 - DNA, 15 bp, Homo sapiens
aaggaaaatataatt

SEQ ID NO: 20730 - DNA, 15 bp, Homo sapiens
aaaggaaaatataat

SEQ ID NO: 20731 - DNA, 15 bp, Homo sapiens
taaaggaaaatataa

SEQ ID NO: 20732 - DNA, 15 bp, Homo sapiens
ttaaaggaaaatata

SEQ ID NO: 20733 - DNA, 15 bp, Homo sapiens
attaaaggaaaatat

SEQ ID NO: 20734 - DNA, 15 bp, Homo sapiens
aattaaaggaaaata

SEQ ID NO: 20735 - DNA, 15 bp, Homo sapiens
taattaaaggaaaat

SEQ ID NO: 20736 - DNA, 15 bp, Homo sapiens
ttaattaaaggaaaa

SEQ ID NO: 20737 - DNA, 15 bp, Homo sapiens
tttaattaaaggaaa

SEQ ID NO: 20738 - DNA, 15 bp, Homo sapiens
ttttaattaaaggaa

SEQ ID NO: 20739 - DNA, 15 bp, Homo sapiens
tttttaattaaagga

SEQ ID NO: 20740 - DNA, 15 bp, Homo sapiens
ttttttaattaaagg

SEQ ID NO: 20741 - DNA, 15 bp, Homo sapiens
tttttttaattaaag

SEQ ID NO: 20742 - DNA, 15 bp, Homo sapiens
tttttttttaattaa

SEQ ID NO: 20743 - DNA, 15 bp, Homo sapiens
ttttttttttaatta

SEQ ID NO: 20744 - DNA, 15 bp, Homo sapiens
tttttttttttaatt

SEQ ID NO: 20745 - DNA, 15 bp, Homo sapiens
ttttttttttttaat

SEQ ID NO: 20746 - DNA, 15 bp, Homo sapiens
cttttttttttttta

SEQ ID NO: 20747 - DNA, 15 bp, Homo sapiens
gcttttttttttttt

SEQ ID NO: 20748 - DNA, 15 bp, Homo sapiens
ggctttttttttttt

SEQ ID NO: 20749 - DNA, 15 bp, Homo sapiens
aggcttttttttttt

SEQ ID NO: 20750 - DNA, 15 bp, Homo sapiens
caggctttttttttt

SEQ ID NO: 20751 - DNA, 15 bp, Homo sapiens
ccaggcttttttttt

SEQ ID NO: 20752 - DNA, 15 bp, Homo sapiens
cccaggctttttttt

SEQ ID NO: 20753 - DNA, 15 bp, Homo sapiens
gcccaggcttttttt

SEQ ID NO: 20754 - DNA, 15 bp, Homo sapiens
cgcccaggctttttt

SEQ ID NO: 20755 - DNA, 15 bp, Homo sapiens
gcgcccaggcttttt

SEQ ID NO: 20756 - DNA, 15 bp, Homo sapiens
tgcgcccaggctttt

SEQ ID NO: 20757 - DNA, 15 bp, Homo sapiens
ctgcgcccaggcttt

SEQ ID NO: 20758 - DNA, 15 bp, Homo sapiens
actgcgcccaggctt

SEQ ID NO: 20759 - DNA, 15 bp, Homo sapiens
cactgcgcccaggct

SEQ ID NO: 20760 - DNA, 15 bp, Homo sapiens
ccactgcgcccaggc

SEQ ID NO: 20761 - DNA, 15 bp, Homo sapiens
gccactgcgcccagg

SEQ ID NO: 20762 - DNA, 15 bp, Homo sapiens
agccactgcgcccag

SEQ ID NO: 20763 - DNA, 15 bp, Homo sapiens
gagccactgcgccca

SEQ ID NO: 20764 - DNA, 15 bp, Homo sapiens
tgagccactgcgccc

SEQ ID NO: 20765 - DNA, 15 bp, Homo sapiens
gtgagccactgcgcc

SEQ ID NO: 20766 - DNA, 15 bp, Homo sapiens
cgtgagccactgcgc

SEQ ID NO: 20767 - DNA, 15 bp, Homo sapiens
gcgtgagccactgcg

SEQ ID NO: 20768 - DNA, 15 bp, Homo sapiens
gcctcggcctctcaa

SEQ ID NO: 20769 - DNA, 15 bp, Homo sapiens
cgcctcggcctctca

SEQ ID NO: 20770 - DNA, 15 bp, Homo sapiens
ccgcctcggcctctc

SEQ ID NO: 20771 - DNA, 15 bp, Homo sapiens
cccgcctcggcctct

SEQ ID NO: 20772 - DNA, 15 bp, Homo sapiens
acccgcctcggcctc

SEQ ID NO: 20773 - DNA, 15 bp, Homo sapiens
cacccgcctcggcct

SEQ ID NO: 20774 - DNA, 15 bp, Homo sapiens
ccacccgcctcggcc

SEQ ID NO: 20775 - DNA, 15 bp, Homo sapiens
tccacccgcctcggc

SEQ ID NO: 20776 - DNA, 15 bp, Homo sapiens
atccacccgcctcgg

SEQ ID NO: 20777 - DNA, 15 bp, Homo sapiens
gatccacccgcctcg

SEQ ID NO: 20778 - DNA, 15 bp, Homo sapiens
ggtgatccacccgcc

SEQ ID NO: 20779 - DNA, 15 bp, Homo sapiens
aggtgatccacccgc

SEQ ID NO: 20780 - DNA, 15 bp, Homo sapiens
caggtgatccacccg

SEQ ID NO: 20781 - DNA, 15 bp, Homo sapiens
tcaggtgatccaccc

SEQ ID NO: 20782 - DNA, 15 bp, Homo sapiens
ctcaggtgatccacc

SEQ ID NO: 20783 - DNA, 15 bp, Homo sapiens
cctcaggtgatccac

SEQ ID NO: 20784 - DNA, 15 bp, Homo sapiens
acctcaggtgatcca

SEQ ID NO: 20785 - DNA, 15 bp, Homo sapiens
gacctcaggtgatcc

SEQ ID NO: 20786 - DNA, 15 bp, Homo sapiens
ggacctcaggtgatc

SEQ ID NO: 20787 - DNA, 15 bp, Homo sapiens
cggacctcaggtgat

SEQ ID NO: 20788 - DNA, 15 bp, Homo sapiens
tcggacctcaggtga

SEQ ID NO: 20789 - DNA, 15 bp, Homo sapiens
ttcggacctcaggtg

SEQ ID NO: 20790 - DNA, 15 bp, Homo sapiens
cttcggacctcaggt

SEQ ID NO: 20791 - DNA, 15 bp, Homo sapiens
acttcggacctcagg

SEQ ID NO: 20792 - DNA, 15 bp, Homo sapiens
aacttcggacctcag

SEQ ID NO: 20793 - DNA, 15 bp, Homo sapiens
aaacttcggacctca

SEQ ID NO: 20794 - DNA, 15 bp, Homo sapiens
caaacttcggacctc

SEQ ID NO: 20795 - DNA, 15 bp, Homo sapiens
tcaaacttcggacct

SEQ ID NO: 20796 - DNA, 15 bp, Homo sapiens
ctcaaacttcggacc

SEQ ID NO: 20797 - DNA, 15 bp, Homo sapiens
tctcaaacttcggac

SEQ ID NO: 20798 - DNA, 15 bp, Homo sapiens
gtctcaaacttcgga

SEQ ID NO: 20799 - DNA, 15 bp, Homo sapiens
ggtctcaaacttcgg

SEQ ID NO: 20800 - DNA, 15 bp, Homo sapiens
tggtctcaaacttcg

SEQ ID NO: 20801 - DNA, 15 bp, Homo sapiens
ttggtctcaaacttc

SEQ ID NO: 20802 - DNA, 15 bp, Homo sapiens
gttggtctcaaactt

SEQ ID NO: 20803 - DNA, 15 bp, Homo sapiens
ggttggtctcaaact

SEQ ID NO: 20804 - DNA, 15 bp, Homo sapiens
aggttggtctcaaac

SEQ ID NO: 20805 - DNA, 15 bp, Homo sapiens
caggttggtctcaaa

SEQ ID NO: 20806 - DNA, 15 bp, Homo sapiens
tcaggttggtctcaa

SEQ ID NO: 20807 - DNA, 15 bp, Homo sapiens
gtcaggttggtctca

SEQ ID NO: 20808 - DNA, 15 bp, Homo sapiens
ggtcaggttggtctc

SEQ ID NO: 20809 - DNA, 15 bp, Homo sapiens
tggtcaggttggtct

SEQ ID NO: 20810 - DNA, 15 bp, Homo sapiens
ttggtcaggttggtc

SEQ ID NO: 20811 - DNA, 15 bp, Homo sapiens
tttggtcaggttggt

SEQ ID NO: 20812 - DNA, 15 bp, Homo sapiens
ttttggtcaggttgg

SEQ ID NO: 20813 - DNA, 15 bp, Homo sapiens
attttggtcaggttg

SEQ ID NO: 20814 - DNA, 15 bp, Homo sapiens
cattttggtcaggtt

SEQ ID NO: 20815 - DNA, 15 bp, Homo sapiens
ccattttggtcaggt

SEQ ID NO: 20816 - DNA, 15 bp, Homo sapiens
accattttggtcagg

SEQ ID NO: 20817 - DNA, 15 bp, Homo sapiens
caccattttggtcag

SEQ ID NO: 20818 - DNA, 15 bp, Homo sapiens
tcaccattttggtca

SEQ ID NO: 20819 - DNA, 15 bp, Homo sapiens
ttcaccattttggtc

SEQ ID NO: 20820 - DNA, 15 bp, Homo sapiens
tttcaccattttggt

SEQ ID NO: 20821 - DNA, 15 bp, Homo sapiens
ggtagagacagggtt

SEQ ID NO: 20822 - DNA, 15 bp, Homo sapiens
cggtagagacagggt

SEQ ID NO: 20823 - DNA, 15 bp, Homo sapiens
tcggtagagacaggg

SEQ ID NO: 20824 - DNA, 15 bp, Homo sapiens
ttcggtagagacagg

SEQ ID NO: 20825 - DNA, 15 bp, Homo sapiens
tttcggtagagacag

SEQ ID NO: 20826 - DNA, 15 bp, Homo sapiens
ttttcggtagagaca

SEQ ID NO: 20827 - DNA, 15 bp, Homo sapiens
cttttcggtagagac

SEQ ID NO: 20828 - DNA, 15 bp, Homo sapiens
tcttttcggtagaga

SEQ ID NO: 20829 - DNA, 15 bp, Homo sapiens
gtcttttcggtagag

SEQ ID NO: 20830 - DNA, 15 bp, Homo sapiens
tgtcttttcggtaga

SEQ ID NO: 20831 - DNA, 15 bp, Homo sapiens
ttgtcttttcggtag

SEQ ID NO: 20832 - DNA, 15 bp, Homo sapiens
tttgtcttttcggta

SEQ ID NO: 20833 - DNA, 15 bp, Homo sapiens
ttttgtcttttcggt

SEQ ID NO: 20834 - DNA, 15 bp, Homo sapiens
tttttgtcttttcgg

SEQ ID NO: 20835 - DNA, 15 bp, Homo sapiens
atttttgtcttttcg

SEQ ID NO: 20836 - DNA, 15 bp, Homo sapiens
aatttttgtcttttc

SEQ ID NO: 20837 - DNA, 15 bp, Homo sapiens
taatttttgtctttt

SEQ ID NO: 20838 - DNA, 15 bp, Homo sapiens
ctaatttttgtcttt

SEQ ID NO: 20839 - DNA, 15 bp, Homo sapiens
gctaatttttgtctt

SEQ ID NO: 20840 - DNA, 15 bp, Homo sapiens
agctaatttttgtct

SEQ ID NO: 20841 - DNA, 15 bp, Homo sapiens
cagctaatttttgtc

SEQ ID NO: 20842 - DNA, 15 bp, Homo sapiens
tcagctaatttttgt

SEQ ID NO: 20843 - DNA, 15 bp, Homo sapiens
ctcagctaatttttg

SEQ ID NO: 20844 - DNA, 15 bp, Homo sapiens
actcagctaattttt

SEQ ID NO: 20845 - DNA, 15 bp, Homo sapiens
cactcagctaatttt

SEQ ID NO: 20846 - DNA, 15 bp, Homo sapiens
ccactcagctaattt

SEQ ID NO: 20847 - DNA, 15 bp, Homo sapiens
accactcagctaatt

SEQ ID NO: 20848 - DNA, 15 bp, Homo sapiens
caccactcagctaat

SEQ ID NO: 20849 - DNA, 15 bp, Homo sapiens
ccaccactcagctaa

SEQ ID NO: 20850 - DNA, 15 bp, Homo sapiens
gccaccactcagcta

SEQ ID NO: 20851 - DNA, 15 bp, Homo sapiens
cgccaccactcagct

SEQ ID NO: 20852 - DNA, 15 bp, Homo sapiens
acgccaccactcagc

SEQ ID NO: 20853 - DNA, 15 bp, Homo sapiens
cacgccaccactcag

SEQ ID NO: 20854 - DNA, 15 bp, Homo sapiens
gcacgccaccactca

SEQ ID NO: 20855 - DNA, 15 bp, Homo sapiens
tgcacgccaccactc

SEQ ID NO: 20856 - DNA, 15 bp, Homo sapiens
gtgcacgccaccact

SEQ ID NO: 20857 - DNA, 15 bp, Homo sapiens
ggtgcacgccaccac

SEQ ID NO: 20858 - DNA, 15 bp, Homo sapiens
tcgagtagctgggac

SEQ ID NO: 20859 - DNA, 15 bp, Homo sapiens
ctcgagtagctggga

SEQ ID NO: 20860 - DNA, 15 bp, Homo sapiens
tctcgagtagctggg

SEQ ID NO: 20861 - DNA, 15 bp, Homo sapiens
ctctcgagtagctgg

SEQ ID NO: 20862 - DNA, 15 bp, Homo sapiens
cctctcgagtagctg

SEQ ID NO: 20863 - DNA, 15 bp, Homo sapiens
gcctctcgagtagct

SEQ ID NO: 20864 - DNA, 15 bp, Homo sapiens
agcctctcgagtagc

SEQ ID NO: 20865 - DNA, 15 bp, Homo sapiens
cagcctctcgagtag

SEQ ID NO: 20866 - DNA, 15 bp, Homo sapiens
tcagcctctcgagta

SEQ ID NO: 20867 - DNA, 15 bp, Homo sapiens
ctcagcctctcgagt

SEQ ID NO: 20868 - DNA, 15 bp, Homo sapiens
tctcagcctctcgag

SEQ ID NO: 20869 - DNA, 15 bp, Homo sapiens
gtctcagcctctcga

SEQ ID NO: 20870 - DNA, 15 bp, Homo sapiens
tgtctcagcctctcg

SEQ ID NO: 20871 - DNA, 15 bp, Homo sapiens
ctgtctcagcctctc

SEQ ID NO: 20872 - DNA, 15 bp, Homo sapiens
cctgtctcagcctct

SEQ ID NO: 20873 - DNA, 15 bp, Homo sapiens
tcctgtctcagcctc

SEQ ID NO: 20874 - DNA, 15 bp, Homo sapiens
ctcctgtctcagcct

SEQ ID NO: 20875 - DNA, 15 bp, Homo sapiens
tctcctgtctcagcc

SEQ ID NO: 20876 - DNA, 15 bp, Homo sapiens
ttctcctgtctcagc

SEQ ID NO: 20877 - DNA, 15 bp, Homo sapiens
attctcctgtctcag

SEQ ID NO: 20878 - DNA, 15 bp, Homo sapiens
aattctcctgtctca

SEQ ID NO: 20879 - DNA, 15 bp, Homo sapiens
caattctcctgtctc

SEQ ID NO: 20880 - DNA, 15 bp, Homo sapiens
gcaattctcctgtct

SEQ ID NO: 20881 - DNA, 15 bp, Homo sapiens
agcaattctcctgtc

SEQ ID NO: 20882 - DNA, 15 bp, Homo sapiens
aagcaattctcctgt

SEQ ID NO: 20883 - DNA, 15 bp, Homo sapiens
aggttcaagcaattc

SEQ ID NO: 20884 - DNA, 15 bp, Homo sapiens
caggttcaagcaatt

SEQ ID NO: 20885 - DNA, 15 bp, Homo sapiens
ccaggttcaagcaat

SEQ ID NO: 20886 - DNA, 15 bp, Homo sapiens
cccaggttcaagcaa

SEQ ID NO: 20887 - DNA, 15 bp, Homo sapiens
gcccaggttcaagca

SEQ ID NO: 20888 - DNA, 15 bp, Homo sapiens
tgcccaggttcaagc

SEQ ID NO: 20889 - DNA, 15 bp, Homo sapiens
ctgcccaggttcaag

SEQ ID NO: 20890 - DNA, 15 bp, Homo sapiens
cgctgcccaggttca

SEQ ID NO: 20891 - DNA, 15 bp, Homo sapiens
ccgctgcccaggttc

SEQ ID NO: 20892 - DNA, 15 bp, Homo sapiens
tccgctgcccaggtt

SEQ ID NO: 20893 - DNA, 15 bp, Homo sapiens
ctccgctgcccaggt

SEQ ID NO: 20894 - DNA, 15 bp, Homo sapiens
cctccgctgcccagg

SEQ ID NO: 20895 - DNA, 15 bp, Homo sapiens
acctccgctgcccag

SEQ ID NO: 20896 - DNA, 15 bp, Homo sapiens
aacctccgctgccca

SEQ ID NO: 20897 - DNA, 15 bp, Homo sapiens
caacctccgctgccc

SEQ ID NO: 20898 - DNA, 15 bp, Homo sapiens
gcaacctccgctgcc

SEQ ID NO: 20899 - DNA, 15 bp, Homo sapiens
tgcaacctccgctgc

SEQ ID NO: 20900 - DNA, 15 bp, Homo sapiens
ctgcaacctccgctg

SEQ ID NO: 20901 - DNA, 15 bp, Homo sapiens
actgcaacctccgct

SEQ ID NO: 20902 - DNA, 15 bp, Homo sapiens
tgatcttggctcact

SEQ ID NO: 20903 - DNA, 15 bp, Homo sapiens
gtgatcttggctcac

SEQ ID NO: 20904 - DNA, 15 bp, Homo sapiens
tgtgatcttggctca

SEQ ID NO: 20905 - DNA, 15 bp, Homo sapiens
gtgtgatcttggctc

SEQ ID NO: 20906 - DNA, 15 bp, Homo sapiens
ggtgtgatcttggct

SEQ ID NO: 20907 - DNA, 15 bp, Homo sapiens
tggtgtgatcttggc

SEQ ID NO: 20908 - DNA, 15 bp, Homo sapiens
gtggtgtgatcttgg

SEQ ID NO: 20909 - DNA, 15 bp, Homo sapiens
agtggtgtgatcttg

SEQ ID NO: 20910 - DNA, 15 bp, Homo sapiens
cagtggtgtgatctt

SEQ ID NO: 20911 - DNA, 15 bp, Homo sapiens
gcagtggtgtgatct

SEQ ID NO: 20912 - DNA, 15 bp, Homo sapiens
agcagtggtgtgatc

SEQ ID NO: 20913 - DNA, 15 bp, Homo sapiens
gagcagtggtgtgat

SEQ ID NO: 20914 - DNA, 15 bp, Homo sapiens
agagcagtggtgtga

SEQ ID NO: 20915 - DNA, 15 bp, Homo sapiens
gagagcagtggtgtg

SEQ ID NO: 20916 - DNA, 15 bp, Homo sapiens
tgagagcagtggtgt

SEQ ID NO: 20917 - DNA, 15 bp, Homo sapiens
ttgagagcagtggtg

SEQ ID NO: 20918 - DNA, 15 bp, Homo sapiens
attgagagcagtggt

SEQ ID NO: 20919 - DNA, 15 bp, Homo sapiens
aattgagagcagtgg

SEQ ID NO: 20920 - DNA, 15 bp, Homo sapiens
gaattgagagcagtg

SEQ ID NO: 20921 - DNA, 15 bp, Homo sapiens
agaattgagagcagt

SEQ ID NO: 20922 - DNA, 15 bp, Homo sapiens
cagaattgagagcag

SEQ ID NO: 20923 - DNA, 15 bp, Homo sapiens
ccagaattgagagca

SEQ ID NO: 20924 - DNA, 15 bp, Homo sapiens
cccagaattgagagc

SEQ ID NO: 20925 - DNA, 15 bp, Homo sapiens
gcccagaattgagag

SEQ ID NO: 20926 - DNA, 15 bp, Homo sapiens
cgcccagaattgaga

SEQ ID NO: 20927 - DNA, 15 bp, Homo sapiens
tcgcccagaattgag

SEQ ID NO: 20928 - DNA, 15 bp, Homo sapiens
gtcgcccagaattga

SEQ ID NO: 20929 - DNA, 15 bp, Homo sapiens
tgtcgcccagaattg

SEQ ID NO: 20930 - DNA, 15 bp, Homo sapiens
ttgtcgcccagaatt

SEQ ID NO: 20931 - DNA, 15 bp, Homo sapiens
cttgtcgcccagaat

SEQ ID NO: 20932 - DNA, 15 bp, Homo sapiens
gcttgtcgcccagaa

SEQ ID NO: 20933 - DNA, 15 bp, Homo sapiens
tgcttgtcgcccaga

SEQ ID NO: 20934 - DNA, 15 bp, Homo sapiens
ttgcttgtcgcccag

SEQ ID NO: 20935 - DNA, 15 bp, Homo sapiens
cttgcttgtcgccca

SEQ ID NO: 20936 - DNA, 15 bp, Homo sapiens
tcttgcttgtcgccc

SEQ ID NO: 20937 - DNA, 15 bp, Homo sapiens
gtcttgcttgtcgcc

SEQ ID NO: 20938 - DNA, 15 bp, Homo sapiens
agtcttgcttgtcgc

SEQ ID NO: 20939 - DNA, 15 bp, Homo sapiens
gagtcttgcttgtcg

SEQ ID NO: 20940 - DNA, 15 bp, Homo sapiens
ggagtcttgcttgtc

SEQ ID NO: 20941 - DNA, 15 bp, Homo sapiens
tggagtcttgcttgt

SEQ ID NO: 20942 - DNA, 15 bp, Homo sapiens
atggagtcttgcttg

SEQ ID NO: 20943 - DNA, 15 bp, Homo sapiens
gatggagtcttgctt

SEQ ID NO: 20944 - DNA, 15 bp, Homo sapiens
agatggagtcttgct

SEQ ID NO: 20945 - DNA, 15 bp, Homo sapiens
gagatggagtcttgc

SEQ ID NO: 20946 - DNA, 15 bp, Homo sapiens
tgagatggagtcttg

SEQ ID NO: 20947 - DNA, 15 bp, Homo sapiens
ttgagatggagtctt

SEQ ID NO: 20948 - DNA, 15 bp, Homo sapiens
ctttgagatggagtc

SEQ ID NO: 20949 - DNA, 15 bp, Homo sapiens
tctttgagatggagt

SEQ ID NO: 20950 - DNA, 15 bp, Homo sapiens
ttctttgagatggag

SEQ ID NO: 20951 - DNA, 15 bp, Homo sapiens
tttctttgagatgga

SEQ ID NO: 20952 - DNA, 15 bp, Homo sapiens
ttttctttgagatgg

SEQ ID NO: 20953 - DNA, 15 bp, Homo sapiens
cttttctttgagatg

SEQ ID NO: 20954 - DNA, 15 bp, Homo sapiens
tcttttctttgagat

SEQ ID NO: 20955 - DNA, 15 bp, Homo sapiens
ttcttttctttgaga

SEQ ID NO: 20956 - DNA, 15 bp, Homo sapiens
tttcttttctttgag

SEQ ID NO: 20957 - DNA, 15 bp, Homo sapiens
ttttcttttctttga

SEQ ID NO: 20958 - DNA, 15 bp, Homo sapiens
cttttcttttctttg

SEQ ID NO: 20959 - DNA, 15 bp, Homo sapiens
tcttttcttttcttt

SEQ ID NO: 20960 - DNA, 15 bp, Homo sapiens
ttcttttcttttctt

SEQ ID NO: 20961 - DNA, 15 bp, Homo sapiens
tttcttttcttttct

SEQ ID NO: 20962 - DNA, 15 bp, Homo sapiens
ttttcttttcttttc

SEQ ID NO: 20963 - DNA, 15 bp, Homo sapiens
tttttcttttctttt

SEQ ID NO: 20964 - DNA, 15 bp, Homo sapiens
ttttttcttttcttt

SEQ ID NO: 20965 - DNA, 15 bp, Homo sapiens
cttttttcttttctt

SEQ ID NO: 20966 - DNA, 15 bp, Homo sapiens
tcttttttcttttct

SEQ ID NO: 20967 - DNA, 15 bp, Homo sapiens
gtcttttttcttttc

SEQ ID NO: 20968 - DNA, 15 bp, Homo sapiens
tgtcttttttctttt

SEQ ID NO: 20969 - DNA, 15 bp, Homo sapiens
ttgtcttttttcttt

SEQ ID NO: 20970 - DNA, 15 bp, Homo sapiens
cttgtcttttttctt

SEQ ID NO: 20971 - DNA, 15 bp, Homo sapiens
ccttgtcttttttct

SEQ ID NO: 20972 - DNA, 15 bp, Homo sapiens
accttgtcttttttc

SEQ ID NO: 20973 - DNA, 15 bp, Homo sapiens
gaccttgtctttttt

SEQ ID NO: 20974 - DNA, 15 bp, Homo sapiens
agaccttgtcttttt

SEQ ID NO: 20975 - DNA, 15 bp, Homo sapiens
gagaccttgtctttt

SEQ ID NO: 20976 - DNA, 15 bp, Homo sapiens
tgagaccttgtcttt

SEQ ID NO: 20977 - DNA, 15 bp, Homo sapiens
atgagaccttgtctt

SEQ ID NO: 20978 - DNA, 15 bp, Homo sapiens
aatgagaccttgtct

SEQ ID NO: 20979 - DNA, 15 bp, Homo sapiens
gaatgagaccttgtc

SEQ ID NO: 20980 - DNA, 15 bp, Homo sapiens
agaatgagaccttgt

SEQ ID NO: 20981 - DNA, 15 bp, Homo sapiens
cagaatgagaccttg

SEQ ID NO: 20982 - DNA, 15 bp, Homo sapiens
acagaatgagacctt

SEQ ID NO: 20983 - DNA, 15 bp, Homo sapiens
aacagaatgagacct

SEQ ID NO: 20984 - DNA, 15 bp, Homo sapiens
caacagaatgagacc

SEQ ID NO: 20985 - DNA, 15 bp, Homo sapiens
gcaacagaatgagac

SEQ ID NO: 20986 - DNA, 15 bp, Homo sapiens
ggcaacagaatgaga

SEQ ID NO: 20987 - DNA, 15 bp, Homo sapiens
gggcaacagaatgag

SEQ ID NO: 20988 - DNA, 15 bp, Homo sapiens
tgggcaacagaatga

SEQ ID NO: 20989 - DNA, 15 bp, Homo sapiens
ctgggcaacagaatg

SEQ ID NO: 20990 - DNA, 15 bp, Homo sapiens
cctgggcaacagaat

SEQ ID NO: 20991 - DNA, 15 bp, Homo sapiens
ctagcctgggcaaca

SEQ ID NO: 20992 - DNA, 15 bp, Homo sapiens
actagcctgggcaac

SEQ ID NO: 20993 - DNA, 15 bp, Homo sapiens
cactagcctgggcaa

SEQ ID NO: 20994 - DNA, 15 bp, Homo sapiens
acactagcctgggca

SEQ ID NO: 20995 - DNA, 15 bp, Homo sapiens
cacactagcctgggc

SEQ ID NO: 20996 - DNA, 15 bp, Homo sapiens
gcacactagcctggg

SEQ ID NO: 20997 - DNA, 15 bp, Homo sapiens
tgcacactagcctgg

SEQ ID NO: 20998 - DNA, 15 bp, Homo sapiens
ctgcacactagcctg

SEQ ID NO: 20999 - DNA, 15 bp, Homo sapiens
actgcacactagcct

SEQ ID NO: 21000 - DNA, 15 bp, Homo sapiens
cactgcacactagcc

SEQ ID NO: 21001 - DNA, 15 bp, Homo sapiens
tcactgcacactagc

SEQ ID NO: 21002 - DNA, 15 bp, Homo sapiens
gtcactgcacactag

SEQ ID NO: 21003 - DNA, 15 bp, Homo sapiens
tgtcactgcacacta

SEQ ID NO: 21004 - DNA, 15 bp, Homo sapiens
gtgtcactgcacact

SEQ ID NO: 21005 - DNA, 15 bp, Homo sapiens
tgtgtcactgcacac

SEQ ID NO: 21006 - DNA, 15 bp, Homo sapiens
ctgtgtcactgcaca

SEQ ID NO: 21007 - DNA, 15 bp, Homo sapiens
gctgtgtcactgcac

SEQ ID NO: 21008 - DNA, 15 bp, Homo sapiens
agctgtgtcactgca

SEQ ID NO: 21009 - DNA, 15 bp, Homo sapiens
cagctgtgtcactgc

SEQ ID NO: 21010 - DNA, 15 bp, Homo sapiens
acagctgtgtcactg

SEQ ID NO: 21011 - DNA, 15 bp, Homo sapiens
cacagctgtgtcact

SEQ ID NO: 21012 - DNA, 15 bp, Homo sapiens
ccacagctgtgtcac

SEQ ID NO: 21013 - DNA, 15 bp, Homo sapiens
gccacagctgtgtca

SEQ ID NO: 21014 - DNA, 15 bp, Homo sapiens
agccacagctgtgtc

SEQ ID NO: 21015 - DNA, 15 bp, Homo sapiens
gagccacagctgtgt

SEQ ID NO: 21016 - DNA, 15 bp, Homo sapiens
tgagccacagctgtg

SEQ ID NO: 21017 - DNA, 15 bp, Homo sapiens
gtgagccacagctgt

SEQ ID NO: 21018 - DNA, 15 bp, Homo sapiens
agtgagccacagctg

SEQ ID NO: 21019 - DNA, 15 bp, Homo sapiens
aagtgagccacagct

SEQ ID NO: 21020 - DNA, 15 bp, Homo sapiens
taagtgagccacagc

SEQ ID NO: 21021 - DNA, 15 bp, Homo sapiens
gtaagtgagccacag

SEQ ID NO: 21022 - DNA, 15 bp, Homo sapiens
tgtaagtgagccaca

SEQ ID NO: 21023 - DNA, 15 bp, Homo sapiens
ctgtaagtgagccac

SEQ ID NO: 21024 - DNA, 15 bp, Homo sapiens
gctgtaagtgagcca

SEQ ID NO: 21025 - DNA, 15 bp, Homo sapiens
ggctgtaagtgagcc

SEQ ID NO: 21026 - DNA, 15 bp, Homo sapiens
aggctgtaagtgagc

SEQ ID NO: 21027 - DNA, 15 bp, Homo sapiens
gaggctgtaagtgag

SEQ ID NO: 21028 - DNA, 15 bp, Homo sapiens
tgaggctgtaagtga

SEQ ID NO: 21029 - DNA, 15 bp, Homo sapiens
ttgaggctgtaagtg

SEQ ID NO: 21030 - DNA, 15 bp, Homo sapiens
gttgaggctgtaagt

SEQ ID NO: 21031 - DNA, 15 bp, Homo sapiens
ggttgaggctgtaag

SEQ ID NO: 21032 - DNA, 15 bp, Homo sapiens
aggttgaggctgtaa

SEQ ID NO: 21033 - DNA, 15 bp, Homo sapiens
gaggttgaggctgta

SEQ ID NO: 21034 - DNA, 15 bp, Homo sapiens
ggaggttgaggctgt

SEQ ID NO: 21035 - DNA, 15 bp, Homo sapiens
gggaggttgaggctg

SEQ ID NO: 21036 - DNA, 15 bp, Homo sapiens
tgggaggttgaggct

SEQ ID NO: 21037 - DNA, 15 bp, Homo sapiens
ctgggaggttgaggc

SEQ ID NO: 21038 - DNA, 15 bp, Homo sapiens
cctgggaggttgagg

SEQ ID NO: 21039 - DNA, 15 bp, Homo sapiens
gcctgggaggttgag

SEQ ID NO: 21040 - DNA, 15 bp, Homo sapiens
agcctgggaggttga

SEQ ID NO: 21041 - DNA, 15 bp, Homo sapiens
gagcctgggaggttg

SEQ ID NO: 21042 - DNA, 15 bp, Homo sapiens
tgagcctgggaggtt

SEQ ID NO: 21043 - DNA, 15 bp, Homo sapiens
ttgagcctgggaggt

SEQ ID NO: 21044 - DNA, 15 bp, Homo sapiens
cttgagcctgggagg

SEQ ID NO: 21045 - DNA, 15 bp, Homo sapiens
acttgagcctgggag

SEQ ID NO: 21046 - DNA, 15 bp, Homo sapiens
gacttgagcctggga

SEQ ID NO: 21047 - DNA, 15 bp, Homo sapiens
ggacttgagcctggg

SEQ ID NO: 21048 - DNA, 15 bp, Homo sapiens
aggacttgagcctgg

SEQ ID NO: 21049 - DNA, 15 bp, Homo sapiens
gaggacttgagcctg

SEQ ID NO: 21050 - DNA, 15 bp, Homo sapiens
ggaggacttgagcct

SEQ ID NO: 21051 - DNA, 15 bp, Homo sapiens
gggaggacttgagcc

SEQ ID NO: 21052 - DNA, 15 bp, Homo sapiens
tgggaggacttgagc

SEQ ID NO: 21053 - DNA, 15 bp, Homo sapiens
gtgggaggacttgag

SEQ ID NO: 21054 - DNA, 15 bp, Homo sapiens
ggtgggaggacttga

SEQ ID NO: 21055 - DNA, 15 bp, Homo sapiens
gggtgggaggacttg

SEQ ID NO: 21056 - DNA, 15 bp, Homo sapiens
ggggtgggaggactt

SEQ ID NO: 21057 - DNA, 15 bp, Homo sapiens
tggggtgggaggact

SEQ ID NO: 21058 - DNA, 15 bp, Homo sapiens
ctggggtgggaggac

SEQ ID NO: 21059 - DNA, 15 bp, Homo sapiens
gctggggtgggagga

SEQ ID NO: 21060 - DNA, 15 bp, Homo sapiens
ggctggggtgggagg

SEQ ID NO: 21061 - DNA, 15 bp, Homo sapiens
aggctggggtgggag

SEQ ID NO: 21062 - DNA, 15 bp, Homo sapiens
gaggctggggtggga

SEQ ID NO: 21063 - DNA, 15 bp, Homo sapiens
tgaggctggggtggg

SEQ ID NO: 21064 - DNA, 15 bp, Homo sapiens
gtgaggctggggtgg

SEQ ID NO: 21065 - DNA, 15 bp, Homo sapiens
tgtgaggctggggtg

SEQ ID NO: 21066 - DNA, 15 bp, Homo sapiens
ttgtgaggctggggt

SEQ ID NO: 21067 - DNA, 15 bp, Homo sapiens
cttgtgaggctgggg

SEQ ID NO: 21068 - DNA, 15 bp, Homo sapiens
acttgtgaggctggg

SEQ ID NO: 21069 - DNA, 15 bp, Homo sapiens
tacttgtgaggctgg

SEQ ID NO: 21070 - DNA, 15 bp, Homo sapiens
ctacttgtgaggctg

SEQ ID NO: 21071 - DNA, 15 bp, Homo sapiens
gctacttgtgaggct

SEQ ID NO: 21072 - DNA, 15 bp, Homo sapiens
agctacttgtgaggc

SEQ ID NO: 21073 - DNA, 15 bp, Homo sapiens
cagctacttgtgagg

SEQ ID NO: 21074 - DNA, 15 bp, Homo sapiens
gcagctacttgtgag

SEQ ID NO: 21075 - DNA, 15 bp, Homo sapiens
tgcagctacttgtga

SEQ ID NO: 21076 - DNA, 15 bp, Homo sapiens
ttgcagctacttgtg

SEQ ID NO: 21077 - DNA, 15 bp, Homo sapiens
gttgcagctacttgt

SEQ ID NO: 21078 - DNA, 15 bp, Homo sapiens
ggttgcagctacttg

SEQ ID NO: 21079 - DNA, 15 bp, Homo sapiens
tggttgcagctactt

SEQ ID NO: 21080 - DNA, 15 bp, Homo sapiens
gtggttgcagctact

SEQ ID NO: 21081 - DNA, 15 bp, Homo sapiens
tgtggttgcagctac

SEQ ID NO: 21082 - DNA, 15 bp, Homo sapiens
ttgtggttgcagcta

SEQ ID NO: 21083 - DNA, 15 bp, Homo sapiens
cttgtggttgcagct

SEQ ID NO: 21084 - DNA, 15 bp, Homo sapiens
acttgtggttgcagc

SEQ ID NO: 21085 - DNA, 15 bp, Homo sapiens
cacttgtggttgcag

SEQ ID NO: 21086 - DNA, 15 bp, Homo sapiens
gcacttgtggttgca

SEQ ID NO: 21087 - DNA, 15 bp, Homo sapiens
tgcacttgtggttgc

SEQ ID NO: 21088 - DNA, 15 bp, Homo sapiens
atgcacttgtggttg

SEQ ID NO: 21089 - DNA, 15 bp, Homo sapiens
catgcacttgtggtt

SEQ ID NO: 21090 - DNA, 15 bp, Homo sapiens
gcatgcacttgtggt

SEQ ID NO: 21091 - DNA, 15 bp, Homo sapiens
ggcatgcacttgtgg

SEQ ID NO: 21092 - DNA, 15 bp, Homo sapiens
tggcatgcacttgtg

SEQ ID NO: 21093 - DNA, 15 bp, Homo sapiens
gtggcatgcacttgt

SEQ ID NO: 21094 - DNA, 15 bp, Homo sapiens
ggtggcatgcacttg

SEQ ID NO: 21095 - DNA, 15 bp, Homo sapiens
tggtggcatgcactt

SEQ ID NO: 21096 - DNA, 15 bp, Homo sapiens
atggtggcatgcact

SEQ ID NO: 21097 - DNA, 15 bp, Homo sapiens
gggcatggtggcatg

SEQ ID NO: 21098 - DNA, 15 bp, Homo sapiens
ggggcatggtggcat

SEQ ID NO: 21099 - DNA, 15 bp, Homo sapiens
tggggcatggtggca

SEQ ID NO: 21100 - DNA, 15 bp, Homo sapiens
gtggggcatggtggc

SEQ ID NO: 21101 - DNA, 15 bp, Homo sapiens
agtggggcatggtgg

SEQ ID NO: 21102 - DNA, 15 bp, Homo sapiens
tagtggggcatggtg

SEQ ID NO: 21103 - DNA, 15 bp, Homo sapiens
ctagtggggcatggt

SEQ ID NO: 21104 - DNA, 15 bp, Homo sapiens
actagtggggcatgg

SEQ ID NO: 21105 - DNA, 15 bp, Homo sapiens
aactagtggggcatg

SEQ ID NO: 21106 - DNA, 15 bp, Homo sapiens
aaactagtggggcat

SEQ ID NO: 21107 - DNA, 15 bp, Homo sapiens
aaaactagtggggca

SEQ ID NO: 21108 - DNA, 15 bp, Homo sapiens
aaaaactagtggggc

SEQ ID NO: 21109 - DNA, 15 bp, Homo sapiens
aaaaaactagtgggg

SEQ ID NO: 21110 - DNA, 15 bp, Homo sapiens
aaaaaaactagtggg

SEQ ID NO: 21111 - DNA, 15 bp, Homo sapiens
taaaaaaactagtgg

SEQ ID NO: 21112 - DNA, 15 bp, Homo sapiens
ataaaaaaactagtg

SEQ ID NO: 21113 - DNA, 15 bp, Homo sapiens
aataaaaaaactagt

SEQ ID NO: 21114 - DNA, 15 bp, Homo sapiens
aaataaaaaaactag

SEQ ID NO: 21115 - DNA, 15 bp, Homo sapiens
aaaataaaaaaacta

SEQ ID NO: 21116 - DNA, 15 bp, Homo sapiens
aaaaataaaaaaact

SEQ ID NO: 21117 - DNA, 15 bp, Homo sapiens
aaaaaataaaaaaac

SEQ ID NO: 21118 - DNA, 15 bp, Homo sapiens
aaaaaaataaaaaaa

SEQ ID NO: 21119 - DNA, 15 bp, Homo sapiens
aaaaaaaataaaaaa

SEQ ID NO: 21120 - DNA, 15 bp, Homo sapiens
aaaaaaaaataaaaa

SEQ ID NO: 21121 - DNA, 15 bp, Homo sapiens
caaaaaaaaataaaa

SEQ ID NO: 21122 - DNA, 15 bp, Homo sapiens
acaaaaaaaaataaa

SEQ ID NO: 21123 - DNA, 15 bp, Homo sapiens
tacaaaaaaaaataa

SEQ ID NO: 21124 - DNA, 15 bp, Homo sapiens
ctacaaaaaaaaata

SEQ ID NO: 21125 - DNA, 15 bp, Homo sapiens
tctacaaaaaaaaat

SEQ ID NO: 21126 - DNA, 15 bp, Homo sapiens
ctctacaaaaaaaaa

SEQ ID NO: 21127 - DNA, 15 bp, Homo sapiens
cctctacaaaaaaaa

SEQ ID NO: 21128 - DNA, 15 bp, Homo sapiens
gcctctacaaaaaaa

SEQ ID NO: 21129 - DNA, 15 bp, Homo sapiens
tgcctctacaaaaaa

SEQ ID NO: 21130 - DNA, 15 bp, Homo sapiens
ctgcctctacaaaaa

SEQ ID NO: 21131 - DNA, 15 bp, Homo sapiens
cctgcctctacaaaa

SEQ ID NO: 21132 - DNA, 15 bp, Homo sapiens
acctgcctctacaaa

SEQ ID NO: 21133 - DNA, 15 bp, Homo sapiens
aacctgcctctacaa

SEQ ID NO: 21134 - DNA, 15 bp, Homo sapiens
gaacctgcctctaca

SEQ ID NO: 21135 - DNA, 15 bp, Homo sapiens
agaacctgcctctac

SEQ ID NO: 21136 - DNA, 15 bp, Homo sapiens
gagaacctgcctcta

SEQ ID NO: 21137 - DNA, 15 bp, Homo sapiens
tgagaacctgcctct

SEQ ID NO: 21138 - DNA, 15 bp, Homo sapiens
gtgagaacctgcctc

SEQ ID NO: 21139 - DNA, 15 bp, Homo sapiens
agtgagaacctgcct

SEQ ID NO: 21140 - DNA, 15 bp, Homo sapiens
tagtgagaacctgcc

SEQ ID NO: 21141 - DNA, 15 bp, Homo sapiens
atagtgagaacctgc

SEQ ID NO: 21142 - DNA, 15 bp, Homo sapiens
catagtgagaacctg

SEQ ID NO: 21143 - DNA, 15 bp, Homo sapiens
acatagtgagaacct

SEQ ID NO: 21144 - DNA, 15 bp, Homo sapiens
gacatagtgagaacc

SEQ ID NO: 21145 - DNA, 15 bp, Homo sapiens
tgacatagtgagaac

SEQ ID NO: 21146 - DNA, 15 bp, Homo sapiens
gtgacatagtgagaa

SEQ ID NO: 21147 - DNA, 15 bp, Homo sapiens
ggtgacatagtgaga

SEQ ID NO: 21148 - DNA, 15 bp, Homo sapiens
tggtgacatagtgag

SEQ ID NO: 21149 - DNA, 15 bp, Homo sapiens
ctggtgacatagtga

SEQ ID NO: 21150 - DNA, 15 bp, Homo sapiens
cctggtgacatagtg

SEQ ID NO: 21151 - DNA, 15 bp, Homo sapiens
gcctggtgacatagt

SEQ ID NO: 21152 - DNA, 15 bp, Homo sapiens
agcctggtgacatag

SEQ ID NO: 21153 - DNA, 15 bp, Homo sapiens
cagcctggtgacata

SEQ ID NO: 21154 - DNA, 15 bp, Homo sapiens
ccagcctggtgacat

SEQ ID NO: 21155 - DNA, 15 bp, Homo sapiens
accagcctggtgaca

SEQ ID NO: 21156 - DNA, 15 bp, Homo sapiens
gaccagcctggtgac

SEQ ID NO: 21157 - DNA, 15 bp, Homo sapiens
agaccagcctggtga

SEQ ID NO: 21158 - DNA, 15 bp, Homo sapiens
aagaccagcctggtg

SEQ ID NO: 21159 - DNA, 15 bp, Homo sapiens
caagaccagcctggt

SEQ ID NO: 21160 - DNA, 15 bp, Homo sapiens
attcaagaccagcct

SEQ ID NO: 21161 - DNA, 15 bp, Homo sapiens
aattcaagaccagcc

SEQ ID NO: 21162 - DNA, 15 bp, Homo sapiens
gaattcaagaccagc

SEQ ID NO: 21163 - DNA, 15 bp, Homo sapiens
ggaattcaagaccag

SEQ ID NO: 21164 - DNA, 15 bp, Homo sapiens
aggaattcaagacca

SEQ ID NO: 21165 - DNA, 15 bp, Homo sapiens
caggaattcaagacc

SEQ ID NO: 21166 - DNA, 15 bp, Homo sapiens
ccaggaattcaagac

SEQ ID NO: 21167 - DNA, 15 bp, Homo sapiens
cccaggaattcaaga

SEQ ID NO: 21168 - DNA, 15 bp, Homo sapiens
gcccaggaattcaag

SEQ ID NO: 21169 - DNA, 15 bp, Homo sapiens
gatcacttgagccca

SEQ ID NO: 21170 - DNA, 15 bp, Homo sapiens
ggatcacttgagccc

SEQ ID NO: 21171 - DNA, 15 bp, Homo sapiens
aggatcacttgagcc

SEQ ID NO: 21172 - DNA, 15 bp, Homo sapiens
gaggatcacttgagc

SEQ ID NO: 21173 - DNA, 15 bp, Homo sapiens
tctttgggaggccaa

SEQ ID NO: 21174 - DNA, 15 bp, Homo sapiens
ctctttgggaggcca

SEQ ID NO: 21175 - DNA, 15 bp, Homo sapiens
gctctttgggaggcc

SEQ ID NO: 21176 - DNA, 15 bp, Homo sapiens
agctctttgggaggc

SEQ ID NO: 21177 - DNA, 15 bp, Homo sapiens
cagctctttgggagg

SEQ ID NO: 21178 - DNA, 15 bp, Homo sapiens
ccagctctttgggag

SEQ ID NO: 21179 - DNA, 15 bp, Homo sapiens
cccagctctttggga

SEQ ID NO: 21180 - DNA, 15 bp, Homo sapiens
tcccagctctttggg

SEQ ID NO: 21181 - DNA, 15 bp, Homo sapiens
atcccagctctttgg

SEQ ID NO: 21182 - DNA, 15 bp, Homo sapiens
aatcccagctctttg

SEQ ID NO: 21183 - DNA, 15 bp, Homo sapiens
taatcccagctcttt

SEQ ID NO: 21184 - DNA, 15 bp, Homo sapiens
ataatcccagctctt

SEQ ID NO: 21185 - DNA, 15 bp, Homo sapiens
tataatcccagctct

SEQ ID NO: 21186 - DNA, 15 bp, Homo sapiens
ttataatcccagctc

SEQ ID NO: 21187 - DNA, 15 bp, Homo sapiens
cttataatcccagct

SEQ ID NO: 21188 - DNA, 15 bp, Homo sapiens
gcttataatcccagc

SEQ ID NO: 21189 - DNA, 15 bp, Homo sapiens
tgcttataatcccag

SEQ ID NO: 21190 - DNA, 15 bp, Homo sapiens
atgcttataatccca

SEQ ID NO: 21191 - DNA, 15 bp, Homo sapiens
catgcttataatccc

SEQ ID NO: 21192 - DNA, 15 bp, Homo sapiens
tcatgcttataatcc

SEQ ID NO: 21193 - DNA, 15 bp, Homo sapiens
ttcatgcttataatc

SEQ ID NO: 21194 - DNA, 15 bp, Homo sapiens
gttcatgcttataat

SEQ ID NO: 21195 - DNA, 15 bp, Homo sapiens
ggttcatgcttataa

SEQ ID NO: 21196 - DNA, 15 bp, Homo sapiens
tggttcatgcttata

SEQ ID NO: 21197 - DNA, 15 bp, Homo sapiens
gtggttcatgcttat

SEQ ID NO: 21198 - DNA, 15 bp, Homo sapiens
ggtggttcatgctta

SEQ ID NO: 21199 - DNA, 15 bp, Homo sapiens
tggtggttcatgctt

SEQ ID NO: 21200 - DNA, 15 bp, Homo sapiens
gtggtggttcatgct

SEQ ID NO: 21201 - DNA, 15 bp, Homo sapiens
tgtggtggttcatgc

SEQ ID NO: 21202 - DNA, 15 bp, Homo sapiens
gtgtggtggttcatg

SEQ ID NO: 21203 - DNA, 15 bp, Homo sapiens
agtgtggtggttcat

SEQ ID NO: 21204 - DNA, 15 bp, Homo sapiens
gagtgtggtggttca

SEQ ID NO: 21205 - DNA, 15 bp, Homo sapiens
tgagtgtggtggttc

SEQ ID NO: 21206 - DNA, 15 bp, Homo sapiens
ctgagtgtggtggtt

SEQ ID NO: 21207 - DNA, 15 bp, Homo sapiens
ggctgagtgtggtgg

SEQ ID NO: 21208 - DNA, 15 bp, Homo sapiens
aggctgagtgtggtg

SEQ ID NO: 21209 - DNA, 15 bp, Homo sapiens
gaggctgagtgtggt

SEQ ID NO: 21210 - DNA, 15 bp, Homo sapiens
ggaggctgagtgtgg

SEQ ID NO: 21211 - DNA, 15 bp, Homo sapiens
aggaggctgagtgtg

SEQ ID NO: 21212 - DNA, 15 bp, Homo sapiens
aaggaggctgagtgt

SEQ ID NO: 21213 - DNA, 15 bp, Homo sapiens
aaaggaggctgagtg

SEQ ID NO: 21214 - DNA, 15 bp, Homo sapiens
gaaaggaggctgagt

SEQ ID NO: 21215 - DNA, 15 bp, Homo sapiens
agaaaggaggctgag

SEQ ID NO: 21216 - DNA, 15 bp, Homo sapiens
tagaaaggaggctga

SEQ ID NO: 21217 - DNA, 15 bp, Homo sapiens
ttagaaaggaggctg

SEQ ID NO: 21218 - DNA, 15 bp, Homo sapiens
attagaaaggaggct

SEQ ID NO: 21219 - DNA, 15 bp, Homo sapiens
aattagaaaggaggc

SEQ ID NO: 21220 - DNA, 15 bp, Homo sapiens
aaattagaaaggagg

SEQ ID NO: 21221 - DNA, 15 bp, Homo sapiens
aaaattagaaaggag

SEQ ID NO: 21222 - DNA, 15 bp, Homo sapiens
gaaaattagaaagga

SEQ ID NO: 21223 - DNA, 15 bp, Homo sapiens
ggaaaattagaaagg

SEQ ID NO: 21224 - DNA, 15 bp, Homo sapiens
aggaaaattagaaag

SEQ ID NO: 21225 - DNA, 15 bp, Homo sapiens
caggaaaattagaaa

SEQ ID NO: 21226 - DNA, 15 bp, Homo sapiens
tcaggaaaattagaa

SEQ ID NO: 21227 - DNA, 15 bp, Homo sapiens
atcaggaaaattaga

SEQ ID NO: 21228 - DNA, 15 bp, Homo sapiens
gatcaggaaaattag

SEQ ID NO: 21229 - DNA, 15 bp, Homo sapiens
ggatcaggaaaatta

SEQ ID NO: 21230 - DNA, 15 bp, Homo sapiens
aggatcaggaaaatt

SEQ ID NO: 21231 - DNA, 15 bp, Homo sapiens
gaggatcaggaaaat

SEQ ID NO: 21232 - DNA, 15 bp, Homo sapiens
agaggatcaggaaaa

SEQ ID NO: 21233 - DNA, 15 bp, Homo sapiens
cagaggatcaggaaa

SEQ ID NO: 21234 - DNA, 15 bp, Homo sapiens
acagaggatcaggaa

SEQ ID NO: 21235 - DNA, 15 bp, Homo sapiens
gacagaggatcagga

SEQ ID NO: 21236 - DNA, 15 bp, Homo sapiens
agacagaggatcagg

SEQ ID NO: 21237 - DNA, 15 bp, Homo sapiens
gagacagaggatcag

SEQ ID NO: 21238 - DNA, 15 bp, Homo sapiens
agagacagaggatca

SEQ ID NO: 21239 - DNA, 15 bp, Homo sapiens
tagagacagaggatc

SEQ ID NO: 21240 - DNA, 15 bp, Homo sapiens
ctagagacagaggat

SEQ ID NO: 21241 - DNA, 15 bp, Homo sapiens
cctagagacagagga

SEQ ID NO: 21242 - DNA, 15 bp, Homo sapiens
acctagagacagagg

SEQ ID NO: 21243 - DNA, 15 bp, Homo sapiens
cacctagagacagag

SEQ ID NO: 21244 - DNA, 15 bp, Homo sapiens
acacctagagacaga

SEQ ID NO: 21245 - DNA, 15 bp, Homo sapiens
tacacctagagacag

SEQ ID NO: 21246 - DNA, 15 bp, Homo sapiens
atacacctagagaca

SEQ ID NO: 21247 - DNA, 15 bp, Homo sapiens
catacacctagagac

SEQ ID NO: 21248 - DNA, 15 bp, Homo sapiens
acatacacctagaga

SEQ ID NO: 21249 - DNA, 15 bp, Homo sapiens
aacatacacctagag

SEQ ID NO: 21250 - DNA, 15 bp, Homo sapiens
taacatacacctaga

SEQ ID NO: 21251 - DNA, 15 bp, Homo sapiens
ttaacatacacctag

SEQ ID NO: 21252 - DNA, 15 bp, Homo sapiens
attaacatacaccta

SEQ ID NO: 21253 - DNA, 15 bp, Homo sapiens
tattaacatacacct

SEQ ID NO: 21254 - DNA, 15 bp, Homo sapiens
ctattaacatacacc

SEQ ID NO: 21255 - DNA, 15 bp, Homo sapiens
tctattaacatacac

SEQ ID NO: 21256 - DNA, 15 bp, Homo sapiens
gtctattaacataca

SEQ ID NO: 21257 - DNA, 15 bp, Homo sapiens
tgtctattaacatac

SEQ ID NO: 21258 - DNA, 15 bp, Homo sapiens
ttgtctattaacata

SEQ ID NO: 21259 - DNA, 15 bp, Homo sapiens
cttgtctattaacat

SEQ ID NO: 21260 - DNA, 15 bp, Homo sapiens
acttgtctattaaca

SEQ ID NO: 21261 - DNA, 15 bp, Homo sapiens
aacttgtctattaac

SEQ ID NO: 21262 - DNA, 15 bp, Homo sapiens
gaacttgtctattaa

SEQ ID NO: 21263 - DNA, 15 bp, Homo sapiens
agaacttgtctatta

SEQ ID NO: 21264 - DNA, 15 bp, Homo sapiens
tagaacttgtctatt

SEQ ID NO: 21265 - DNA, 15 bp, Homo sapiens
ctagaacttgtctat

SEQ ID NO: 21266 - DNA, 15 bp, Homo sapiens
tctagaacttgtcta

SEQ ID NO: 21267 - DNA, 15 bp, Homo sapiens
ctctagaacttgtct

SEQ ID NO: 21268 - DNA, 15 bp, Homo sapiens
tctctagaacttgtc

SEQ ID NO: 21269 - DNA, 15 bp, Homo sapiens
ttctctagaacttgt

SEQ ID NO: 21270 - DNA, 15 bp, Homo sapiens
tttctctagaacttg

SEQ ID NO: 21271 - DNA, 15 bp, Homo sapiens
ctttctctagaactt

SEQ ID NO: 21272 - DNA, 15 bp, Homo sapiens
gctttctctagaact

SEQ ID NO: 21273 - DNA, 15 bp, Homo sapiens
agctttctctagaac

SEQ ID NO: 21274 - DNA, 15 bp, Homo sapiens
cagctttctctagaa

SEQ ID NO: 21275 - DNA, 15 bp, Homo sapiens
gcagctttctctaga

SEQ ID NO: 21276 - DNA, 15 bp, Homo sapiens
agcagctttctctag

SEQ ID NO: 21277 - DNA, 15 bp, Homo sapiens
tagcagctttctcta

SEQ ID NO: 21278 - DNA, 15 bp, Homo sapiens
ctagcagctttctct

SEQ ID NO: 21279 - DNA, 15 bp, Homo sapiens
actagcagctttctc

SEQ ID NO: 21280 - DNA, 15 bp, Homo sapiens
aactagcagctttct

SEQ ID NO: 21281 - DNA, 15 bp, Homo sapiens
taactagcagctttc

SEQ ID NO: 21282 - DNA, 15 bp, Homo sapiens
ttaactagcagcttt

SEQ ID NO: 21283 - DNA, 15 bp, Homo sapiens
gttaactagcagctt

SEQ ID NO: 21284 - DNA, 15 bp, Homo sapiens
ggttaactagcagct

SEQ ID NO: 21285 - DNA, 15 bp, Homo sapiens
aggttaactagcagc

SEQ ID NO: 21286 - DNA, 15 bp, Homo sapiens
gaggttaactagcag

SEQ ID NO: 21287 - DNA, 15 bp, Homo sapiens
ggaggttaactagca

SEQ ID NO: 21288 - DNA, 15 bp, Homo sapiens
gggaggttaactagc

SEQ ID NO: 21289 - DNA, 15 bp, Homo sapiens
agggaggttaactag

SEQ ID NO: 21290 - DNA, 15 bp, Homo sapiens
tagggaggttaacta

SEQ ID NO: 21291 - DNA, 15 bp, Homo sapiens
gtagggaggttaact

SEQ ID NO: 21292 - DNA, 15 bp, Homo sapiens
ggtagggaggttaac

SEQ ID NO: 21293 - DNA, 15 bp, Homo sapiens
aggtagggaggttaa

SEQ ID NO: 21294 - DNA, 15 bp, Homo sapiens
caggtagggaggtta

SEQ ID NO: 21295 - DNA, 15 bp, Homo sapiens
tcaggtagggaggtt

SEQ ID NO: 21296 - DNA, 15 bp, Homo sapiens
ttcaggtagggaggt

SEQ ID NO: 21297 - DNA, 15 bp, Homo sapiens
cttcaggtagggagg

SEQ ID NO: 21298 - DNA, 15 bp, Homo sapiens
acttcaggtagggag

SEQ ID NO: 21299 - DNA, 15 bp, Homo sapiens
gacttcaggtaggga

SEQ ID NO: 21300 - DNA, 15 bp, Homo sapiens
ggacttcaggtaggg

SEQ ID NO: 21301 - DNA, 15 bp, Homo sapiens
aggacttcaggtagg

SEQ ID NO: 21302 - DNA, 15 bp, Homo sapiens
taggacttcaggtag

SEQ ID NO: 21303 - DNA, 15 bp, Homo sapiens
ttaggacttcaggta

SEQ ID NO: 21304 - DNA, 15 bp, Homo sapiens
attaggacttcaggt

SEQ ID NO: 21305 - DNA, 15 bp, Homo sapiens
aattaggacttcagg

SEQ ID NO: 21306 - DNA, 15 bp, Homo sapiens
caattaggacttcag

SEQ ID NO: 21307 - DNA, 15 bp, Homo sapiens
ccaattaggacttca

SEQ ID NO: 21308 - DNA, 15 bp, Homo sapiens
accaattaggacttc

SEQ ID NO: 21309 - DNA, 15 bp, Homo sapiens
aaccaattaggactt

SEQ ID NO: 21310 - DNA, 15 bp, Homo sapiens
aaaccaattaggact

SEQ ID NO: 21311 - DNA, 15 bp, Homo sapiens
aaaaccaattaggac

SEQ ID NO: 21312 - DNA, 15 bp, Homo sapiens
aaaaaccaattagga

SEQ ID NO: 21313 - DNA, 15 bp, Homo sapiens
gaaaaaccaattagg

SEQ ID NO: 21314 - DNA, 15 bp, Homo sapiens
agaaaaaccaattag

SEQ ID NO: 21315 - DNA, 15 bp, Homo sapiens
tagaaaaaccaatta

SEQ ID NO: 21316 - DNA, 15 bp, Homo sapiens
atagaaaaaccaatt

SEQ ID NO: 21317 - DNA, 15 bp, Homo sapiens
gatagaaaaaccaat

SEQ ID NO: 21318 - DNA, 15 bp, Homo sapiens
tgatagaaaaaccaa

SEQ ID NO: 21319 - DNA, 15 bp, Homo sapiens
gtgatagaaaaacca

SEQ ID NO: 21320 - DNA, 15 bp, Homo sapiens
tgtgatagaaaaacc

SEQ ID NO: 21321 - DNA, 15 bp, Homo sapiens
atgtgatagaaaaac

SEQ ID NO: 21322 - DNA, 15 bp, Homo sapiens
catgtgatagaaaaa

SEQ ID NO: 21323 - DNA, 15 bp, Homo sapiens
acatgtgatagaaaa

SEQ ID NO: 21324 - DNA, 15 bp, Homo sapiens
aacatgtgatagaaa

SEQ ID NO: 21325 - DNA, 15 bp, Homo sapiens
caacatgtgatagaa

SEQ ID NO: 21326 - DNA, 15 bp, Homo sapiens
tcaacatgtgataga

SEQ ID NO: 21327 - DNA, 15 bp, Homo sapiens
ttcaacatgtgatag

SEQ ID NO: 21328 - DNA, 15 bp, Homo sapiens
attcaacatgtgata

SEQ ID NO: 21329 - DNA, 15 bp, Homo sapiens
cattcaacatgtgat

SEQ ID NO: 21330 - DNA, 15 bp, Homo sapiens
tcattcaacatgtga

SEQ ID NO: 21331 - DNA, 15 bp, Homo sapiens
ttcattcaacatgtg

SEQ ID NO: 21332 - DNA, 15 bp, Homo sapiens
cttcattcaacatgt

SEQ ID NO: 21333 - DNA, 15 bp, Homo sapiens
gcttcattcaacatg

SEQ ID NO: 21334 - DNA, 15 bp, Homo sapiens
cgcttcattcaacat

SEQ ID NO: 21335 - DNA, 15 bp, Homo sapiens
acgcttcattcaaca

SEQ ID NO: 21336 - DNA, 15 bp, Homo sapiens
cacgcttcattcaac

SEQ ID NO: 21337 - DNA, 15 bp, Homo sapiens
gcacgcttcattcaa

SEQ ID NO: 21338 - DNA, 15 bp, Homo sapiens
agcacgcttcattca

SEQ ID NO: 21339 - DNA, 15 bp, Homo sapiens
aagcacgcttcattc

SEQ ID NO: 21340 - DNA, 15 bp, Homo sapiens
aaagcacgcttcatt

SEQ ID NO: 21341 - DNA, 15 bp, Homo sapiens
aaaagcacgcttcat

SEQ ID NO: 21342 - DNA, 15 bp, Homo sapiens
aaaaagcacgcttca

SEQ ID NO: 21343 - DNA, 15 bp, Homo sapiens
gaaaaagcacgcttc

SEQ ID NO: 21344 - DNA, 15 bp, Homo sapiens
agaaaaagcacgctt

SEQ ID NO: 21345 - DNA, 15 bp, Homo sapiens
gagaaaaagcacgct

SEQ ID NO: 21346 - DNA, 15 bp, Homo sapiens
tgagaaaaagcacgc

SEQ ID NO: 21347 - DNA, 15 bp, Homo sapiens
ttgagaaaaagcacg

SEQ ID NO: 21348 - DNA, 15 bp, Homo sapiens
tttgagaaaaagcac

SEQ ID NO: 21349 - DNA, 15 bp, Homo sapiens
ttttgagaaaaagca

SEQ ID NO: 21350 - DNA, 15 bp, Homo sapiens
tttttgagaaaaagc

SEQ ID NO: 21351 - DNA, 15 bp, Homo sapiens
ctttttgagaaaaag

SEQ ID NO: 21352 - DNA, 15 bp, Homo sapiens
actttttgagaaaaa

SEQ ID NO: 21353 - DNA, 15 bp, Homo sapiens
tactttttgagaaaa

SEQ ID NO: 21354 - DNA, 15 bp, Homo sapiens
ctactttttgagaaa

SEQ ID NO: 21355 - DNA, 15 bp, Homo sapiens
tctactttttgagaa

SEQ ID NO: 21356 - DNA, 15 bp, Homo sapiens
atctactttttgaga

SEQ ID NO: 21357 - DNA, 15 bp, Homo sapiens
tatctactttttgag

SEQ ID NO: 21358 - DNA, 15 bp, Homo sapiens
ctatctactttttga

SEQ ID NO: 21359 - DNA, 15 bp, Homo sapiens
actatctactttttg

SEQ ID NO: 21360 - DNA, 15 bp, Homo sapiens
gactatctacttttt

SEQ ID NO: 21361 - DNA, 15 bp, Homo sapiens
tgactatctactttt

SEQ ID NO: 21362 - DNA, 15 bp, Homo sapiens
atgactatctacttt

SEQ ID NO: 21363 - DNA, 15 bp, Homo sapiens
gatgactatctactt

SEQ ID NO: 21364 - DNA, 15 bp, Homo sapiens
agatgactatctact

SEQ ID NO: 21365 - DNA, 15 bp, Homo sapiens
gagatgactatctac

SEQ ID NO: 21366 - DNA, 15 bp, Homo sapiens
agagatgactatcta

SEQ ID NO: 21367 - DNA, 15 bp, Homo sapiens
gagagatgactatct

SEQ ID NO: 21368 - DNA, 15 bp, Homo sapiens
agagagatgactatc

SEQ ID NO: 21369 - DNA, 15 bp, Homo sapiens
cagagagatgactat

SEQ ID NO: 21370 - DNA, 15 bp, Homo sapiens
acagagagatgacta

SEQ ID NO: 21371 - DNA, 15 bp, Homo sapiens
tacagagagatgact

SEQ ID NO: 21372 - DNA, 15 bp, Homo sapiens
atacagagagatgac

SEQ ID NO: 21373 - DNA, 15 bp, Homo sapiens
aatacagagagatga

SEQ ID NO: 21374 - DNA, 15 bp, Homo sapiens
gaatacagagagatg

SEQ ID NO: 21375 - DNA, 15 bp, Homo sapiens
tgaatacagagagat

SEQ ID NO: 21376 - DNA, 15 bp, Homo sapiens
atgaatacagagaga

SEQ ID NO: 21377 - DNA, 15 bp, Homo sapiens
aatgaatacagagag

SEQ ID NO: 21378 - DNA, 15 bp, Homo sapiens
taatgaatacagaga

SEQ ID NO: 21379 - DNA, 15 bp, Homo sapiens
ctaatgaatacagag

SEQ ID NO: 21380 - DNA, 15 bp, Homo sapiens
tctaatgaatacaga

SEQ ID NO: 21381 - DNA, 15 bp, Homo sapiens
ctctaatgaatacag

SEQ ID NO: 21382 - DNA, 15 bp, Homo sapiens
tctctaatgaataca

SEQ ID NO: 21383 - DNA, 15 bp, Homo sapiens
atctctaatgaatac

SEQ ID NO: 21384 - DNA, 15 bp, Homo sapiens
aatctctaatgaata

SEQ ID NO: 21385 - DNA, 15 bp, Homo sapiens
caatctctaatgaat

SEQ ID NO: 21386 - DNA, 15 bp, Homo sapiens
ccaatctctaatgaa

SEQ ID NO: 21387 - DNA, 15 bp, Homo sapiens
accaatctctaatga

SEQ ID NO: 21388 - DNA, 15 bp, Homo sapiens
aaccaatctctaatg

SEQ ID NO: 21389 - DNA, 15 bp, Homo sapiens
gaaccaatctctaat

SEQ ID NO: 21390 - DNA, 15 bp, Homo sapiens
ggaaccaatctctaa

SEQ ID NO: 21391 - DNA, 15 bp, Homo sapiens
tggaaccaatctcta

SEQ ID NO: 21392 - DNA, 15 bp, Homo sapiens
ctggaaccaatctct

SEQ ID NO: 21393 - DNA, 15 bp, Homo sapiens
cctggaaccaatctc

SEQ ID NO: 21394 - DNA, 15 bp, Homo sapiens
tcctggaaccaatct

SEQ ID NO: 21395 - DNA, 15 bp, Homo sapiens
gtcctggaaccaatc

SEQ ID NO: 21396 - DNA, 15 bp, Homo sapiens
ggtcctggaaccaat

SEQ ID NO: 21397 - DNA, 15 bp, Homo sapiens
aggtcctggaaccaa

SEQ ID NO: 21398 - DNA, 15 bp, Homo sapiens
gaggtcctggaacca

SEQ ID NO: 21399 - DNA, 15 bp, Homo sapiens
ggaggtcctggaacc

SEQ ID NO: 21400 - DNA, 15 bp, Homo sapiens
gggaggtcctggaac

SEQ ID NO: 21401 - DNA, 15 bp, Homo sapiens
agggaggtcctggaa

SEQ ID NO: 21402 - DNA, 15 bp, Homo sapiens
gagggaggtcctgga

SEQ ID NO: 21403 - DNA, 15 bp, Homo sapiens
tgagggaggtcctgg

SEQ ID NO: 21404 - DNA, 15 bp, Homo sapiens
ctgagggaggtcctg

SEQ ID NO: 21405 - DNA, 15 bp, Homo sapiens
tctgagggaggtcct

SEQ ID NO: 21406 - DNA, 15 bp, Homo sapiens
atctgagggaggtcc

SEQ ID NO: 21407 - DNA, 15 bp, Homo sapiens
tatctgagggaggtc

SEQ ID NO: 21408 - DNA, 15 bp, Homo sapiens
gtatctgagggaggt

SEQ ID NO: 21409 - DNA, 15 bp, Homo sapiens
ggtatctgagggagg

SEQ ID NO: 21410 - DNA, 15 bp, Homo sapiens
tggtatctgagggag

SEQ ID NO: 21411 - DNA, 15 bp, Homo sapiens
ttggtatctgaggga

SEQ ID NO: 21412 - DNA, 15 bp, Homo sapiens
tttggtatctgaggg

SEQ ID NO: 21413 - DNA, 15 bp, Homo sapiens
gtttggtatctgagg

SEQ ID NO: 21414 - DNA, 15 bp, Homo sapiens
agtttggtatctgag

SEQ ID NO: 21415 - DNA, 15 bp, Homo sapiens
gagtttggtatctga

SEQ ID NO: 21416 - DNA, 15 bp, Homo sapiens
agagtttggtatctg

SEQ ID NO: 21417 - DNA, 15 bp, Homo sapiens
cagagtttggtatct

SEQ ID NO: 21418 - DNA, 15 bp, Homo sapiens
gcagagtttggtatc

SEQ ID NO: 21419 - DNA, 15 bp, Homo sapiens
tgcagagtttggtat

SEQ ID NO: 21420 - DNA, 15 bp, Homo sapiens
ctgcagagtttggta

SEQ ID NO: 21421 - DNA, 15 bp, Homo sapiens
tctgcagagtttggt

SEQ ID NO: 21422 - DNA, 15 bp, Homo sapiens
atctgcagagtttgg

SEQ ID NO: 21423 - DNA, 15 bp, Homo sapiens
catctgcagagtttg

SEQ ID NO: 21424 - DNA, 15 bp, Homo sapiens
gcatctgcagagttt

SEQ ID NO: 21425 - DNA, 15 bp, Homo sapiens
agcatctgcagagtt

SEQ ID NO: 21426 - DNA, 15 bp, Homo sapiens
gagcatctgcagagt

SEQ ID NO: 21427 - DNA, 15 bp, Homo sapiens
tgagcatctgcagag

SEQ ID NO: 21428 - DNA, 15 bp, Homo sapiens
ttgagcatctgcaga

SEQ ID NO: 21429 - DNA, 15 bp, Homo sapiens
cttgagcatctgcag

SEQ ID NO: 21430 - DNA, 15 bp, Homo sapiens
acttgagcatctgca

SEQ ID NO: 21431 - DNA, 15 bp, Homo sapiens
gacttgagcatctgc

SEQ ID NO: 21432 - DNA, 15 bp, Homo sapiens
agacttgagcatctg

SEQ ID NO: 21433 - DNA, 15 bp, Homo sapiens
gagacttgagcatct

SEQ ID NO: 21434 - DNA, 15 bp, Homo sapiens
agagacttgagcatc

SEQ ID NO: 21435 - DNA, 15 bp, Homo sapiens
cagagacttgagcat

SEQ ID NO: 21436 - DNA, 15 bp, Homo sapiens
tcagagacttgagca

SEQ ID NO: 21437 - DNA, 15 bp, Homo sapiens
ttcagagacttgagc

SEQ ID NO: 21438 - DNA, 15 bp, Homo sapiens
tttcagagacttgag

SEQ ID NO: 21439 - DNA, 15 bp, Homo sapiens
atttcagagacttga

SEQ ID NO: 21440 - DNA, 15 bp, Homo sapiens
catttcagagacttg

SEQ ID NO: 21441 - DNA, 15 bp, Homo sapiens
tcatttcagagactt

SEQ ID NO: 21442 - DNA, 15 bp, Homo sapiens
ttcatttcagagact

SEQ ID NO: 21443 - DNA, 15 bp, Homo sapiens
tttcatttcagagac

SEQ ID NO: 21444 - DNA, 15 bp, Homo sapiens
atttcatttcagaga

SEQ ID NO: 21445 - DNA, 15 bp, Homo sapiens
catttcatttcagag

SEQ ID NO: 21446 - DNA, 15 bp, Homo sapiens
ccatttcatttcaga

SEQ ID NO: 21447 - DNA, 15 bp, Homo sapiens
accatttcatttcag

SEQ ID NO: 21448 - DNA, 15 bp, Homo sapiens
aaccatttcatttca

SEQ ID NO: 21449 - DNA, 15 bp, Homo sapiens
gaaccatttcatttc

SEQ ID NO: 21450 - DNA, 15 bp, Homo sapiens
tgaaccatttcattt

SEQ ID NO: 21451 - DNA, 15 bp, Homo sapiens
ctgaaccatttcatt

SEQ ID NO: 21452 - DNA, 15 bp, Homo sapiens
actgaaccatttcat

SEQ ID NO: 21453 - DNA, 15 bp, Homo sapiens
tactgaaccatttca

SEQ ID NO: 21454 - DNA, 15 bp, Homo sapiens
gtactgaaccatttc

SEQ ID NO: 21455 - DNA, 15 bp, Homo sapiens
agtactgaaccattt

SEQ ID NO: 21456 - DNA, 15 bp, Homo sapiens
aagtactgaaccatt

SEQ ID NO: 21457 - DNA, 15 bp, Homo sapiens
caagtactgaaccat

SEQ ID NO: 21458 - DNA, 15 bp, Homo sapiens
gcaagtactgaacca

SEQ ID NO: 21459 - DNA, 15 bp, Homo sapiens
tgcaagtactgaacc

SEQ ID NO: 21460 - DNA, 15 bp, Homo sapiens
atgcaagtactgaac

SEQ ID NO: 21461 - DNA, 15 bp, Homo sapiens
tatgcaagtactgaa

SEQ ID NO: 21462 - DNA, 15 bp, Homo sapiens
atatgcaagtactga

SEQ ID NO: 21463 - DNA, 15 bp, Homo sapiens
tatatgcaagtactg

SEQ ID NO: 21464 - DNA, 15 bp, Homo sapiens
ttatatgcaagtact

SEQ ID NO: 21465 - DNA, 15 bp, Homo sapiens
gttatatgcaagtac

SEQ ID NO: 21466 - DNA, 15 bp, Homo sapiens
ggttatatgcaagta

SEQ ID NO: 21467 - DNA, 15 bp, Homo sapiens
aggttatatgcaagt

SEQ ID NO: 21468 - DNA, 15 bp, Homo sapiens
aaggttatatgcaag

SEQ ID NO: 21469 - DNA, 15 bp, Homo sapiens
caaggttatatgcaa

SEQ ID NO: 21470 - DNA, 15 bp, Homo sapiens
acaaggttatatgca

SEQ ID NO: 21471 - DNA, 15 bp, Homo sapiens
aacaaggttatatgc

SEQ ID NO: 21472 - DNA, 15 bp, Homo sapiens
gaacaaggttatatg

SEQ ID NO: 21473 - DNA, 15 bp, Homo sapiens
tgaacaaggttatat

SEQ ID NO: 21474 - DNA, 15 bp, Homo sapiens
atgaacaaggttata

SEQ ID NO: 21475 - DNA, 15 bp, Homo sapiens
gatgaacaaggttat

SEQ ID NO: 21476 - DNA, 15 bp, Homo sapiens
ggatgaacaaggtta

SEQ ID NO: 21477 - DNA, 15 bp, Homo sapiens
aggatgaacaaggtt

SEQ ID NO: 21478 - DNA, 15 bp, Homo sapiens
gaggatgaacaaggt

SEQ ID NO: 21479 - DNA, 15 bp, Homo sapiens
ggaggatgaacaagg

SEQ ID NO: 21480 - DNA, 15 bp, Homo sapiens
tggaggatgaacaag

SEQ ID NO: 21481 - DNA, 15 bp, Homo sapiens
ctggaggatgaacaa

SEQ ID NO: 21482 - DNA, 15 bp, Homo sapiens
actggaggatgaaca

SEQ ID NO: 21483 - DNA, 15 bp, Homo sapiens
tactggaggatgaac

SEQ ID NO: 21484 - DNA, 15 bp, Homo sapiens
atactggaggatgaa

SEQ ID NO: 21485 - DNA, 15 bp, Homo sapiens
tatactggaggatga

SEQ ID NO: 21486 - DNA, 15 bp, Homo sapiens
gtatactggaggatg

SEQ ID NO: 21487 - DNA, 15 bp, Homo sapiens
agtatactggaggat

SEQ ID NO: 21488 - DNA, 15 bp, Homo sapiens
aagtatactggagga

SEQ ID NO: 21489 - DNA, 15 bp, Homo sapiens
caagtatactggagg

SEQ ID NO: 21490 - DNA, 15 bp, Homo sapiens
tcaagtatactggag

SEQ ID NO: 21491 - DNA, 15 bp, Homo sapiens
ttcaagtatactgga

SEQ ID NO: 21492 - DNA, 15 bp, Homo sapiens
tttcaagtatactgg

SEQ ID NO: 21493 - DNA, 15 bp, Homo sapiens
ttttcaagtatactg

SEQ ID NO: 21494 - DNA, 15 bp, Homo sapiens
gttttcaagtatact

SEQ ID NO: 21495 - DNA, 15 bp, Homo sapiens
tgttttcaagtatac

SEQ ID NO: 21496 - DNA, 15 bp, Homo sapiens
atgttttcaagtata

SEQ ID NO: 21497 - DNA, 15 bp, Homo sapiens
gatgttttcaagtat

SEQ ID NO: 21498 - DNA, 15 bp, Homo sapiens
agatgttttcaagta

SEQ ID NO: 21499 - DNA, 15 bp, Homo sapiens
gagatgttttcaagt

SEQ ID NO: 21500 - DNA, 15 bp, Homo sapiens
ggagatgttttcaag

SEQ ID NO: 21501 - DNA, 15 bp, Homo sapiens
tggagatgttttcaa

SEQ ID NO: 21502 - DNA, 15 bp, Homo sapiens
ctggagatgttttca

SEQ ID NO: 21503 - DNA, 15 bp, Homo sapiens
tctggagatgttttc

SEQ ID NO: 21504 - DNA, 15 bp, Homo sapiens
atctggagatgtttt

SEQ ID NO: 21505 - DNA, 15 bp, Homo sapiens
aatctggagatgttt

SEQ ID NO: 21506 - DNA, 15 bp, Homo sapiens
taatctggagatgtt

SEQ ID NO: 21507 - DNA, 15 bp, Homo sapiens
gtaatctggagatgt

SEQ ID NO: 21508 - DNA, 15 bp, Homo sapiens
agtaatctggagatg

SEQ ID NO: 21509 - DNA, 15 bp, Homo sapiens
aagtaatctggagat

SEQ ID NO: 21510 - DNA, 15 bp, Homo sapiens
taagtaatctggaga

SEQ ID NO: 21511 - DNA, 15 bp, Homo sapiens
gtaagtaatctggag

SEQ ID NO: 21512 - DNA, 15 bp, Homo sapiens
tgtaagtaatctgga

SEQ ID NO: 21513 - DNA, 15 bp, Homo sapiens
ctgtaagtaatctgg

SEQ ID NO: 21514 - DNA, 15 bp, Homo sapiens
actgtaagtaatctg

SEQ ID NO: 21515 - DNA, 15 bp, Homo sapiens
tactgtaagtaatct

SEQ ID NO: 21516 - DNA, 15 bp, Homo sapiens
gtactgtaagtaatc

SEQ ID NO: 21517 - DNA, 15 bp, Homo sapiens
ggtactgtaagtaat

SEQ ID NO: 21518 - DNA, 15 bp, Homo sapiens
aggtactgtaagtaa

SEQ ID NO: 21519 - DNA, 15 bp, Homo sapiens
taggtactgtaagta

SEQ ID NO: 21520 - DNA, 15 bp, Homo sapiens
ttaggtactgtaagt

SEQ ID NO: 21521 - DNA, 15 bp, Homo sapiens
gttaggtactgtaag

SEQ ID NO: 21522 - DNA, 15 bp, Homo sapiens
cgttaggtactgtaa

SEQ ID NO: 21523 - DNA, 15 bp, Homo sapiens
acgttaggtactgta

SEQ ID NO: 21524 - DNA, 15 bp, Homo sapiens
tacgttaggtactgt

SEQ ID NO: 21525 - DNA, 15 bp, Homo sapiens
ttacgttaggtactg

SEQ ID NO: 21526 - DNA, 15 bp, Homo sapiens
attacgttaggtact

SEQ ID NO: 21527 - DNA, 15 bp, Homo sapiens
tattacgttaggtac

SEQ ID NO: 21528 - DNA, 15 bp, Homo sapiens
atattacgttaggta

SEQ ID NO: 21529 - DNA, 15 bp, Homo sapiens
aatattacgttaggt

SEQ ID NO: 21530 - DNA, 15 bp, Homo sapiens
taatattacgttagg

SEQ ID NO: 21531 - DNA, 15 bp, Homo sapiens
ataatattacgttag

SEQ ID NO: 21532 - DNA, 15 bp, Homo sapiens
tataatattacgtta

SEQ ID NO: 21533 - DNA, 15 bp, Homo sapiens
ttataatattacgtt

SEQ ID NO: 21534 - DNA, 15 bp, Homo sapiens
tttataatattacgt

SEQ ID NO: 21535 - DNA, 15 bp, Homo sapiens
atttataatattacg

SEQ ID NO: 21536 - DNA, 15 bp, Homo sapiens
catttataatattac

SEQ ID NO: 21537 - DNA, 15 bp, Homo sapiens
tcatttataatatta

SEQ ID NO: 21538 - DNA, 15 bp, Homo sapiens
atcatttataatatt

SEQ ID NO: 21539 - DNA, 15 bp, Homo sapiens
tatcatttataatat

SEQ ID NO: 21540 - DNA, 15 bp, Homo sapiens
atatcatttataata

SEQ ID NO: 21541 - DNA, 15 bp, Homo sapiens
catatcatttataat

SEQ ID NO: 21542 - DNA, 15 bp, Homo sapiens
acatatcatttataa

SEQ ID NO: 21543 - DNA, 15 bp, Homo sapiens
tacatatcatttata

SEQ ID NO: 21544 - DNA, 15 bp, Homo sapiens
ttacatatcatttat

SEQ ID NO: 21545 - DNA, 15 bp, Homo sapiens
tttacatatcattta

SEQ ID NO: 21546 - DNA, 15 bp, Homo sapiens
atttacatatcattt

SEQ ID NO: 21547 - DNA, 15 bp, Homo sapiens
tatttacatatcatt

SEQ ID NO: 21548 - DNA, 15 bp, Homo sapiens
ctatttacatatcat

SEQ ID NO: 21549 - DNA, 15 bp, Homo sapiens
actatttacatatca

SEQ ID NO: 21550 - DNA, 15 bp, Homo sapiens
aactatttacatatc

SEQ ID NO: 21551 - DNA, 15 bp, Homo sapiens
taactatttacatat

SEQ ID NO: 21552 - DNA, 15 bp, Homo sapiens
ttaactatttacata

SEQ ID NO: 21553 - DNA, 15 bp, Homo sapiens
tttaactatttacat

SEQ ID NO: 21554 - DNA, 15 bp, Homo sapiens
gtttaactatttaca

SEQ ID NO: 21555 - DNA, 15 bp, Homo sapiens
agtttaactatttac

SEQ ID NO: 21556 - DNA, 15 bp, Homo sapiens
cagtttaactattta

SEQ ID NO: 21557 - DNA, 15 bp, Homo sapiens
acagtttaactattt

SEQ ID NO: 21558 - DNA, 15 bp, Homo sapiens
cacagtttaactatt

SEQ ID NO: 21559 - DNA, 15 bp, Homo sapiens
acacagtttaactat

SEQ ID NO: 21560 - DNA, 15 bp, Homo sapiens
aacacagtttaacta

SEQ ID NO: 21561 - DNA, 15 bp, Homo sapiens
caacacagtttaact

SEQ ID NO: 21562 - DNA, 15 bp, Homo sapiens
acaacacagtttaac

SEQ ID NO: 21563 - DNA, 15 bp, Homo sapiens
aacaacacagtttaa

SEQ ID NO: 21564 - DNA, 15 bp, Homo sapiens
aaacaacacagttta

SEQ ID NO: 21565 - DNA, 15 bp, Homo sapiens
taaacaacacagttt

SEQ ID NO: 21566 - DNA, 15 bp, Homo sapiens
ctaaacaacacagtt

SEQ ID NO: 21567 - DNA, 15 bp, Homo sapiens
cctaaacaacacagt

SEQ ID NO: 21568 - DNA, 15 bp, Homo sapiens
ccctaaacaacacag

SEQ ID NO: 21569 - DNA, 15 bp, Homo sapiens
tccctaaacaacaca

SEQ ID NO: 21570 - DNA, 15 bp, Homo sapiens
atccctaaacaacac

SEQ ID NO: 21571 - DNA, 15 bp, Homo sapiens
tatccctaaacaaca

SEQ ID NO: 21572 - DNA, 15 bp, Homo sapiens
ctatccctaaacaac

SEQ ID NO: 21573 - DNA, 15 bp, Homo sapiens
actatccctaaacaa

SEQ ID NO: 21574 - DNA, 15 bp, Homo sapiens
aactatccctaaaca

SEQ ID NO: 21575 - DNA, 15 bp, Homo sapiens
taactatccctaaac

SEQ ID NO: 21576 - DNA, 15 bp, Homo sapiens
ttaactatccctaaa

SEQ ID NO: 21577 - DNA, 15 bp, Homo sapiens
gttaactatccctaa

SEQ ID NO: 21578 - DNA, 15 bp, Homo sapiens
ggttaactatcccta

SEQ ID NO: 21579 - DNA, 15 bp, Homo sapiens
aggttaactatccct

SEQ ID NO: 21580 - DNA, 15 bp, Homo sapiens
caggttaactatccc

SEQ ID NO: 21581 - DNA, 15 bp, Homo sapiens
acaggttaactatcc

SEQ ID NO: 21582 - DNA, 15 bp, Homo sapiens
cacaggttaactatc

SEQ ID NO: 21583 - DNA, 15 bp, Homo sapiens
acacaggttaactat

SEQ ID NO: 21584 - DNA, 15 bp, Homo sapiens
aacacaggttaacta

SEQ ID NO: 21585 - DNA, 15 bp, Homo sapiens
caacacaggttaact

SEQ ID NO: 21586 - DNA, 15 bp, Homo sapiens
acaacacaggttaac

SEQ ID NO: 21587 - DNA, 15 bp, Homo sapiens
aacaacacaggttaa

SEQ ID NO: 21588 - DNA, 15 bp, Homo sapiens
aaacaacacaggtta

SEQ ID NO: 21589 - DNA, 15 bp, Homo sapiens
taaacaacacaggtt

SEQ ID NO: 21590 - DNA, 15 bp, Homo sapiens
ctaaacaacacaggt

SEQ ID NO: 21591 - DNA, 15 bp, Homo sapiens
cctaaacaacacagg

SEQ ID NO: 21592 - DNA, 15 bp, Homo sapiens
ttccctaaacaacac

SEQ ID NO: 21593 - DNA, 15 bp, Homo sapiens
attccctaaacaaca

SEQ ID NO: 21594 - DNA, 15 bp, Homo sapiens
tattccctaaacaac

SEQ ID NO: 21595 - DNA, 15 bp, Homo sapiens
ttattccctaaacaa

SEQ ID NO: 21596 - DNA, 15 bp, Homo sapiens
attattccctaaaca

SEQ ID NO: 21597 - DNA, 15 bp, Homo sapiens
cattattccctaaac

SEQ ID NO: 21598 - DNA, 15 bp, Homo sapiens
tcattattccctaaa

SEQ ID NO: 21599 - DNA, 15 bp, Homo sapiens
gtcattattccctaa

SEQ ID NO: 21600 - DNA, 15 bp, Homo sapiens
tgtcattattcccta

SEQ ID NO: 21601 - DNA, 15 bp, Homo sapiens
ttgtcattattccct

SEQ ID NO: 21602 - DNA, 15 bp, Homo sapiens
cttgtcattattccc

SEQ ID NO: 21603 - DNA, 15 bp, Homo sapiens
tcttgtcattattcc

SEQ ID NO: 21604 - DNA, 15 bp, Homo sapiens
ttcttgtcattattc

SEQ ID NO: 21605 - DNA, 15 bp, Homo sapiens
tttcttgtcattatt

SEQ ID NO: 21606 - DNA, 15 bp, Homo sapiens
ttttcttgtcattat

SEQ ID NO: 21607 - DNA, 15 bp, Homo sapiens
tttttcttgtcatta

SEQ ID NO: 21608 - DNA, 15 bp, Homo sapiens
ttttttcttgtcatt

SEQ ID NO: 21609 - DNA, 15 bp, Homo sapiens
tttttttcttgtcat

SEQ ID NO: 21610 - DNA, 15 bp, Homo sapiens
atttttttcttgtca

SEQ ID NO: 21611 - DNA, 15 bp, Homo sapiens
catttttttcttgtc

SEQ ID NO: 21612 - DNA, 15 bp, Homo sapiens
acatttttttcttgt

SEQ ID NO: 21613 - DNA, 15 bp, Homo sapiens
tacatttttttcttg

SEQ ID NO: 21614 - DNA, 15 bp, Homo sapiens
gtacatttttttctt

SEQ ID NO: 21615 - DNA, 15 bp, Homo sapiens
tgtacatttttttct

SEQ ID NO: 21616 - DNA, 15 bp, Homo sapiens
atgtacatttttttc

SEQ ID NO: 21617 - DNA, 15 bp, Homo sapiens
catgtacattttttt

SEQ ID NO: 21618 - DNA, 15 bp, Homo sapiens
acatgtacatttttt

SEQ ID NO: 21619 - DNA, 15 bp, Homo sapiens
aacatgtacattttt

SEQ ID NO: 21620 - DNA, 15 bp, Homo sapiens
gaacatgtacatttt

SEQ ID NO: 21621 - DNA, 15 bp, Homo sapiens
tgaacatgtacattt

SEQ ID NO: 21622 - DNA, 15 bp, Homo sapiens
ctgaacatgtacatt

SEQ ID NO: 21623 - DNA, 15 bp, Homo sapiens
actgaacatgtacat

SEQ ID NO: 21624 - DNA, 15 bp, Homo sapiens
tactgaacatgtaca

SEQ ID NO: 21625 - DNA, 15 bp, Homo sapiens
gtactgaacatgtac

SEQ ID NO: 21626 - DNA, 15 bp, Homo sapiens
tgtactgaacatgta

SEQ ID NO: 21627 - DNA, 15 bp, Homo sapiens
ctgtactgaacatgt

SEQ ID NO: 21628 - DNA, 15 bp, Homo sapiens
tctgtactgaacatg

SEQ ID NO: 21629 - DNA, 15 bp, Homo sapiens
atctgtactgaacat

SEQ ID NO: 21630 - DNA, 15 bp, Homo sapiens
catctgtactgaaca

SEQ ID NO: 21631 - DNA, 15 bp, Homo sapiens
gcatctgtactgaac

SEQ ID NO: 21632 - DNA, 15 bp, Homo sapiens
tgcatctgtactgaa

SEQ ID NO: 21633 - DNA, 15 bp, Homo sapiens
ctgcatctgtactga

SEQ ID NO: 21634 - DNA, 15 bp, Homo sapiens
actgcatctgtactg

SEQ ID NO: 21635 - DNA, 15 bp, Homo sapiens
aactgcatctgtact

SEQ ID NO: 21636 - DNA, 15 bp, Homo sapiens
taactgcatctgtac

SEQ ID NO: 21637 - DNA, 15 bp, Homo sapiens
ataactgcatctgta

SEQ ID NO: 21638 - DNA, 15 bp, Homo sapiens
aataactgcatctgt

SEQ ID NO: 21639 - DNA, 15 bp, Homo sapiens
aaataactgcatctg

SEQ ID NO: 21640 - DNA, 15 bp, Homo sapiens
aaaataactgcatct

SEQ ID NO: 21641 - DNA, 15 bp, Homo sapiens
aaaaataactgcatc

SEQ ID NO: 21642 - DNA, 15 bp, Homo sapiens
aaaaaataactgcat

SEQ ID NO: 21643 - DNA, 15 bp, Homo sapiens
gaaaaaataactgca

SEQ ID NO: 21644 - DNA, 15 bp, Homo sapiens
ggaaaaaataactgc

SEQ ID NO: 21645 - DNA, 15 bp, Homo sapiens
tggaaaaaataactg

SEQ ID NO: 21646 - DNA, 15 bp, Homo sapiens
atggaaaaaataact

SEQ ID NO: 21647 - DNA, 15 bp, Homo sapiens
gatggaaaaaataac

SEQ ID NO: 21648 - DNA, 15 bp, Homo sapiens
agatggaaaaaataa

SEQ ID NO: 21649 - DNA, 15 bp, Homo sapiens
cagatggaaaaaata

SEQ ID NO: 21650 - DNA, 15 bp, Homo sapiens
gcagatggaaaaaat

SEQ ID NO: 21651 - DNA, 15 bp, Homo sapiens
agcagatggaaaaaa

SEQ ID NO: 21652 - DNA, 15 bp, Homo sapiens
cagcagatggaaaaa

SEQ ID NO: 21653 - DNA, 15 bp, Homo sapiens
acagcagatggaaaa

SEQ ID NO: 21654 - DNA, 15 bp, Homo sapiens
aacagcagatggaaa

SEQ ID NO: 21655 - DNA, 15 bp, Homo sapiens
aaacagcagatggaa

SEQ ID NO: 21656 - DNA, 15 bp, Homo sapiens
taaacagcagatgga

SEQ ID NO: 21657 - DNA, 15 bp, Homo sapiens
ctaaacagcagatgg

SEQ ID NO: 21658 - DNA, 15 bp, Homo sapiens
actaaacagcagatg

SEQ ID NO: 21659 - DNA, 15 bp, Homo sapiens
aactaaacagcagat

SEQ ID NO: 21660 - DNA, 15 bp, Homo sapiens
caactaaacagcaga

SEQ ID NO: 21661 - DNA, 15 bp, Homo sapiens
tcaactaaacagcag

SEQ ID NO: 21662 - DNA, 15 bp, Homo sapiens
gtcaactaaacagca

SEQ ID NO: 21663 - DNA, 15 bp, Homo sapiens
ggtcaactaaacagc

SEQ ID NO: 21664 - DNA, 15 bp, Homo sapiens
cggtcaactaaacag

SEQ ID NO: 21665 - DNA, 15 bp, Homo sapiens
acggtcaactaaaca

SEQ ID NO: 21666 - DNA, 15 bp, Homo sapiens
cacggtcaactaaac

SEQ ID NO: 21667 - DNA, 15 bp, Homo sapiens
ccacggtcaactaaa

SEQ ID NO: 21668 - DNA, 15 bp, Homo sapiens
tccacggtcaactaa

SEQ ID NO: 21669 - DNA, 15 bp, Homo sapiens
atccacggtcaacta

SEQ ID NO: 21670 - DNA, 15 bp, Homo sapiens
catccacggtcaact

SEQ ID NO: 21671 - DNA, 15 bp, Homo sapiens
acatccacggtcaac

SEQ ID NO: 21672 - DNA, 15 bp, Homo sapiens
cacatccacggtcaa

SEQ ID NO: 21673 - DNA, 15 bp, Homo sapiens
ccacatccacggtca

SEQ ID NO: 21674 - DNA, 15 bp, Homo sapiens
tccacatccacggtc

SEQ ID NO: 21675 - DNA, 15 bp, Homo sapiens
ttccacatccacggt

SEQ ID NO: 21676 - DNA, 15 bp, Homo sapiens
gttccacatccacgg

SEQ ID NO: 21677 - DNA, 15 bp, Homo sapiens
ggttccacatccacg

SEQ ID NO: 21678 - DNA, 15 bp, Homo sapiens
gggttccacatccac

SEQ ID NO: 21679 - DNA, 15 bp, Homo sapiens
tgggttccacatcca

SEQ ID NO: 21680 - DNA, 15 bp, Homo sapiens
gtgggttccacatcc

SEQ ID NO: 21681 - DNA, 15 bp, Homo sapiens
tgtgggttccacatc

SEQ ID NO: 21682 - DNA, 15 bp, Homo sapiens
ctgtgggttccacat

SEQ ID NO: 21683 - DNA, 15 bp, Homo sapiens
cctgtgggttccaca

SEQ ID NO: 21684 - DNA, 15 bp, Homo sapiens
acctgtgggttccac

SEQ ID NO: 21685 - DNA, 15 bp, Homo sapiens
tacctgtgggttcca

SEQ ID NO: 21686 - DNA, 15 bp, Homo sapiens
gtacctgtgggttcc

SEQ ID NO: 21687 - DNA, 15 bp, Homo sapiens
tgtacctgtgggttc

SEQ ID NO: 21688 - DNA, 15 bp, Homo sapiens
ctgtacctgtgggtt

SEQ ID NO: 21689 - DNA, 15 bp, Homo sapiens
tctgtacctgtgggt

SEQ ID NO: 21690 - DNA, 15 bp, Homo sapiens
ctctgtacctgtggg

SEQ ID NO: 21691 - DNA, 15 bp, Homo sapiens
cctctgtacctgtgg

SEQ ID NO: 21692 - DNA, 15 bp, Homo sapiens
ccctctgtacctgtg

SEQ ID NO: 21693 - DNA, 15 bp, Homo sapiens
gccctctgtacctgt

SEQ ID NO: 21694 - DNA, 15 bp, Homo sapiens
agccctctgtacctg

SEQ ID NO: 21695 - DNA, 15 bp, Homo sapiens
cagccctctgtacct

SEQ ID NO: 21696 - DNA, 15 bp, Homo sapiens
tcagccctctgtacc

SEQ ID NO: 21697 - DNA, 15 bp, Homo sapiens
gtcagccctctgtac

SEQ ID NO: 21698 - DNA, 15 bp, Homo sapiens
agtcagccctctgta

SEQ ID NO: 21699 - DNA, 15 bp, Homo sapiens
tagtcagccctctgt

SEQ ID NO: 21700 - DNA, 15 bp, Homo sapiens
ttagtcagccctctg

SEQ ID NO: 21701 - DNA, 15 bp, Homo sapiens
tttagtcagccctct

SEQ ID NO: 21702 - DNA, 15 bp, Homo sapiens
ttttagtcagccctc

SEQ ID NO: 21703 - DNA, 15 bp, Homo sapiens
attttagtcagccct

SEQ ID NO: 21704 - DNA, 15 bp, Homo sapiens
aattttagtcagccc

SEQ ID NO: 21705 - DNA, 15 bp, Homo sapiens
caattttagtcagcc

SEQ ID NO: 21706 - DNA, 15 bp, Homo sapiens
gcaattttagtcagc

SEQ ID NO: 21707 - DNA, 15 bp, Homo sapiens
agcaattttagtcag

SEQ ID NO: 21708 - DNA, 15 bp, Homo sapiens
aagcaattttagtca

SEQ ID NO: 21709 - DNA, 15 bp, Homo sapiens
aaagcaattttagtc

SEQ ID NO: 21710 - DNA, 15 bp, Homo sapiens
aaaagcaattttagt

SEQ ID NO: 21711 - DNA, 15 bp, Homo sapiens
taaaagcaattttag

SEQ ID NO: 21712 - DNA, 15 bp, Homo sapiens
ttaaaagcaatttta

SEQ ID NO: 21713 - DNA, 15 bp, Homo sapiens
gttaaaagcaatttt

SEQ ID NO: 21714 - DNA, 15 bp, Homo sapiens
agttaaaagcaattt

SEQ ID NO: 21715 - DNA, 15 bp, Homo sapiens
aagttaaaagcaatt

SEQ ID NO: 21716 - DNA, 15 bp, Homo sapiens
caagttaaaagcaat

SEQ ID NO: 21717 - DNA, 15 bp, Homo sapiens
gcaagttaaaagcaa

SEQ ID NO: 21718 - DNA, 15 bp, Homo sapiens
agcaagttaaaagca

SEQ ID NO: 21719 - DNA, 15 bp, Homo sapiens
aagcaagttaaaagc

SEQ ID NO: 21720 - DNA, 15 bp, Homo sapiens
aaagcaagttaaaag

SEQ ID NO: 21721 - DNA, 15 bp, Homo sapiens
taaagcaagttaaaa

SEQ ID NO: 21722 - DNA, 15 bp, Homo sapiens
ataaagcaagttaaa

SEQ ID NO: 21723 - DNA, 15 bp, Homo sapiens
aataaagcaagttaa

SEQ ID NO: 21724 - DNA, 15 bp, Homo sapiens
gaataaagcaagtta

SEQ ID NO: 21725 - DNA, 15 bp, Homo sapiens
agaataaagcaagtt

SEQ ID NO: 21726 - DNA, 15 bp, Homo sapiens
cagaataaagcaagt

SEQ ID NO: 21727 - DNA, 15 bp, Homo sapiens
acagaataaagcaag

SEQ ID NO: 21728 - DNA, 15 bp, Homo sapiens
cacagaataaagcaa

SEQ ID NO: 21729 - DNA, 15 bp, Homo sapiens
acacagaataaagca

SEQ ID NO: 21730 - DNA, 15 bp, Homo sapiens
tacacagaataaagc

SEQ ID NO: 21731 - DNA, 15 bp, Homo sapiens
atacacagaataaag

SEQ ID NO: 21732 - DNA, 15 bp, Homo sapiens
aatacacagaataaa

SEQ ID NO: 21733 - DNA, 15 bp, Homo sapiens
gaatacacagaataa

SEQ ID NO: 21734 - DNA, 15 bp, Homo sapiens
tgaatacacagaata

SEQ ID NO: 21735 - DNA, 15 bp, Homo sapiens
atgaatacacagaat

SEQ ID NO: 21736 - DNA, 15 bp, Homo sapiens
gatgaatacacagaa

SEQ ID NO: 21737 - DNA, 15 bp, Homo sapiens
tgatgaatacacaga

SEQ ID NO: 21738 - DNA, 15 bp, Homo sapiens
atgatgaatacacag

SEQ ID NO: 21739 - DNA, 15 bp, Homo sapiens
tatgatgaatacaca

SEQ ID NO: 21740 - DNA, 15 bp, Homo sapiens
atatgatgaatacac

SEQ ID NO: 21741 - DNA, 15 bp, Homo sapiens
tatatgatgaataca

SEQ ID NO: 21742 - DNA, 15 bp, Homo sapiens
atatatgatgaatac

SEQ ID NO: 21743 - DNA, 15 bp, Homo sapiens
tatatatgatgaata

SEQ ID NO: 21744 - DNA, 15 bp, Homo sapiens
atatatatgatgaat

SEQ ID NO: 21745 - DNA, 15 bp, Homo sapiens
aatatatatgatgaa

SEQ ID NO: 21746 - DNA, 15 bp, Homo sapiens
aaatatatatgatga

SEQ ID NO: 21747 - DNA, 15 bp, Homo sapiens
aaaatatatatgatg

SEQ ID NO: 21748 - DNA, 15 bp, Homo sapiens
aaaaatatatatgat

SEQ ID NO: 21749 - DNA, 15 bp, Homo sapiens
caaaaatatatatga

SEQ ID NO: 21750 - DNA, 15 bp, Homo sapiens
acaaaaatatatatg

SEQ ID NO: 21751 - DNA, 15 bp, Homo sapiens
aacaaaaatatatat

SEQ ID NO: 21752 - DNA, 15 bp, Homo sapiens
aaacaaaaatatata

SEQ ID NO: 21753 - DNA, 15 bp, Homo sapiens
caaacaaaaatatat

SEQ ID NO: 21754 - DNA, 15 bp, Homo sapiens
acaaacaaaaatata

SEQ ID NO: 21755 - DNA, 15 bp, Homo sapiens
aacaaacaaaaatat

SEQ ID NO: 21756 - DNA, 15 bp, Homo sapiens
aaacaaacaaaaata

SEQ ID NO: 21757 - DNA, 15 bp, Homo sapiens
caaacaaacaaaaat

SEQ ID NO: 21758 - DNA, 15 bp, Homo sapiens
gaacaaacaaacaaa

SEQ ID NO: 21759 - DNA, 15 bp, Homo sapiens
agaacaaacaaacaa

SEQ ID NO: 21760 - DNA, 15 bp, Homo sapiens
aagaacaaacaaaca

SEQ ID NO: 21761 - DNA, 15 bp, Homo sapiens
caagaacaaacaaac

SEQ ID NO: 21762 - DNA, 15 bp, Homo sapiens
acaagaacaaacaaa

SEQ ID NO: 21763 - DNA, 15 bp, Homo sapiens
aacaagaacaaacaa

SEQ ID NO: 21764 - DNA, 15 bp, Homo sapiens
aaacaagaacaaaca

SEQ ID NO: 21765 - DNA, 15 bp, Homo sapiens
aaaacaagaacaaac

SEQ ID NO: 21766 - DNA, 15 bp, Homo sapiens
caaaacaagaacaaa

SEQ ID NO: 21767 - DNA, 15 bp, Homo sapiens
tcaaaacaagaacaa

SEQ ID NO: 21768 - DNA, 15 bp, Homo sapiens
ctcaaaacaagaaca

SEQ ID NO: 21769 - DNA, 15 bp, Homo sapiens
tctcaaaacaagaac

SEQ ID NO: 21770 - DNA, 15 bp, Homo sapiens
atctcaaaacaagaa

SEQ ID NO: 21771 - DNA, 15 bp, Homo sapiens
catctcaaaacaaga

SEQ ID NO: 21772 - DNA, 15 bp, Homo sapiens
ccatctcaaaacaag

SEQ ID NO: 21773 - DNA, 15 bp, Homo sapiens
tgaaactccatctca

SEQ ID NO: 21774 - DNA, 15 bp, Homo sapiens
gtgaaactccatctc

SEQ ID NO: 21775 - DNA, 15 bp, Homo sapiens
agtgaaactccatct

SEQ ID NO: 21776 - DNA, 15 bp, Homo sapiens
gagtgaaactccatc

SEQ ID NO: 21777 - DNA, 15 bp, Homo sapiens
agagtgaaactccat

SEQ ID NO: 21778 - DNA, 15 bp, Homo sapiens
aagagtgaaactcca

SEQ ID NO: 21779 - DNA, 15 bp, Homo sapiens
caagagtgaaactcc

SEQ ID NO: 21780 - DNA, 15 bp, Homo sapiens
acaagagtgaaactc

SEQ ID NO: 21781 - DNA, 15 bp, Homo sapiens
aacaagagtgaaact

SEQ ID NO: 21782 - DNA, 15 bp, Homo sapiens
caacaagagtgaaac

SEQ ID NO: 21783 - DNA, 15 bp, Homo sapiens
acagcctgggcaaca

SEQ ID NO: 21784 - DNA, 15 bp, Homo sapiens
tacagcctgggcaac

SEQ ID NO: 21785 - DNA, 15 bp, Homo sapiens
ctacagcctgggcaa

SEQ ID NO: 21786 - DNA, 15 bp, Homo sapiens
actacagcctgggca

SEQ ID NO: 21787 - DNA, 15 bp, Homo sapiens
ttgcactacagcctg

SEQ ID NO: 21788 - DNA, 15 bp, Homo sapiens
attgcactacagcct

SEQ ID NO: 21789 - DNA, 15 bp, Homo sapiens
cattgcactacagcc

SEQ ID NO: 21790 - DNA, 15 bp, Homo sapiens
ccattgcactacagc

SEQ ID NO: 21791 - DNA, 15 bp, Homo sapiens
gccattgcactacag

SEQ ID NO: 21792 - DNA, 15 bp, Homo sapiens
ggccattgcactaca

SEQ ID NO: 21793 - DNA, 15 bp, Homo sapiens
gggccattgcactac

SEQ ID NO: 21794 - DNA, 15 bp, Homo sapiens
cgggccattgcacta

SEQ ID NO: 21795 - DNA, 15 bp, Homo sapiens
tcgggccattgcact

SEQ ID NO: 21796 - DNA, 15 bp, Homo sapiens
atcgggccattgcac

SEQ ID NO: 21797 - DNA, 15 bp, Homo sapiens
gatcgggccattgca

SEQ ID NO: 21798 - DNA, 15 bp, Homo sapiens
agatcgggccattgc

SEQ ID NO: 21799 - DNA, 15 bp, Homo sapiens
gagatcgggccattg

SEQ ID NO: 21800 - DNA, 15 bp, Homo sapiens
tgagatcgggccatt

SEQ ID NO: 21801 - DNA, 15 bp, Homo sapiens
ctgagatcgggccat

SEQ ID NO: 21802 - DNA, 15 bp, Homo sapiens
gctgagatcgggcca

SEQ ID NO: 21803 - DNA, 15 bp, Homo sapiens
agctgagatcgggcc

SEQ ID NO: 21804 - DNA, 15 bp, Homo sapiens
gagctgagatcgggc

SEQ ID NO: 21805 - DNA, 15 bp, Homo sapiens
tgagctgagatcggg

SEQ ID NO: 21806 - DNA, 15 bp, Homo sapiens
gtgagctgagatcgg

SEQ ID NO: 21807 - DNA, 15 bp, Homo sapiens
tagtgagctgagatc

SEQ ID NO: 21808 - DNA, 15 bp, Homo sapiens
gtagtgagctgagat

SEQ ID NO: 21809 - DNA, 15 bp, Homo sapiens
tgtagtgagctgaga

SEQ ID NO: 21810 - DNA, 15 bp, Homo sapiens
ttgtagtgagctgag

SEQ ID NO: 21811 - DNA, 15 bp, Homo sapiens
gttgtagtgagctga

SEQ ID NO: 21812 - DNA, 15 bp, Homo sapiens
ggttgtagtgagctg

SEQ ID NO: 21813 - DNA, 15 bp, Homo sapiens
aggttgtagtgagct

SEQ ID NO: 21814 - DNA, 15 bp, Homo sapiens
gaggttgtagtgagc

SEQ ID NO: 21815 - DNA, 15 bp, Homo sapiens
ggaggttgtagtgag

SEQ ID NO: 21816 - DNA, 15 bp, Homo sapiens
cggaggttgtagtga

SEQ ID NO: 21817 - DNA, 15 bp, Homo sapiens
gcggaggttgtagtg

SEQ ID NO: 21818 - DNA, 15 bp, Homo sapiens
ggcggaggttgtagt

SEQ ID NO: 21819 - DNA, 15 bp, Homo sapiens
aggcggaggttgtag

SEQ ID NO: 21820 - DNA, 15 bp, Homo sapiens
aaggcggaggttgta

SEQ ID NO: 21821 - DNA, 15 bp, Homo sapiens
gaaggcggaggttgt

SEQ ID NO: 21822 - DNA, 15 bp, Homo sapiens
agaaggcggaggttg

SEQ ID NO: 21823 - DNA, 15 bp, Homo sapiens
cagaaggcggaggtt

SEQ ID NO: 21824 - DNA, 15 bp, Homo sapiens
ccagaaggcggaggt

SEQ ID NO: 21825 - DNA, 15 bp, Homo sapiens
cccagaaggcggagg

SEQ ID NO: 21826 - DNA, 15 bp, Homo sapiens
acccagaaggcggag

SEQ ID NO: 21827 - DNA, 15 bp, Homo sapiens
aacccagaaggcgga

SEQ ID NO: 21828 - DNA, 15 bp, Homo sapiens
gaacccagaaggcgg

SEQ ID NO: 21829 - DNA, 15 bp, Homo sapiens
tgaacccagaaggcg

SEQ ID NO: 21830 - DNA, 15 bp, Homo sapiens
ttgaacccagaaggc

SEQ ID NO: 21831 - DNA, 15 bp, Homo sapiens
cttgaacccagaagg

SEQ ID NO: 21832 - DNA, 15 bp, Homo sapiens
gcttgaacccagaag

SEQ ID NO: 21833 - DNA, 15 bp, Homo sapiens
tgcttgaacccagaa

SEQ ID NO: 21834 - DNA, 15 bp, Homo sapiens
ttgcttgaacccaga

SEQ ID NO: 21835 - DNA, 15 bp, Homo sapiens
attgcttgaacccag

SEQ ID NO: 21836 - DNA, 15 bp, Homo sapiens
aattgcttgaaccca

SEQ ID NO: 21837 - DNA, 15 bp, Homo sapiens
gcaggagaattgctt

SEQ ID NO: 21838 - DNA, 15 bp, Homo sapiens
agcaggagaattgct

SEQ ID NO: 21839 - DNA, 15 bp, Homo sapiens
aagcaggagaattgc

SEQ ID NO: 21840 - DNA, 15 bp, Homo sapiens
gaagcaggagaattg

SEQ ID NO: 21841 - DNA, 15 bp, Homo sapiens
tgaagcaggagaatt

SEQ ID NO: 21842 - DNA, 15 bp, Homo sapiens
gctgaagcaggagaa

SEQ ID NO: 21843 - DNA, 15 bp, Homo sapiens
ggctgaagcaggaga

SEQ ID NO: 21844 - DNA, 15 bp, Homo sapiens
aggctgaagcaggag

SEQ ID NO: 21845 - DNA, 15 bp, Homo sapiens
gaggctgaagcagga

SEQ ID NO: 21846 - DNA, 15 bp, Homo sapiens
ggaggctgaagcagg

SEQ ID NO: 21847 - DNA, 15 bp, Homo sapiens
gggaggctgaagcag

SEQ ID NO: 21848 - DNA, 15 bp, Homo sapiens
tgggaggctgaagca

SEQ ID NO: 21849 - DNA, 15 bp, Homo sapiens
ttgggaggctgaagc

SEQ ID NO: 21850 - DNA, 15 bp, Homo sapiens
cttgggaggctgaag

SEQ ID NO: 21851 - DNA, 15 bp, Homo sapiens
acttgggaggctgaa

SEQ ID NO: 21852 - DNA, 15 bp, Homo sapiens
gggcgcatgcctgta

SEQ ID NO: 21853 - DNA, 15 bp, Homo sapiens
ggggcgcatgcctgt

SEQ ID NO: 21854 - DNA, 15 bp, Homo sapiens
gggggcgcatgcctg

SEQ ID NO: 21855 - DNA, 15 bp, Homo sapiens
tgggggcgcatgcct

SEQ ID NO: 21856 - DNA, 15 bp, Homo sapiens
gtgggggcgcatgcc

SEQ ID NO: 21857 - DNA, 15 bp, Homo sapiens
cgtgggggcgcatgc

SEQ ID NO: 21858 - DNA, 15 bp, Homo sapiens
gcgtgggggcgcatg

SEQ ID NO: 21859 - DNA, 15 bp, Homo sapiens
ggcgtgggggcgcat

SEQ ID NO: 21860 - DNA, 15 bp, Homo sapiens
gggcgtgggggcgca

SEQ ID NO: 21861 - DNA, 15 bp, Homo sapiens
cgggcgtgggggcgc

SEQ ID NO: 21862 - DNA, 15 bp, Homo sapiens
ccgggcgtgggggcg

SEQ ID NO: 21863 - DNA, 15 bp, Homo sapiens
gccgggcgtgggggc

SEQ ID NO: 21864 - DNA, 15 bp, Homo sapiens
agccgggcgtggggg

SEQ ID NO: 21865 - DNA, 15 bp, Homo sapiens
tagccgggcgtgggg

SEQ ID NO: 21866 - DNA, 15 bp, Homo sapiens
ttagccgggcgtggg

SEQ ID NO: 21867 - DNA, 15 bp, Homo sapiens
gagaaaccctatctc

SEQ ID NO: 21868 - DNA, 15 bp, Homo sapiens
ggagaaaccctatct

SEQ ID NO: 21869 - DNA, 15 bp, Homo sapiens
tggagaaaccctatc

SEQ ID NO: 21870 - DNA, 15 bp, Homo sapiens
atggagaaaccctat

SEQ ID NO: 21871 - DNA, 15 bp, Homo sapiens
catggagaaacccta

SEQ ID NO: 21872 - DNA, 15 bp, Homo sapiens
acatggagaaaccct

SEQ ID NO: 21873 - DNA, 15 bp, Homo sapiens
cgagttcgagaccag

SEQ ID NO: 21874 - DNA, 15 bp, Homo sapiens
gcgagttcgagacca

SEQ ID NO: 21875 - DNA, 15 bp, Homo sapiens
cgcgagttcgagacc

SEQ ID NO: 21876 - DNA, 15 bp, Homo sapiens
tcgcgagttcgagac

SEQ ID NO: 21877 - DNA, 15 bp, Homo sapiens
gtcgcgagttcgaga

SEQ ID NO: 21878 - DNA, 15 bp, Homo sapiens
ggtcgcgagttcgag

SEQ ID NO: 21879 - DNA, 15 bp, Homo sapiens
aggtcgcgagttcga

SEQ ID NO: 21880 - DNA, 15 bp, Homo sapiens
gaggtcgcgagttcg

SEQ ID NO: 21881 - DNA, 15 bp, Homo sapiens
tgaggtcgcgagttc

SEQ ID NO: 21882 - DNA, 15 bp, Homo sapiens
ttgaggtcgcgagtt

SEQ ID NO: 21883 - DNA, 15 bp, Homo sapiens
cttgaggtcgcgagt

SEQ ID NO: 21884 - DNA, 15 bp, Homo sapiens
acttgaggtcgcgag

SEQ ID NO: 21885 - DNA, 15 bp, Homo sapiens
cacttgaggtcgcga

SEQ ID NO: 21886 - DNA, 15 bp, Homo sapiens
tcacttgaggtcgcg

SEQ ID NO: 21887 - DNA, 15 bp, Homo sapiens
atcacttgaggtcgc

SEQ ID NO: 21888 - DNA, 15 bp, Homo sapiens
gatcacttgaggtcg

SEQ ID NO: 21889 - DNA, 15 bp, Homo sapiens
tggatcacttgaggt

SEQ ID NO: 21890 - DNA, 15 bp, Homo sapiens
gtggatcacttgagg

SEQ ID NO: 21891 - DNA, 15 bp, Homo sapiens
ggtggatcacttgag

SEQ ID NO: 21892 - DNA, 15 bp, Homo sapiens
gggtggatcacttga

SEQ ID NO: 21893 - DNA, 15 bp, Homo sapiens
cgggtggatcacttg

SEQ ID NO: 21894 - DNA, 15 bp, Homo sapiens
gcgggtggatcactt

SEQ ID NO: 21895 - DNA, 15 bp, Homo sapiens
agcgggtggatcact

SEQ ID NO: 21896 - DNA, 15 bp, Homo sapiens
aagcgggtggatcac

SEQ ID NO: 21897 - DNA, 15 bp, Homo sapiens
aaagcgggtggatca

SEQ ID NO: 21898 - DNA, 15 bp, Homo sapiens
aaaagcgggtggatc

SEQ ID NO: 21899 - DNA, 15 bp, Homo sapiens
caaaagcgggtggat

SEQ ID NO: 21900 - DNA, 15 bp, Homo sapiens
tcaaaagcgggtgga

SEQ ID NO: 21901 - DNA, 15 bp, Homo sapiens
ttcaaaagcgggtgg

SEQ ID NO: 21902 - DNA, 15 bp, Homo sapiens
tttcaaaagcgggtg

SEQ ID NO: 21903 - DNA, 15 bp, Homo sapiens
ctttcaaaagcgggt

SEQ ID NO: 21904 - DNA, 15 bp, Homo sapiens
gctttcaaaagcggg

SEQ ID NO: 21905 - DNA, 15 bp, Homo sapiens
ggctttcaaaagcgg

SEQ ID NO: 21906 - DNA, 15 bp, Homo sapiens
aggctttcaaaagcg

SEQ ID NO: 21907 - DNA, 15 bp, Homo sapiens
gaggctttcaaaagc

SEQ ID NO: 21908 - DNA, 15 bp, Homo sapiens
ggaggctttcaaaag

SEQ ID NO: 21909 - DNA, 15 bp, Homo sapiens
gggaggctttcaaaa

SEQ ID NO: 21910 - DNA, 15 bp, Homo sapiens
tgggaggctttcaaa

SEQ ID NO: 21911 - DNA, 15 bp, Homo sapiens
ttgggaggctttcaa

SEQ ID NO: 21912 - DNA, 15 bp, Homo sapiens
tttgggaggctttca

SEQ ID NO: 21913 - DNA, 15 bp, Homo sapiens
ctttgggaggctttc

SEQ ID NO: 21914 - DNA, 15 bp, Homo sapiens
actttgggaggcttt

SEQ ID NO: 21915 - DNA, 15 bp, Homo sapiens
cactttgggaggctt

SEQ ID NO: 21916 - DNA, 15 bp, Homo sapiens
tcacgcctataatcc

SEQ ID NO: 21917 - DNA, 15 bp, Homo sapiens
ctcacgcctataatc

SEQ ID NO: 21918 - DNA, 15 bp, Homo sapiens
gctcacgcctataat

SEQ ID NO: 21919 - DNA, 15 bp, Homo sapiens
ggctcacgcctataa

SEQ ID NO: 21920 - DNA, 15 bp, Homo sapiens
gggctcacgcctata

SEQ ID NO: 21921 - DNA, 15 bp, Homo sapiens
ggggctcacgcctat

SEQ ID NO: 21922 - DNA, 15 bp, Homo sapiens
gggggctcacgccta

SEQ ID NO: 21923 - DNA, 15 bp, Homo sapiens
cgggggctcacgcct

SEQ ID NO: 21924 - DNA, 15 bp, Homo sapiens
gcgggggctcacgcc

SEQ ID NO: 21925 - DNA, 15 bp, Homo sapiens
cgcgggggctcacgc

SEQ ID NO: 21926 - DNA, 15 bp, Homo sapiens
gcgcgggggctcacg

SEQ ID NO: 21927 - DNA, 15 bp, Homo sapiens
ggcgcgggggctcac

SEQ ID NO: 21928 - DNA, 15 bp, Homo sapiens
gggcgcgggggctca

SEQ ID NO: 21929 - DNA, 15 bp, Homo sapiens
cgggcgcgggggctc

SEQ ID NO: 21930 - DNA, 15 bp, Homo sapiens
ccgggcgcgggggct

SEQ ID NO: 21931 - DNA, 15 bp, Homo sapiens
gccgggcgcgggggc

SEQ ID NO: 21932 - DNA, 15 bp, Homo sapiens
ggccgggcgcggggg

SEQ ID NO: 21933 - DNA, 15 bp, Homo sapiens
tggccgggcgcgggg

SEQ ID NO: 21934 - DNA, 15 bp, Homo sapiens
atggccgggcgcggg

SEQ ID NO: 21935 - DNA, 15 bp, Homo sapiens
gatggccgggcgcgg

SEQ ID NO: 21936 - DNA, 15 bp, Homo sapiens
ggatggccgggcgcg

SEQ ID NO: 21937 - DNA, 15 bp, Homo sapiens
aggatggccgggcgc

SEQ ID NO: 21938 - DNA, 15 bp, Homo sapiens
taggatggccgggcg

SEQ ID NO: 21939 - DNA, 15 bp, Homo sapiens
ataggatggccgggc

SEQ ID NO: 21940 - DNA, 15 bp, Homo sapiens
tataggatggccggg

SEQ ID NO: 21941 - DNA, 15 bp, Homo sapiens
atataggatggccgg

SEQ ID NO: 21942 - DNA, 15 bp, Homo sapiens
aatataggatggccg

SEQ ID NO: 21943 - DNA, 15 bp, Homo sapiens
aaatataggatggcc

SEQ ID NO: 21944 - DNA, 15 bp, Homo sapiens
aaaatataggatggc

SEQ ID NO: 21945 - DNA, 15 bp, Homo sapiens
aaaaatataggatgg

SEQ ID NO: 21946 - DNA, 15 bp, Homo sapiens
aaaaaatataggatg

SEQ ID NO: 21947 - DNA, 15 bp, Homo sapiens
caaaaaatataggat

SEQ ID NO: 21948 - DNA, 15 bp, Homo sapiens
tcaaaaaatatagga

SEQ ID NO: 21949 - DNA, 15 bp, Homo sapiens
gtcaaaaaatatagg

SEQ ID NO: 21950 - DNA, 15 bp, Homo sapiens
ggtcaaaaaatatag

SEQ ID NO: 21951 - DNA, 15 bp, Homo sapiens
tggtcaaaaaatata

SEQ ID NO: 21952 - DNA, 15 bp, Homo sapiens
atggtcaaaaaatat

SEQ ID NO: 21953 - DNA, 15 bp, Homo sapiens
gatggtcaaaaaata

SEQ ID NO: 21954 - DNA, 15 bp, Homo sapiens
tgatggtcaaaaaat

SEQ ID NO: 21955 - DNA, 15 bp, Homo sapiens
atgatggtcaaaaaa

SEQ ID NO: 21956 - DNA, 15 bp, Homo sapiens
aatgatggtcaaaaa

SEQ ID NO: 21957 - DNA, 15 bp, Homo sapiens
aaatgatggtcaaaa

SEQ ID NO: 21958 - DNA, 15 bp, Homo sapiens
caaatgatggtcaaa

SEQ ID NO: 21959 - DNA, 15 bp, Homo sapiens
tcaaatgatggtcaa

SEQ ID NO: 21960 - DNA, 15 bp, Homo sapiens
atcaaatgatggtca

SEQ ID NO: 21961 - DNA, 15 bp, Homo sapiens
tatcaaatgatggtc

SEQ ID NO: 21962 - DNA, 15 bp, Homo sapiens
ttatcaaatgatggt

SEQ ID NO: 21963 - DNA, 15 bp, Homo sapiens
tttatcaaatgatgg

SEQ ID NO: 21964 - DNA, 15 bp, Homo sapiens
ttttatcaaatgatg

SEQ ID NO: 21965 - DNA, 15 bp, Homo sapiens
attttatcaaatgat

SEQ ID NO: 21966 - DNA, 15 bp, Homo sapiens
tattttatcaaatga

SEQ ID NO: 21967 - DNA, 15 bp, Homo sapiens
ttattttatcaaatg

SEQ ID NO: 21968 - DNA, 15 bp, Homo sapiens
tttattttatcaaat

SEQ ID NO: 21969 - DNA, 15 bp, Homo sapiens
atttattttatcaaa

SEQ ID NO: 21970 - DNA, 15 bp, Homo sapiens
tatttattttatcaa

SEQ ID NO: 21971 - DNA, 15 bp, Homo sapiens
ttatttattttatca

SEQ ID NO: 21972 - DNA, 15 bp, Homo sapiens
attatttattttatc

SEQ ID NO: 21973 - DNA, 15 bp, Homo sapiens
aattatttattttat

SEQ ID NO: 21974 - DNA, 15 bp, Homo sapiens
aaattatttatttta

SEQ ID NO: 21975 - DNA, 15 bp, Homo sapiens
taaattatttatttt

SEQ ID NO: 21976 - DNA, 15 bp, Homo sapiens
ttaaattatttattt

SEQ ID NO: 21977 - DNA, 15 bp, Homo sapiens
tttaaattatttatt

SEQ ID NO: 21978 - DNA, 15 bp, Homo sapiens
gtttaaattatttat

SEQ ID NO: 21979 - DNA, 15 bp, Homo sapiens
ggtttaaattattta

SEQ ID NO: 21980 - DNA, 15 bp, Homo sapiens
aggtttaaattattt

SEQ ID NO: 21981 - DNA, 15 bp, Homo sapiens
caggtttaaattatt

SEQ ID NO: 21982 - DNA, 15 bp, Homo sapiens
gcaggtttaaattat

SEQ ID NO: 21983 - DNA, 15 bp, Homo sapiens
agcaggtttaaatta

SEQ ID NO: 21984 - DNA, 15 bp, Homo sapiens
cagcaggtttaaatt

SEQ ID NO: 21985 - DNA, 15 bp, Homo sapiens
acagcaggtttaaat

SEQ ID NO: 21986 - DNA, 15 bp, Homo sapiens
aacagcaggtttaaa

SEQ ID NO: 21987 - DNA, 15 bp, Homo sapiens
taacagcaggtttaa

SEQ ID NO: 21988 - DNA, 15 bp, Homo sapiens
ctaacagcaggttta

SEQ ID NO: 21989 - DNA, 15 bp, Homo sapiens
tctaacagcaggttt

SEQ ID NO: 21990 - DNA, 15 bp, Homo sapiens
ttctaacagcaggtt

SEQ ID NO: 21991 - DNA, 15 bp, Homo sapiens
tttctaacagcaggt

SEQ ID NO: 21992 - DNA, 15 bp, Homo sapiens
ttttctaacagcagg

SEQ ID NO: 21993 - DNA, 15 bp, Homo sapiens
cttttctaacagcag

SEQ ID NO: 21994 - DNA, 15 bp, Homo sapiens
acttttctaacagca

SEQ ID NO: 21995 - DNA, 15 bp, Homo sapiens
tacttttctaacagc

SEQ ID NO: 21996 - DNA, 15 bp, Homo sapiens
ttacttttctaacag

SEQ ID NO: 21997 - DNA, 15 bp, Homo sapiens
gttacttttctaaca

SEQ ID NO: 21998 - DNA, 15 bp, Homo sapiens
tgttacttttctaac

SEQ ID NO: 21999 - DNA, 15 bp, Homo sapiens
ttgttacttttctaa

SEQ ID NO: 22000 - DNA, 15 bp, Homo sapiens
gttgttacttttcta

SEQ ID NO: 22001 - DNA, 15 bp, Homo sapiens
agttgttacttttct

SEQ ID NO: 22002 - DNA, 15 bp, Homo sapiens
cagttgttacttttc

SEQ ID NO: 22003 - DNA, 15 bp, Homo sapiens
tcagttgttactttt

SEQ ID NO: 22004 - DNA, 15 bp, Homo sapiens
ttcagttgttacttt

SEQ ID NO: 22005 - DNA, 15 bp, Homo sapiens
attcagttgttactt

SEQ ID NO: 22006 - DNA, 15 bp, Homo sapiens
tattcagttgttact

SEQ ID NO: 22007 - DNA, 15 bp, Homo sapiens
ttattcagttgttac

SEQ ID NO: 22008 - DNA, 15 bp, Homo sapiens
tttattcagttgtta

SEQ ID NO: 22009 - DNA, 15 bp, Homo sapiens
atttattcagttgtt

SEQ ID NO: 22010 - DNA, 15 bp, Homo sapiens
tatttattcagttgt

SEQ ID NO: 22011 - DNA, 15 bp, Homo sapiens
ttatttattcagttg

SEQ ID NO: 22012 - DNA, 15 bp, Homo sapiens
attatttattcagtt

SEQ ID NO: 22013 - DNA, 15 bp, Homo sapiens
cattatttattcagt

SEQ ID NO: 22014 - DNA, 15 bp, Homo sapiens
gcattatttattcag

SEQ ID NO: 22015 - DNA, 15 bp, Homo sapiens
tgcattatttattca

SEQ ID NO: 22016 - DNA, 15 bp, Homo sapiens
ttgcattatttattc

SEQ ID NO: 22017 - DNA, 15 bp, Homo sapiens
attgcattatttatt

SEQ ID NO: 22018 - DNA, 15 bp, Homo sapiens
tattgcattatttat

SEQ ID NO: 22019 - DNA, 15 bp, Homo sapiens
ttattgcattattta

SEQ ID NO: 22020 - DNA, 15 bp, Homo sapiens
attattgcattattt

SEQ ID NO: 22021 - DNA, 15 bp, Homo sapiens
aattattgcattatt

SEQ ID NO: 22022 - DNA, 15 bp, Homo sapiens
taattattgcattat

SEQ ID NO: 22023 - DNA, 15 bp, Homo sapiens
ataattattgcatta

SEQ ID NO: 22024 - DNA, 15 bp, Homo sapiens
tataattattgcatt

SEQ ID NO: 22025 - DNA, 15 bp, Homo sapiens
gtataattattgcat

SEQ ID NO: 22026 - DNA, 15 bp, Homo sapiens
tgtataattattgca

SEQ ID NO: 22027 - DNA, 15 bp, Homo sapiens
ctgtataattattgc

SEQ ID NO: 22028 - DNA, 15 bp, Homo sapiens
gctgtataattattg

SEQ ID NO: 22029 - DNA, 15 bp, Homo sapiens
agctgtataattatt

SEQ ID NO: 22030 - DNA, 15 bp, Homo sapiens
cagctgtataattat

SEQ ID NO: 22031 - DNA, 15 bp, Homo sapiens
ccagctgtataatta

SEQ ID NO: 22032 - DNA, 15 bp, Homo sapiens
tccagctgtataatt

SEQ ID NO: 22033 - DNA, 15 bp, Homo sapiens
atccagctgtataat

SEQ ID NO: 22034 - DNA, 15 bp, Homo sapiens
aatccagctgtataa

SEQ ID NO: 22035 - DNA, 15 bp, Homo sapiens
taatccagctgtata

SEQ ID NO: 22036 - DNA, 15 bp, Homo sapiens
ataatccagctgtat

SEQ ID NO: 22037 - DNA, 15 bp, Homo sapiens
aataatccagctgta

SEQ ID NO: 22038 - DNA, 15 bp, Homo sapiens
aaataatccagctgt

SEQ ID NO: 22039 - DNA, 15 bp, Homo sapiens
aaaataatccagctg

SEQ ID NO: 22040 - DNA, 15 bp, Homo sapiens
caaaataatccagct

SEQ ID NO: 22041 - DNA, 15 bp, Homo sapiens
acaaaataatccagc

SEQ ID NO: 22042 - DNA, 15 bp, Homo sapiens
tacaaaataatccag

SEQ ID NO: 22043 - DNA, 15 bp, Homo sapiens
atacaaaataatcca

SEQ ID NO: 22044 - DNA, 15 bp, Homo sapiens
tatacaaaataatcc

SEQ ID NO: 22045 - DNA, 15 bp, Homo sapiens
ttatacaaaataatc

SEQ ID NO: 22046 - DNA, 15 bp, Homo sapiens
attatacaaaataat

SEQ ID NO: 22047 - DNA, 15 bp, Homo sapiens
aattatacaaaataa

SEQ ID NO: 22048 - DNA, 15 bp, Homo sapiens
gaattatacaaaata

SEQ ID NO: 22049 - DNA, 15 bp, Homo sapiens
tgaattatacaaaat

SEQ ID NO: 22050 - DNA, 15 bp, Homo sapiens
gtgaattatacaaaa

SEQ ID NO: 22051 - DNA, 15 bp, Homo sapiens
agtgaattatacaaa

SEQ ID NO: 22052 - DNA, 15 bp, Homo sapiens
aagtgaattatacaa

SEQ ID NO: 22053 - DNA, 15 bp, Homo sapiens
aaagtgaattataca

SEQ ID NO: 22054 - DNA, 15 bp, Homo sapiens
gaaagtgaattatac

SEQ ID NO: 22055 - DNA, 15 bp, Homo sapiens
ggaaagtgaattata

SEQ ID NO: 22056 - DNA, 15 bp, Homo sapiens
aggaaagtgaattat

SEQ ID NO: 22057 - DNA, 15 bp, Homo sapiens
aaggaaagtgaatta

SEQ ID NO: 22058 - DNA, 15 bp, Homo sapiens
taaggaaagtgaatt

SEQ ID NO: 22059 - DNA, 15 bp, Homo sapiens
ctaaggaaagtgaat

SEQ ID NO: 22060 - DNA, 15 bp, Homo sapiens
cctaaggaaagtgaa

SEQ ID NO: 22061 - DNA, 15 bp, Homo sapiens
acctaaggaaagtga

SEQ ID NO: 22062 - DNA, 15 bp, Homo sapiens
aacctaaggaaagtg

SEQ ID NO: 22063 - DNA, 15 bp, Homo sapiens
aaacctaaggaaagt

SEQ ID NO: 22064 - DNA, 15 bp, Homo sapiens
aaaacctaaggaaag

SEQ ID NO: 22065 - DNA, 15 bp, Homo sapiens
caaaacctaaggaaa

SEQ ID NO: 22066 - DNA, 15 bp, Homo sapiens
gcaaaacctaaggaa

SEQ ID NO: 22067 - DNA, 15 bp, Homo sapiens
agcaaaacctaagga

SEQ ID NO: 22068 - DNA, 15 bp, Homo sapiens
aagcaaaacctaagg

SEQ ID NO: 22069 - DNA, 15 bp, Homo sapiens
taagcaaaacctaag

SEQ ID NO: 22070 - DNA, 15 bp, Homo sapiens
ttaagcaaaacctaa

SEQ ID NO: 22071 - DNA, 15 bp, Homo sapiens
tttaagcaaaaccta

SEQ ID NO: 22072 - DNA, 15 bp, Homo sapiens
gtttaagcaaaacct

SEQ ID NO: 22073 - DNA, 15 bp, Homo sapiens
tgtttaagcaaaacc

SEQ ID NO: 22074 - DNA, 15 bp, Homo sapiens
ttgtttaagcaaaac

SEQ ID NO: 22075 - DNA, 15 bp, Homo sapiens
gttgtttaagcaaaa

SEQ ID NO: 22076 - DNA, 15 bp, Homo sapiens
agttgtttaagcaaa

SEQ ID NO: 22077 - DNA, 15 bp, Homo sapiens
aagttgtttaagcaa

SEQ ID NO: 22078 - DNA, 15 bp, Homo sapiens
caagttgtttaagca

SEQ ID NO: 22079 - DNA, 15 bp, Homo sapiens
ccaagttgtttaagc

SEQ ID NO: 22080 - DNA, 15 bp, Homo sapiens
accaagttgtttaag

SEQ ID NO: 22081 - DNA, 15 bp, Homo sapiens
taccaagttgtttaa

SEQ ID NO: 22082 - DNA, 15 bp, Homo sapiens
gtaccaagttgttta

SEQ ID NO: 22083 - DNA, 15 bp, Homo sapiens
tgtaccaagttgttt

SEQ ID NO: 22084 - DNA, 15 bp, Homo sapiens
ttgtaccaagttgtt

SEQ ID NO: 22085 - DNA, 15 bp, Homo sapiens
cttgtaccaagttgt

SEQ ID NO: 22086 - DNA, 15 bp, Homo sapiens
acttgtaccaagttg

SEQ ID NO: 22087 - DNA, 15 bp, Homo sapiens
gacttgtaccaagtt

SEQ ID NO: 22088 - DNA, 15 bp, Homo sapiens
agacttgtaccaagt

SEQ ID NO: 22089 - DNA, 15 bp, Homo sapiens
tagacttgtaccaag

SEQ ID NO: 22090 - DNA, 15 bp, Homo sapiens
atagacttgtaccaa

SEQ ID NO: 22091 - DNA, 15 bp, Homo sapiens
aatagacttgtacca

SEQ ID NO: 22092 - DNA, 15 bp, Homo sapiens
gaatagacttgtacc

SEQ ID NO: 22093 - DNA, 15 bp, Homo sapiens
ggaatagacttgtac

SEQ ID NO: 22094 - DNA, 15 bp, Homo sapiens
tggaatagacttgta

SEQ ID NO: 22095 - DNA, 15 bp, Homo sapiens
ttggaatagacttgt

SEQ ID NO: 22096 - DNA, 15 bp, Homo sapiens
tttggaatagacttg

SEQ ID NO: 22097 - DNA, 15 bp, Homo sapiens
ttttggaatagactt

SEQ ID NO: 22098 - DNA, 15 bp, Homo sapiens
cttttggaatagact

SEQ ID NO: 22099 - DNA, 15 bp, Homo sapiens
ccttttggaatagac

SEQ ID NO: 22100 - DNA, 15 bp, Homo sapiens
accttttggaataga

SEQ ID NO: 22101 - DNA, 15 bp, Homo sapiens
taccttttggaatag

SEQ ID NO: 22102 - DNA, 15 bp, Homo sapiens
gtaccttttggaata

SEQ ID NO: 22103 - DNA, 15 bp, Homo sapiens
tgtaccttttggaat

SEQ ID NO: 22104 - DNA, 15 bp, Homo sapiens
gtgtaccttttggaa

SEQ ID NO: 22105 - DNA, 15 bp, Homo sapiens
tgtgtaccttttgga

SEQ ID NO: 22106 - DNA, 15 bp, Homo sapiens
atgtgtaccttttgg

SEQ ID NO: 22107 - DNA, 15 bp, Homo sapiens
catgtgtaccttttg

SEQ ID NO: 22108 - DNA, 15 bp, Homo sapiens
tcatgtgtacctttt

SEQ ID NO: 22109 - DNA, 15 bp, Homo sapiens
gtcatgtgtaccttt

SEQ ID NO: 22110 - DNA, 15 bp, Homo sapiens
agtcatgtgtacctt

SEQ ID NO: 22111 - DNA, 15 bp, Homo sapiens
gagtcatgtgtacct

SEQ ID NO: 22112 - DNA, 15 bp, Homo sapiens
tgagtcatgtgtacc

SEQ ID NO: 22113 - DNA, 15 bp, Homo sapiens
atgagtcatgtgtac

SEQ ID NO: 22114 - DNA, 15 bp, Homo sapiens
tatgagtcatgtgta

SEQ ID NO: 22115 - DNA, 15 bp, Homo sapiens
gtatgagtcatgtgt

SEQ ID NO: 22116 - DNA, 15 bp, Homo sapiens
tgtatgagtcatgtg

SEQ ID NO: 22117 - DNA, 15 bp, Homo sapiens
ctgtatgagtcatgt

SEQ ID NO: 22118 - DNA, 15 bp, Homo sapiens
tctgtatgagtcatg

SEQ ID NO: 22119 - DNA, 15 bp, Homo sapiens
ctctgtatgagtcat

SEQ ID NO: 22120 - DNA, 15 bp, Homo sapiens
actctgtatgagtca

SEQ ID NO: 22121 - DNA, 15 bp, Homo sapiens
tactctgtatgagtc

SEQ ID NO: 22122 - DNA, 15 bp, Homo sapiens
ctactctgtatgagt

SEQ ID NO: 22123 - DNA, 15 bp, Homo sapiens
tctactctgtatgag

SEQ ID NO: 22124 - DNA, 15 bp, Homo sapiens
gtctactctgtatga

SEQ ID NO: 22125 - DNA, 15 bp, Homo sapiens
tgtctactctgtatg

SEQ ID NO: 22126 - DNA, 15 bp, Homo sapiens
atgtctactctgtat

SEQ ID NO: 22127 - DNA, 15 bp, Homo sapiens
aatgtctactctgta

SEQ ID NO: 22128 - DNA, 15 bp, Homo sapiens
aaatgtctactctgt

SEQ ID NO: 22129 - DNA, 15 bp, Homo sapiens
caaatgtctactctg

SEQ ID NO: 22130 - DNA, 15 bp, Homo sapiens
acaaatgtctactct

SEQ ID NO: 22131 - DNA, 15 bp, Homo sapiens
gacaaatgtctactc

SEQ ID NO: 22132 - DNA, 15 bp, Homo sapiens
tgacaaatgtctact

SEQ ID NO: 22133 - DNA, 15 bp, Homo sapiens
gtgacaaatgtctac

SEQ ID NO: 22134 - DNA, 15 bp, Homo sapiens
tgtgacaaatgtcta

SEQ ID NO: 22135 - DNA, 15 bp, Homo sapiens
atgtgacaaatgtct

SEQ ID NO: 22136 - DNA, 15 bp, Homo sapiens
tatgtgacaaatgtc

SEQ ID NO: 22137 - DNA, 15 bp, Homo sapiens
atatgtgacaaatgt

SEQ ID NO: 22138 - DNA, 15 bp, Homo sapiens
aatatgtgacaaatg

SEQ ID NO: 22139 - DNA, 15 bp, Homo sapiens
aaatatgtgacaaat

SEQ ID NO: 22140 - DNA, 15 bp, Homo sapiens
aaaatatgtgacaaa

SEQ ID NO: 22141 - DNA, 15 bp, Homo sapiens
taaaatatgtgacaa

SEQ ID NO: 22142 - DNA, 15 bp, Homo sapiens
ataaaatatgtgaca

SEQ ID NO: 22143 - DNA, 15 bp, Homo sapiens
aataaaatatgtgac

SEQ ID NO: 22144 - DNA, 15 bp, Homo sapiens
gaataaaatatgtga

SEQ ID NO: 22145 - DNA, 15 bp, Homo sapiens
cgaataaaatatgtg

SEQ ID NO: 22146 - DNA, 15 bp, Homo sapiens
ccgaataaaatatgt

SEQ ID NO: 22147 - DNA, 15 bp, Homo sapiens
gccgaataaaatatg

SEQ ID NO: 22148 - DNA, 15 bp, Homo sapiens
agccgaataaaatat

SEQ ID NO: 22149 - DNA, 15 bp, Homo sapiens
gagccgaataaaata

SEQ ID NO: 22150 - DNA, 15 bp, Homo sapiens
tgagccgaataaaat

SEQ ID NO: 22151 - DNA, 15 bp, Homo sapiens
atgagccgaataaaa

SEQ ID NO: 22152 - DNA, 15 bp, Homo sapiens
aatgagccgaataaa

SEQ ID NO: 22153 - DNA, 15 bp, Homo sapiens
taatgagccgaataa

SEQ ID NO: 22154 - DNA, 15 bp, Homo sapiens
ttaatgagccgaata

SEQ ID NO: 22155 - DNA, 15 bp, Homo sapiens
attaatgagccgaat

SEQ ID NO: 22156 - DNA, 15 bp, Homo sapiens
aattaatgagccgaa

SEQ ID NO: 22157 - DNA, 15 bp, Homo sapiens
taattaatgagccga

SEQ ID NO: 22158 - DNA, 15 bp, Homo sapiens
ctaattaatgagccg

SEQ ID NO: 22159 - DNA, 15 bp, Homo sapiens
gctaattaatgagcc

SEQ ID NO: 22160 - DNA, 15 bp, Homo sapiens
tgctaattaatgagc

SEQ ID NO: 22161 - DNA, 15 bp, Homo sapiens
ttgctaattaatgag

SEQ ID NO: 22162 - DNA, 15 bp, Homo sapiens
cttgctaattaatga

SEQ ID NO: 22163 - DNA, 15 bp, Homo sapiens
ccttgctaattaatg

SEQ ID NO: 22164 - DNA, 15 bp, Homo sapiens
cccttgctaattaat

SEQ ID NO: 22165 - DNA, 15 bp, Homo sapiens
tcccttgctaattaa

SEQ ID NO: 22166 - DNA, 15 bp, Homo sapiens
ttcccttgctaatta

SEQ ID NO: 22167 - DNA, 15 bp, Homo sapiens
attcccttgctaatt

SEQ ID NO: 22168 - DNA, 15 bp, Homo sapiens
gattcccttgctaat

SEQ ID NO: 22169 - DNA, 15 bp, Homo sapiens
agattcccttgctaa

SEQ ID NO: 22170 - DNA, 15 bp, Homo sapiens
cagattcccttgcta

SEQ ID NO: 22171 - DNA, 15 bp, Homo sapiens
acagattcccttgct

SEQ ID NO: 22172 - DNA, 15 bp, Homo sapiens
tacagattcccttgc

SEQ ID NO: 22173 - DNA, 15 bp, Homo sapiens
atacagattcccttg

SEQ ID NO: 22174 - DNA, 15 bp, Homo sapiens
aatacagattccctt

SEQ ID NO: 22175 - DNA, 15 bp, Homo sapiens
aaatacagattccct

SEQ ID NO: 22176 - DNA, 15 bp, Homo sapiens
caaatacagattccc

SEQ ID NO: 22177 - DNA, 15 bp, Homo sapiens
tcaaatacagattcc

SEQ ID NO: 22178 - DNA, 15 bp, Homo sapiens
ctcaaatacagattc

SEQ ID NO: 22179 - DNA, 15 bp, Homo sapiens
cctcaaatacagatt

SEQ ID NO: 22180 - DNA, 15 bp, Homo sapiens
tcctcaaatacagat

SEQ ID NO: 22181 - DNA, 15 bp, Homo sapiens
ttcctcaaatacaga

SEQ ID NO: 22182 - DNA, 15 bp, Homo sapiens
cttcctcaaatacag

SEQ ID NO: 22183 - DNA, 15 bp, Homo sapiens
acttcctcaaataca

SEQ ID NO: 22184 - DNA, 15 bp, Homo sapiens
cacttcctcaaatac

SEQ ID NO: 22185 - DNA, 15 bp, Homo sapiens
acacttcctcaaata

SEQ ID NO: 22186 - DNA, 15 bp, Homo sapiens
aacacttcctcaaat

SEQ ID NO: 22187 - DNA, 15 bp, Homo sapiens
gaacacttcctcaaa

SEQ ID NO: 22188 - DNA, 15 bp, Homo sapiens
tgaacacttcctcaa

SEQ ID NO: 22189 - DNA, 15 bp, Homo sapiens
ttgaacacttcctca

SEQ ID NO: 22190 - DNA, 15 bp, Homo sapiens
attgaacacttcctc

SEQ ID NO: 22191 - DNA, 15 bp, Homo sapiens
tattgaacacttcct

SEQ ID NO: 22192 - DNA, 15 bp, Homo sapiens
atattgaacacttcc

SEQ ID NO: 22193 - DNA, 15 bp, Homo sapiens
aatattgaacacttc

SEQ ID NO: 22194 - DNA, 15 bp, Homo sapiens
taatattgaacactt

SEQ ID NO: 22195 - DNA, 15 bp, Homo sapiens
ctaatattgaacact

SEQ ID NO: 22196 - DNA, 15 bp, Homo sapiens
tctaatattgaacac

SEQ ID NO: 22197 - DNA, 15 bp, Homo sapiens
ttctaatattgaaca

SEQ ID NO: 22198 - DNA, 15 bp, Homo sapiens
attctaatattgaac

SEQ ID NO: 22199 - DNA, 15 bp, Homo sapiens
tattctaatattgaa

SEQ ID NO: 22200 - DNA, 15 bp, Homo sapiens
atattctaatattga

SEQ ID NO: 22201 - DNA, 15 bp, Homo sapiens
aatattctaatattg

SEQ ID NO: 22202 - DNA, 15 bp, Homo sapiens
taatattctaatatt

SEQ ID NO: 22203 - DNA, 15 bp, Homo sapiens
ctaatattctaatat

SEQ ID NO: 22204 - DNA, 15 bp, Homo sapiens
tctaatattctaata

SEQ ID NO: 22205 - DNA, 15 bp, Homo sapiens
ttctaatattctaat

SEQ ID NO: 22206 - DNA, 15 bp, Homo sapiens
attctaatattctaa

SEQ ID NO: 22207 - DNA, 15 bp, Homo sapiens
tattctaatattcta

SEQ ID NO: 22208 - DNA, 15 bp, Homo sapiens
ctattctaatattct

SEQ ID NO: 22209 - DNA, 15 bp, Homo sapiens
cctattctaatattc

SEQ ID NO: 22210 - DNA, 15 bp, Homo sapiens
ccctattctaatatt

SEQ ID NO: 22211 - DNA, 15 bp, Homo sapiens
tccctattctaatat

SEQ ID NO: 22212 - DNA, 15 bp, Homo sapiens
atccctattctaata

SEQ ID NO: 22213 - DNA, 15 bp, Homo sapiens
aatccctattctaat

SEQ ID NO: 22214 - DNA, 15 bp, Homo sapiens
caatccctattctaa

SEQ ID NO: 22215 - DNA, 15 bp, Homo sapiens
gcaatccctattcta

SEQ ID NO: 22216 - DNA, 15 bp, Homo sapiens
agcaatccctattct

SEQ ID NO: 22217 - DNA, 15 bp, Homo sapiens
tagcaatccctattc

SEQ ID NO: 22218 - DNA, 15 bp, Homo sapiens
ctagcaatccctatt

SEQ ID NO: 22219 - DNA, 15 bp, Homo sapiens
cctagcaatccctat

SEQ ID NO: 22220 - DNA, 15 bp, Homo sapiens
acctagcaatcccta

SEQ ID NO: 22221 - DNA, 15 bp, Homo sapiens
aacctagcaatccct

SEQ ID NO: 22222 - DNA, 15 bp, Homo sapiens
taacctagcaatccc

SEQ ID NO: 22223 - DNA, 15 bp, Homo sapiens
ctaacctagcaatcc

SEQ ID NO: 22224 - DNA, 15 bp, Homo sapiens
tctaacctagcaatc

SEQ ID NO: 22225 - DNA, 15 bp, Homo sapiens
atctaacctagcaat

SEQ ID NO: 22226 - DNA, 15 bp, Homo sapiens
aatctaacctagcaa

SEQ ID NO: 22227 - DNA, 15 bp, Homo sapiens
taatctaacctagca

SEQ ID NO: 22228 - DNA, 15 bp, Homo sapiens
gtaatctaacctagc

SEQ ID NO: 22229 - DNA, 15 bp, Homo sapiens
tgtaatctaacctag

SEQ ID NO: 22230 - DNA, 15 bp, Homo sapiens
ttgtaatctaaccta

SEQ ID NO: 22231 - DNA, 15 bp, Homo sapiens
tttgtaatctaacct

SEQ ID NO: 22232 - DNA, 15 bp, Homo sapiens
ttttgtaatctaacc

SEQ ID NO: 22233 - DNA, 15 bp, Homo sapiens
gttttgtaatctaac

SEQ ID NO: 22234 - DNA, 15 bp, Homo sapiens
agttttgtaatctaa

SEQ ID NO: 22235 - DNA, 15 bp, Homo sapiens
tagttttgtaatcta

SEQ ID NO: 22236 - DNA, 15 bp, Homo sapiens
ttagttttgtaatct

SEQ ID NO: 22237 - DNA, 15 bp, Homo sapiens
attagttttgtaatc

SEQ ID NO: 22238 - DNA, 15 bp, Homo sapiens
cattagttttgtaat

SEQ ID NO: 22239 - DNA, 15 bp, Homo sapiens
acattagttttgtaa

SEQ ID NO: 22240 - DNA, 15 bp, Homo sapiens
actcggctcactgca

SEQ ID NO: 22241 - DNA, 15 bp, Homo sapiens
gactcggctcactgc

SEQ ID NO: 22242 - DNA, 15 bp, Homo sapiens
cgactcggctcactg

SEQ ID NO: 22243 - DNA, 15 bp, Homo sapiens
acgactcggctcact

SEQ ID NO: 22244 - DNA, 15 bp, Homo sapiens
cacgactcggctcac

SEQ ID NO: 22245 - DNA, 15 bp, Homo sapiens
gcacgactcggctca

SEQ ID NO: 22246 - DNA, 15 bp, Homo sapiens
ggcacgactcggctc

SEQ ID NO: 22247 - DNA, 15 bp, Homo sapiens
tggcacgactcggct

SEQ ID NO: 22248 - DNA, 15 bp, Homo sapiens
atggcacgactcggc

SEQ ID NO: 22249 - DNA, 15 bp, Homo sapiens
aatggcacgactcgg

SEQ ID NO: 22250 - DNA, 15 bp, Homo sapiens
caatggcacgactcg

SEQ ID NO: 22251 - DNA, 15 bp, Homo sapiens
gcaatggcacgactc

SEQ ID NO: 22252 - DNA, 15 bp, Homo sapiens
tgcaatggcacgact

SEQ ID NO: 22253 - DNA, 15 bp, Homo sapiens
ctgcaatggcacgac

SEQ ID NO: 22254 - DNA, 15 bp, Homo sapiens
actgcaatggcacga

SEQ ID NO: 22255 - DNA, 15 bp, Homo sapiens
gactgcaatggcacg

SEQ ID NO: 22256 - DNA, 15 bp, Homo sapiens
ggactgcaatggcac

SEQ ID NO: 22257 - DNA, 15 bp, Homo sapiens
tggactgcaatggca

SEQ ID NO: 22258 - DNA, 15 bp, Homo sapiens
gtggactgcaatggc

SEQ ID NO: 22259 - DNA, 15 bp, Homo sapiens
ggtggactgcaatgg

SEQ ID NO: 22260 - DNA, 15 bp, Homo sapiens
gggtggactgcaatg

SEQ ID NO: 22261 - DNA, 15 bp, Homo sapiens
tgggtggactgcaat

SEQ ID NO: 22262 - DNA, 15 bp, Homo sapiens
ctgggtggactgcaa

SEQ ID NO: 22263 - DNA, 15 bp, Homo sapiens
gctgggtggactgca

SEQ ID NO: 22264 - DNA, 15 bp, Homo sapiens
ggctgggtggactgc

SEQ ID NO: 22265 - DNA, 15 bp, Homo sapiens
aggctgggtggactg

SEQ ID NO: 22266 - DNA, 15 bp, Homo sapiens
taggctgggtggact

SEQ ID NO: 22267 - DNA, 15 bp, Homo sapiens
ctaggctgggtggac

SEQ ID NO: 22268 - DNA, 15 bp, Homo sapiens
cctaggctgggtgga

SEQ ID NO: 22269 - DNA, 15 bp, Homo sapiens
gcctaggctgggtgg

SEQ ID NO: 22270 - DNA, 15 bp, Homo sapiens
cgcctaggctgggtg

SEQ ID NO: 22271 - DNA, 15 bp, Homo sapiens
tcgcctaggctgggt

SEQ ID NO: 22272 - DNA, 15 bp, Homo sapiens
gtcgcctaggctggg

SEQ ID NO: 22273 - DNA, 15 bp, Homo sapiens
tgtcgcctaggctgg

SEQ ID NO: 22274 - DNA, 15 bp, Homo sapiens
ctgtcgcctaggctg

SEQ ID NO: 22275 - DNA, 15 bp, Homo sapiens
tctgtcgcctaggct

SEQ ID NO: 22276 - DNA, 15 bp, Homo sapiens
ctctgtcgcctaggc

SEQ ID NO: 22277 - DNA, 15 bp, Homo sapiens
actctgtcgcctagg

SEQ ID NO: 22278 - DNA, 15 bp, Homo sapiens
cactctgtcgcctag

SEQ ID NO: 22279 - DNA, 15 bp, Homo sapiens
tcactctgtcgccta

SEQ ID NO: 22280 - DNA, 15 bp, Homo sapiens
ttcactctgtcgcct

SEQ ID NO: 22281 - DNA, 15 bp, Homo sapiens
tttcactctgtcgcc

SEQ ID NO: 22282 - DNA, 15 bp, Homo sapiens
gtttcactctgtcgc

SEQ ID NO: 22283 - DNA, 15 bp, Homo sapiens
agtttcactctgtcg

SEQ ID NO: 22284 - DNA, 15 bp, Homo sapiens
gagtttcactctgtc

SEQ ID NO: 22285 - DNA, 15 bp, Homo sapiens
ggagtttcactctgt

SEQ ID NO: 22286 - DNA, 15 bp, Homo sapiens
tggagtttcactctg

SEQ ID NO: 22287 - DNA, 15 bp, Homo sapiens
gtggagtttcactct

SEQ ID NO: 22288 - DNA, 15 bp, Homo sapiens
ggtggagtttcactc

SEQ ID NO: 22289 - DNA, 15 bp, Homo sapiens
aggtggagtttcact

SEQ ID NO: 22290 - DNA, 15 bp, Homo sapiens
gaggtggagtttcac

SEQ ID NO: 22291 - DNA, 15 bp, Homo sapiens
tgaggtggagtttca

SEQ ID NO: 22292 - DNA, 15 bp, Homo sapiens
ttgaggtggagtttc

SEQ ID NO: 22293 - DNA, 15 bp, Homo sapiens
tttgaggtggagttt

SEQ ID NO: 22294 - DNA, 15 bp, Homo sapiens
ttttgaggtggagtt

SEQ ID NO: 22295 - DNA, 15 bp, Homo sapiens
tttttgaggtggagt

SEQ ID NO: 22296 - DNA, 15 bp, Homo sapiens
ttttttgaggtggag

SEQ ID NO: 22297 - DNA, 15 bp, Homo sapiens
tttttttgaggtgga

SEQ ID NO: 22298 - DNA, 15 bp, Homo sapiens
ttttttttgaggtgg

SEQ ID NO: 22299 - DNA, 15 bp, Homo sapiens
tttttttttgaggtg

SEQ ID NO: 22300 - DNA, 15 bp, Homo sapiens
ttttttttttgaggt

SEQ ID NO: 22301 - DNA, 15 bp, Homo sapiens
tttttttttttgagg

SEQ ID NO: 22302 - DNA, 15 bp, Homo sapiens
aactttttttttttt

SEQ ID NO: 22303 - DNA, 15 bp, Homo sapiens
taacttttttttttt

SEQ ID NO: 22304 - DNA, 15 bp, Homo sapiens
ataactttttttttt

SEQ ID NO: 22305 - DNA, 15 bp, Homo sapiens
aataacttttttttt

SEQ ID NO: 22306 - DNA, 15 bp, Homo sapiens
aaataactttttttt

SEQ ID NO: 22307 - DNA, 15 bp, Homo sapiens
aaaataacttttttt

SEQ ID NO: 22308 - DNA, 15 bp, Homo sapiens
taaaataactttttt

SEQ ID NO: 22309 - DNA, 15 bp, Homo sapiens
ttaaaataacttttt

SEQ ID NO: 22310 - DNA, 15 bp, Homo sapiens
tttaaaataactttt

SEQ ID NO: 22311 - DNA, 15 bp, Homo sapiens
ttttaaaataacttt

SEQ ID NO: 22312 - DNA, 15 bp, Homo sapiens
attttaaaataactt

SEQ ID NO: 22313 - DNA, 15 bp, Homo sapiens
tattttaaaataact

SEQ ID NO: 22314 - DNA, 15 bp, Homo sapiens
ttattttaaaataac

SEQ ID NO: 22315 - DNA, 15 bp, Homo sapiens
tttattttaaaataa

SEQ ID NO: 22316 - DNA, 15 bp, Homo sapiens
ctttattttaaaata

SEQ ID NO: 22317 - DNA, 15 bp, Homo sapiens
tctttattttaaaat

SEQ ID NO: 22318 - DNA, 15 bp, Homo sapiens
atctttattttaaaa

SEQ ID NO: 22319 - DNA, 15 bp, Homo sapiens
aatctttattttaaa

SEQ ID NO: 22320 - DNA, 15 bp, Homo sapiens
taatctttattttaa

SEQ ID NO: 22321 - DNA, 15 bp, Homo sapiens
ttaatctttatttta

SEQ ID NO: 22322 - DNA, 15 bp, Homo sapiens
gttaatctttatttt

SEQ ID NO: 22323 - DNA, 15 bp, Homo sapiens
agttaatctttattt

SEQ ID NO: 22324 - DNA, 15 bp, Homo sapiens
tagttaatctttatt

SEQ ID NO: 22325 - DNA, 15 bp, Homo sapiens
ttagttaatctttat

SEQ ID NO: 22326 - DNA, 15 bp, Homo sapiens
attagttaatcttta

SEQ ID NO: 22327 - DNA, 15 bp, Homo sapiens
aattagttaatcttt

SEQ ID NO: 22328 - DNA, 15 bp, Homo sapiens
aaattagttaatctt

SEQ ID NO: 22329 - DNA, 15 bp, Homo sapiens
gaaattagttaatct

SEQ ID NO: 22330 - DNA, 15 bp, Homo sapiens
ggaaattagttaatc

SEQ ID NO: 22331 - DNA, 15 bp, Homo sapiens
aggaaattagttaat

SEQ ID NO: 22332 - DNA, 15 bp, Homo sapiens
aaggaaattagttaa

SEQ ID NO: 22333 - DNA, 15 bp, Homo sapiens
taaggaaattagtta

SEQ ID NO: 22334 - DNA, 15 bp, Homo sapiens
ataaggaaattagtt

SEQ ID NO: 22335 - DNA, 15 bp, Homo sapiens
aataaggaaattagt

SEQ ID NO: 22336 - DNA, 15 bp, Homo sapiens
caataaggaaattag

SEQ ID NO: 22337 - DNA, 15 bp, Homo sapiens
tcaataaggaaatta

SEQ ID NO: 22338 - DNA, 15 bp, Homo sapiens
ttcaataaggaaatt

SEQ ID NO: 22339 - DNA, 15 bp, Homo sapiens
attcaataaggaaat

SEQ ID NO: 22340 - DNA, 15 bp, Homo sapiens
cattcaataaggaaa

SEQ ID NO: 22341 - DNA, 15 bp, Homo sapiens
acattcaataaggaa

SEQ ID NO: 22342 - DNA, 15 bp, Homo sapiens
cacattcaataagga

SEQ ID NO: 22343 - DNA, 15 bp, Homo sapiens
tcacattcaataagg

SEQ ID NO: 22344 - DNA, 15 bp, Homo sapiens
ctcacattcaataag

SEQ ID NO: 22345 - DNA, 15 bp, Homo sapiens
tctcacattcaataa

SEQ ID NO: 22346 - DNA, 15 bp, Homo sapiens
atctcacattcaata

SEQ ID NO: 22347 - DNA, 15 bp, Homo sapiens
catctcacattcaat

SEQ ID NO: 22348 - DNA, 15 bp, Homo sapiens
tcatctcacattcaa

SEQ ID NO: 22349 - DNA, 15 bp, Homo sapiens
ttcatctcacattca

SEQ ID NO: 22350 - DNA, 15 bp, Homo sapiens
attcatctcacattc

SEQ ID NO: 22351 - DNA, 15 bp, Homo sapiens
aattcatctcacatt

SEQ ID NO: 22352 - DNA, 15 bp, Homo sapiens
caattcatctcacat

SEQ ID NO: 22353 - DNA, 15 bp, Homo sapiens
gcaattcatctcaca

SEQ ID NO: 22354 - DNA, 15 bp, Homo sapiens
agcaattcatctcac

SEQ ID NO: 22355 - DNA, 15 bp, Homo sapiens
gagcaattcatctca

SEQ ID NO: 22356 - DNA, 15 bp, Homo sapiens
agagcaattcatctc

SEQ ID NO: 22357 - DNA, 15 bp, Homo sapiens
cagagcaattcatct

SEQ ID NO: 22358 - DNA, 15 bp, Homo sapiens
tcagagcaattcatc

SEQ ID NO: 22359 - DNA, 15 bp, Homo sapiens
ttcagagcaattcat

SEQ ID NO: 22360 - DNA, 15 bp, Homo sapiens
tttcagagcaattca

SEQ ID NO: 22361 - DNA, 15 bp, Homo sapiens
ttttcagagcaattc

SEQ ID NO: 22362 - DNA, 15 bp, Homo sapiens
cttttcagagcaatt

SEQ ID NO: 22363 - DNA, 15 bp, Homo sapiens
tcttttcagagcaat

SEQ ID NO: 22364 - DNA, 15 bp, Homo sapiens
atcttttcagagcaa

SEQ ID NO: 22365 - DNA, 15 bp, Homo sapiens
catcttttcagagca

SEQ ID NO: 22366 - DNA, 15 bp, Homo sapiens
acatcttttcagagc

SEQ ID NO: 22367 - DNA, 15 bp, Homo sapiens
cacatcttttcagag

SEQ ID NO: 22368 - DNA, 15 bp, Homo sapiens
acacatcttttcaga

SEQ ID NO: 22369 - DNA, 15 bp, Homo sapiens
aacacatcttttcag

SEQ ID NO: 22370 - DNA, 15 bp, Homo sapiens
aaacacatcttttca

SEQ ID NO: 22371 - DNA, 15 bp, Homo sapiens
aaaacacatcttttc

SEQ ID NO: 22372 - DNA, 15 bp, Homo sapiens
aaaaacacatctttt

SEQ ID NO: 22373 - DNA, 15 bp, Homo sapiens
taaaaacacatcttt

SEQ ID NO: 22374 - DNA, 15 bp, Homo sapiens
ttaaaaacacatctt

SEQ ID NO: 22375 - DNA, 15 bp, Homo sapiens
tttaaaaacacatct

SEQ ID NO: 22376 - DNA, 15 bp, Homo sapiens
ttttaaaaacacatc

SEQ ID NO: 22377 - DNA, 15 bp, Homo sapiens
gttttaaaaacacat

SEQ ID NO: 22378 - DNA, 15 bp, Homo sapiens
tgttttaaaaacaca

SEQ ID NO: 22379 - DNA, 15 bp, Homo sapiens
gtgttttaaaaacac

SEQ ID NO: 22380 - DNA, 15 bp, Homo sapiens
tgtgttttaaaaaca

SEQ ID NO: 22381 - DNA, 15 bp, Homo sapiens
ttgtgttttaaaaac

SEQ ID NO: 22382 - DNA, 15 bp, Homo sapiens
gttgtgttttaaaaa

SEQ ID NO: 22383 - DNA, 15 bp, Homo sapiens
tgttgtgttttaaaa

SEQ ID NO: 22384 - DNA, 15 bp, Homo sapiens
atgttgtgttttaaa

SEQ ID NO: 22385 - DNA, 15 bp, Homo sapiens
tatgttgtgttttaa

SEQ ID NO: 22386 - DNA, 15 bp, Homo sapiens
ctatgttgtgtttta

SEQ ID NO: 22387 - DNA, 15 bp, Homo sapiens
gctatgttgtgtttt

SEQ ID NO: 22388 - DNA, 15 bp, Homo sapiens
agctatgttgtgttt

SEQ ID NO: 22389 - DNA, 15 bp, Homo sapiens
aagctatgttgtgtt

SEQ ID NO: 22390 - DNA, 15 bp, Homo sapiens
aaagctatgttgtgt

SEQ ID NO: 22391 - DNA, 15 bp, Homo sapiens
caaagctatgttgtg

SEQ ID NO: 22392 - DNA, 15 bp, Homo sapiens
acaaagctatgttgt

SEQ ID NO: 22393 - DNA, 15 bp, Homo sapiens
aacaaagctatgttg

SEQ ID NO: 22394 - DNA, 15 bp, Homo sapiens
caacaaagctatgtt

SEQ ID NO: 22395 - DNA, 15 bp, Homo sapiens
acaacaaagctatgt

SEQ ID NO: 22396 - DNA, 15 bp, Homo sapiens
aacaacaaagctatg

SEQ ID NO: 22397 - DNA, 15 bp, Homo sapiens
caacaacaaagctat

SEQ ID NO: 22398 - DNA, 15 bp, Homo sapiens
gcaacaacaaagcta

SEQ ID NO: 22399 - DNA, 15 bp, Homo sapiens
agcaacaacaaagct

SEQ ID NO: 22400 - DNA, 15 bp, Homo sapiens
cagcaacaacaaagc

SEQ ID NO: 22401 - DNA, 15 bp, Homo sapiens
acagcaacaacaaag

SEQ ID NO: 22402 - DNA, 15 bp, Homo sapiens
aacagcaacaacaaa

SEQ ID NO: 22403 - DNA, 15 bp, Homo sapiens
taacagcaacaacaa

SEQ ID NO: 22404 - DNA, 15 bp, Homo sapiens
ataacagcaacaaca

SEQ ID NO: 22405 - DNA, 15 bp, Homo sapiens
aataacagcaacaac

SEQ ID NO: 22406 - DNA, 15 bp, Homo sapiens
taataacagcaacaa

SEQ ID NO: 22407 - DNA, 15 bp, Homo sapiens
gtaataacagcaaca

SEQ ID NO: 22408 - DNA, 15 bp, Homo sapiens
cgtaataacagcaac

SEQ ID NO: 22409 - DNA, 15 bp, Homo sapiens
ccgtaataacagcaa

SEQ ID NO: 22410 - DNA, 15 bp, Homo sapiens
tccgtaataacagca

SEQ ID NO: 22411 - DNA, 15 bp, Homo sapiens
ctccgtaataacagc

SEQ ID NO: 22412 - DNA, 15 bp, Homo sapiens
actccgtaataacag

SEQ ID NO: 22413 - DNA, 15 bp, Homo sapiens
aactccgtaataaca

SEQ ID NO: 22414 - DNA, 15 bp, Homo sapiens
aaactccgtaataac

SEQ ID NO: 22415 - DNA, 15 bp, Homo sapiens
aaaactccgtaataa

SEQ ID NO: 22416 - DNA, 15 bp, Homo sapiens
caaaactccgtaata

SEQ ID NO: 22417 - DNA, 15 bp, Homo sapiens
gcaaaactccgtaat

SEQ ID NO: 22418 - DNA, 15 bp, Homo sapiens
agcaaaactccgtaa

SEQ ID NO: 22419 - DNA, 15 bp, Homo sapiens
gagcaaaactccgta

SEQ ID NO: 22420 - DNA, 15 bp, Homo sapiens
agagcaaaactccgt

SEQ ID NO: 22421 - DNA, 15 bp, Homo sapiens
cagagcaaaactccg

SEQ ID NO: 22422 - DNA, 15 bp, Homo sapiens
acagagcaaaactcc

SEQ ID NO: 22423 - DNA, 15 bp, Homo sapiens
gacagagcaaaactc

SEQ ID NO: 22424 - DNA, 15 bp, Homo sapiens
cgacagagcaaaact

SEQ ID NO: 22425 - DNA, 15 bp, Homo sapiens
gcgacagagcaaaac

SEQ ID NO: 22426 - DNA, 15 bp, Homo sapiens
ggcgacagagcaaaa

SEQ ID NO: 22427 - DNA, 15 bp, Homo sapiens
gggcgacagagcaaa

SEQ ID NO: 22428 - DNA, 15 bp, Homo sapiens
tagcctgggcgacag

SEQ ID NO: 22429 - DNA, 15 bp, Homo sapiens
ctagcctgggcgaca

SEQ ID NO: 22430 - DNA, 15 bp, Homo sapiens
tctagcctgggcgac

SEQ ID NO: 22431 - DNA, 15 bp, Homo sapiens
ctctagcctgggcga

SEQ ID NO: 22432 - DNA, 15 bp, Homo sapiens
actctagcctgggcg

SEQ ID NO: 22433 - DNA, 15 bp, Homo sapiens
cactctagcctgggc

SEQ ID NO: 22434 - DNA, 15 bp, Homo sapiens
gcactctagcctggg

SEQ ID NO: 22435 - DNA, 15 bp, Homo sapiens
tgcactctagcctgg

SEQ ID NO: 22436 - DNA, 15 bp, Homo sapiens
ctgcactctagcctg

SEQ ID NO: 22437 - DNA, 15 bp, Homo sapiens
actgcactctagcct

SEQ ID NO: 22438 - DNA, 15 bp, Homo sapiens
cactgcactctagcc

SEQ ID NO: 22439 - DNA, 15 bp, Homo sapiens
ccactgcactctagc

SEQ ID NO: 22440 - DNA, 15 bp, Homo sapiens
gccactgcactctag

SEQ ID NO: 22441 - DNA, 15 bp, Homo sapiens
cgccactgcactcta

SEQ ID NO: 22442 - DNA, 15 bp, Homo sapiens
gcgccactgcactct

SEQ ID NO: 22443 - DNA, 15 bp, Homo sapiens
ggctgagattgcgcc

SEQ ID NO: 22444 - DNA, 15 bp, Homo sapiens
gggctgagattgcgc

SEQ ID NO: 22445 - DNA, 15 bp, Homo sapiens
tgggctgagattgcg

SEQ ID NO: 22446 - DNA, 15 bp, Homo sapiens
gtgggctgagattgc

SEQ ID NO: 22447 - DNA, 15 bp, Homo sapiens
agtgggctgagattg

SEQ ID NO: 22448 - DNA, 15 bp, Homo sapiens
cagtgggctgagatt

SEQ ID NO: 22449 - DNA, 15 bp, Homo sapiens
gcagtgggctgagat

SEQ ID NO: 22450 - DNA, 15 bp, Homo sapiens
tgcagtgggctgaga

SEQ ID NO: 22451 - DNA, 15 bp, Homo sapiens
ttgcagtgggctgag

SEQ ID NO: 22452 - DNA, 15 bp, Homo sapiens
gttgcagtgggctga

SEQ ID NO: 22453 - DNA, 15 bp, Homo sapiens
ggttgcagtgggctg

SEQ ID NO: 22454 - DNA, 15 bp, Homo sapiens
aggttgcagtgggct

SEQ ID NO: 22455 - DNA, 15 bp, Homo sapiens
gaggttgcagtgggc

SEQ ID NO: 22456 - DNA, 15 bp, Homo sapiens
agaggttgcagtggg

SEQ ID NO: 22457 - DNA, 15 bp, Homo sapiens
cagaggttgcagtgg

SEQ ID NO: 22458 - DNA, 15 bp, Homo sapiens
gtgcttgaacccggg

SEQ ID NO: 22459 - DNA, 15 bp, Homo sapiens
agtgcttgaacccgg

SEQ ID NO: 22460 - DNA, 15 bp, Homo sapiens
aagtgcttgaacccg

SEQ ID NO: 22461 - DNA, 15 bp, Homo sapiens
gaagtgcttgaaccc

SEQ ID NO: 22462 - DNA, 15 bp, Homo sapiens
agaagtgcttgaacc

SEQ ID NO: 22463 - DNA, 15 bp, Homo sapiens
gagaagtgcttgaac

SEQ ID NO: 22464 - DNA, 15 bp, Homo sapiens
agagaagtgcttgaa

SEQ ID NO: 22465 - DNA, 15 bp, Homo sapiens
gagagaagtgcttga

SEQ ID NO: 22466 - DNA, 15 bp, Homo sapiens
ggagagaagtgcttg

SEQ ID NO: 22467 - DNA, 15 bp, Homo sapiens
gggagagaagtgctt

SEQ ID NO: 22468 - DNA, 15 bp, Homo sapiens
agggagagaagtgct

SEQ ID NO: 22469 - DNA, 15 bp, Homo sapiens
gagggagagaagtgc

SEQ ID NO: 22470 - DNA, 15 bp, Homo sapiens
tgagggagagaagtg

SEQ ID NO: 22471 - DNA, 15 bp, Homo sapiens
ttgagggagagaagt

SEQ ID NO: 22472 - DNA, 15 bp, Homo sapiens
gttgagggagagaag

SEQ ID NO: 22473 - DNA, 15 bp, Homo sapiens
ggttgagggagagaa

SEQ ID NO: 22474 - DNA, 15 bp, Homo sapiens
aggttgagggagaga

SEQ ID NO: 22475 - DNA, 15 bp, Homo sapiens
gaggttgagggagag

SEQ ID NO: 22476 - DNA, 15 bp, Homo sapiens
ggaggttgagggaga

SEQ ID NO: 22477 - DNA, 15 bp, Homo sapiens
aggaggttgagggag

SEQ ID NO: 22478 - DNA, 15 bp, Homo sapiens
caggaggttgaggga

SEQ ID NO: 22479 - DNA, 15 bp, Homo sapiens
tcaggaggttgaggg

SEQ ID NO: 22480 - DNA, 15 bp, Homo sapiens
ctcaggaggttgagg

SEQ ID NO: 22481 - DNA, 15 bp, Homo sapiens
actcaggaggttgag

SEQ ID NO: 22482 - DNA, 15 bp, Homo sapiens
tactcaggaggttga

SEQ ID NO: 22483 - DNA, 15 bp, Homo sapiens
ctactcaggaggttg

SEQ ID NO: 22484 - DNA, 15 bp, Homo sapiens
gctactcaggaggtt

SEQ ID NO: 22485 - DNA, 15 bp, Homo sapiens
agctactcaggaggt

SEQ ID NO: 22486 - DNA, 15 bp, Homo sapiens
caaattagccgggcg

SEQ ID NO: 22487 - DNA, 15 bp, Homo sapiens
acaaattagccgggc

SEQ ID NO: 22488 - DNA, 15 bp, Homo sapiens
aacaaattagccggg

SEQ ID NO: 22489 - DNA, 15 bp, Homo sapiens
taacaaattagccgg

SEQ ID NO: 22490 - DNA, 15 bp, Homo sapiens
ataacaaattagccg

SEQ ID NO: 22491 - DNA, 15 bp, Homo sapiens
tataacaaattagcc

SEQ ID NO: 22492 - DNA, 15 bp, Homo sapiens
atataacaaattagc

SEQ ID NO: 22493 - DNA, 15 bp, Homo sapiens
aatataacaaattag

SEQ ID NO: 22494 - DNA, 15 bp, Homo sapiens
aaatataacaaatta

SEQ ID NO: 22495 - DNA, 15 bp, Homo sapiens
aaaatataacaaatt

SEQ ID NO: 22496 - DNA, 15 bp, Homo sapiens
aaaaatataacaaat

SEQ ID NO: 22497 - DNA, 15 bp, Homo sapiens
taaaaatataacaaa

SEQ ID NO: 22498 - DNA, 15 bp, Homo sapiens
ctaaaaatataacaa

SEQ ID NO: 22499 - DNA, 15 bp, Homo sapiens
actaaaaatataaca

SEQ ID NO: 22500 - DNA, 15 bp, Homo sapiens
tactaaaaatataac

SEQ ID NO: 22501 - DNA, 15 bp, Homo sapiens
acccgtctctactaa

SEQ ID NO: 22502 - DNA, 15 bp, Homo sapiens
aacccgtctctacta

SEQ ID NO: 22503 - DNA, 15 bp, Homo sapiens
aaacccgtctctact

SEQ ID NO: 22504 - DNA, 15 bp, Homo sapiens
gaaacccgtctctac

SEQ ID NO: 22505 - DNA, 15 bp, Homo sapiens
tgaaacccgtctcta

SEQ ID NO: 22506 - DNA, 15 bp, Homo sapiens
gtgaaacccgtctct

SEQ ID NO: 22507 - DNA, 15 bp, Homo sapiens
ggtgaaacccgtctc

SEQ ID NO: 22508 - DNA, 15 bp, Homo sapiens
tggtgaaacccgtct

SEQ ID NO: 22509 - DNA, 15 bp, Homo sapiens
atggtgaaacccgtc

SEQ ID NO: 22510 - DNA, 15 bp, Homo sapiens
gatggtgaaacccgt

SEQ ID NO: 22511 - DNA, 15 bp, Homo sapiens
agatggtgaaacccg

SEQ ID NO: 22512 - DNA, 15 bp, Homo sapiens
aagatggtgaaaccc

SEQ ID NO: 22513 - DNA, 15 bp, Homo sapiens
aaagatggtgaaacc

SEQ ID NO: 22514 - DNA, 15 bp, Homo sapiens
caaagatggtgaaac

SEQ ID NO: 22515 - DNA, 15 bp, Homo sapiens
gcaaagatggtgaaa

SEQ ID NO: 22516 - DNA, 15 bp, Homo sapiens
ggcaaagatggtgaa

SEQ ID NO: 22517 - DNA, 15 bp, Homo sapiens
tggcaaagatggtga

SEQ ID NO: 22518 - DNA, 15 bp, Homo sapiens
ctggcaaagatggtg

SEQ ID NO: 22519 - DNA, 15 bp, Homo sapiens
cctggcaaagatggt

SEQ ID NO: 22520 - DNA, 15 bp, Homo sapiens
gcctggcaaagatgg

SEQ ID NO: 22521 - DNA, 15 bp, Homo sapiens
agcctggcaaagatg

SEQ ID NO: 22522 - DNA, 15 bp, Homo sapiens
cagcctggcaaagat

SEQ ID NO: 22523 - DNA, 15 bp, Homo sapiens
tcagcctggcaaaga

SEQ ID NO: 22524 - DNA, 15 bp, Homo sapiens
atcagcctggcaaag

SEQ ID NO: 22525 - DNA, 15 bp, Homo sapiens
gatcagcctggcaaa

SEQ ID NO: 22526 - DNA, 15 bp, Homo sapiens
agatcagcctggcaa

SEQ ID NO: 22527 - DNA, 15 bp, Homo sapiens
aagatcagcctggca

SEQ ID NO: 22528 - DNA, 15 bp, Homo sapiens
caagatcagcctggc

SEQ ID NO: 22529 - DNA, 15 bp, Homo sapiens
tcaagatcagcctgg

SEQ ID NO: 22530 - DNA, 15 bp, Homo sapiens
ctcaagatcagcctg

SEQ ID NO: 22531 - DNA, 15 bp, Homo sapiens
gctcaagatcagcct

SEQ ID NO: 22532 - DNA, 15 bp, Homo sapiens
agctcaagatcagcc

SEQ ID NO: 22533 - DNA, 15 bp, Homo sapiens
gagctcaagatcagc

SEQ ID NO: 22534 - DNA, 15 bp, Homo sapiens
ggagctcaagatcag

SEQ ID NO: 22535 - DNA, 15 bp, Homo sapiens
aggagctcaagatca

SEQ ID NO: 22536 - DNA, 15 bp, Homo sapiens
caggagctcaagatc

SEQ ID NO: 22537 - DNA, 15 bp, Homo sapiens
acaggagctcaagat

SEQ ID NO: 22538 - DNA, 15 bp, Homo sapiens
gacaggagctcaaga

SEQ ID NO: 22539 - DNA, 15 bp, Homo sapiens
ggacaggagctcaag

SEQ ID NO: 22540 - DNA, 15 bp, Homo sapiens
aggacaggagctcaa

SEQ ID NO: 22541 - DNA, 15 bp, Homo sapiens
gaggacaggagctca

SEQ ID NO: 22542 - DNA, 15 bp, Homo sapiens
tgaggacaggagctc

SEQ ID NO: 22543 - DNA, 15 bp, Homo sapiens
atgaggacaggagct

SEQ ID NO: 22544 - DNA, 15 bp, Homo sapiens
catgaggacaggagc

SEQ ID NO: 22545 - DNA, 15 bp, Homo sapiens
tcatgaggacaggag

SEQ ID NO: 22546 - DNA, 15 bp, Homo sapiens
atcatgaggacagga

SEQ ID NO: 22547 - DNA, 15 bp, Homo sapiens
gatcatgaggacagg

SEQ ID NO: 22548 - DNA, 15 bp, Homo sapiens
agatcatgaggacag

SEQ ID NO: 22549 - DNA, 15 bp, Homo sapiens
tagatcatgaggaca

SEQ ID NO: 22550 - DNA, 15 bp, Homo sapiens
gtagatcatgaggac

SEQ ID NO: 22551 - DNA, 15 bp, Homo sapiens
agtagatcatgagga

SEQ ID NO: 22552 - DNA, 15 bp, Homo sapiens
gagtagatcatgagg

SEQ ID NO: 22553 - DNA, 15 bp, Homo sapiens
tgagtagatcatgag

SEQ ID NO: 22554 - DNA, 15 bp, Homo sapiens
gtgagtagatcatga

SEQ ID NO: 22555 - DNA, 15 bp, Homo sapiens
ggtgagtagatcatg

SEQ ID NO: 22556 - DNA, 15 bp, Homo sapiens
aggtgagtagatcat

SEQ ID NO: 22557 - DNA, 15 bp, Homo sapiens
aaggtgagtagatca

SEQ ID NO: 22558 - DNA, 15 bp, Homo sapiens
caaggtgagtagatc

SEQ ID NO: 22559 - DNA, 15 bp, Homo sapiens
ccaaggtgagtagat

SEQ ID NO: 22560 - DNA, 15 bp, Homo sapiens
gccaaggtgagtaga

SEQ ID NO: 22561 - DNA, 15 bp, Homo sapiens
ggccaaggtgagtag

SEQ ID NO: 22562 - DNA, 15 bp, Homo sapiens
aggccaaggtgagta

SEQ ID NO: 22563 - DNA, 15 bp, Homo sapiens
gaggccaaggtgagt

SEQ ID NO: 22564 - DNA, 15 bp, Homo sapiens
agaggccaaggtgag

SEQ ID NO: 22565 - DNA, 15 bp, Homo sapiens
gagaggccaaggtga

SEQ ID NO: 22566 - DNA, 15 bp, Homo sapiens
tgagaggccaaggtg

SEQ ID NO: 22567 - DNA, 15 bp, Homo sapiens
ctgagaggccaaggt

SEQ ID NO: 22568 - DNA, 15 bp, Homo sapiens
actgagaggccaagg

SEQ ID NO: 22569 - DNA, 15 bp, Homo sapiens
cactgagaggccaag

SEQ ID NO: 22570 - DNA, 15 bp, Homo sapiens
gcactgagaggccaa

SEQ ID NO: 22571 - DNA, 15 bp, Homo sapiens
agcactgagaggcca

SEQ ID NO: 22572 - DNA, 15 bp, Homo sapiens
cagcactgagaggcc

SEQ ID NO: 22573 - DNA, 15 bp, Homo sapiens
ccagcactgagaggc

SEQ ID NO: 22574 - DNA, 15 bp, Homo sapiens
cccagcactgagagg

SEQ ID NO: 22575 - DNA, 15 bp, Homo sapiens
tcccagcactgagag

SEQ ID NO: 22576 - DNA, 15 bp, Homo sapiens
atcccagcactgaga

SEQ ID NO: 22577 - DNA, 15 bp, Homo sapiens
aatcccagcactgag

SEQ ID NO: 22578 - DNA, 15 bp, Homo sapiens
taatcccagcactga

SEQ ID NO: 22579 - DNA, 15 bp, Homo sapiens
ataatcccagcactg

SEQ ID NO: 22580 - DNA, 15 bp, Homo sapiens
tggctcacgcctata

SEQ ID NO: 22581 - DNA, 15 bp, Homo sapiens
gtggctcacgcctat

SEQ ID NO: 22582 - DNA, 15 bp, Homo sapiens
ggtggctcacgccta

SEQ ID NO: 22583 - DNA, 15 bp, Homo sapiens
agctgggcacggtgg

SEQ ID NO: 22584 - DNA, 15 bp, Homo sapiens
gagctgggcacggtg

SEQ ID NO: 22585 - DNA, 15 bp, Homo sapiens
tgagctgggcacggt

SEQ ID NO: 22586 - DNA, 15 bp, Homo sapiens
ttgagctgggcacgg

SEQ ID NO: 22587 - DNA, 15 bp, Homo sapiens
gttgagctgggcacg

SEQ ID NO: 22588 - DNA, 15 bp, Homo sapiens
cgttgagctgggcac

SEQ ID NO: 22589 - DNA, 15 bp, Homo sapiens
acgttgagctgggca

SEQ ID NO: 22590 - DNA, 15 bp, Homo sapiens
cacgttgagctgggc

SEQ ID NO: 22591 - DNA, 15 bp, Homo sapiens
ccacgttgagctggg

SEQ ID NO: 22592 - DNA, 15 bp, Homo sapiens
gccacgttgagctgg

SEQ ID NO: 22593 - DNA, 15 bp, Homo sapiens
ggccacgttgagctg

SEQ ID NO: 22594 - DNA, 15 bp, Homo sapiens
aggccacgttgagct

SEQ ID NO: 22595 - DNA, 15 bp, Homo sapiens
caggccacgttgagc

SEQ ID NO: 22596 - DNA, 15 bp, Homo sapiens
acaggccacgttgag

SEQ ID NO: 22597 - DNA, 15 bp, Homo sapiens
aacaggccacgttga

SEQ ID NO: 22598 - DNA, 15 bp, Homo sapiens
aaacaggccacgttg

SEQ ID NO: 22599 - DNA, 15 bp, Homo sapiens
taaacaggccacgtt

SEQ ID NO: 22600 - DNA, 15 bp, Homo sapiens
ttaaacaggccacgt

SEQ ID NO: 22601 - DNA, 15 bp, Homo sapiens
gttaaacaggccacg

SEQ ID NO: 22602 - DNA, 15 bp, Homo sapiens
agttaaacaggccac

SEQ ID NO: 22603 - DNA, 15 bp, Homo sapiens
aagttaaacaggcca

SEQ ID NO: 22604 - DNA, 15 bp, Homo sapiens
caagttaaacaggcc

SEQ ID NO: 22605 - DNA, 15 bp, Homo sapiens
tcaagttaaacaggc

SEQ ID NO: 22606 - DNA, 15 bp, Homo sapiens
ctcaagttaaacagg

SEQ ID NO: 22607 - DNA, 15 bp, Homo sapiens
actcaagttaaacag

SEQ ID NO: 22608 - DNA, 15 bp, Homo sapiens
aactcaagttaaaca

SEQ ID NO: 22609 - DNA, 15 bp, Homo sapiens
aaactcaagttaaac

SEQ ID NO: 22610 - DNA, 15 bp, Homo sapiens
aaaactcaagttaaa

SEQ ID NO: 22611 - DNA, 15 bp, Homo sapiens
taaaactcaagttaa

SEQ ID NO: 22612 - DNA, 15 bp, Homo sapiens
gtaaaactcaagtta

SEQ ID NO: 22613 - DNA, 15 bp, Homo sapiens
tgtaaaactcaagtt

SEQ ID NO: 22614 - DNA, 15 bp, Homo sapiens
atgtaaaactcaagt

SEQ ID NO: 22615 - DNA, 15 bp, Homo sapiens
aatgtaaaactcaag

SEQ ID NO: 22616 - DNA, 15 bp, Homo sapiens
aaatgtaaaactcaa

SEQ ID NO: 22617 - DNA, 15 bp, Homo sapiens
aaaatgtaaaactca

SEQ ID NO: 22618 - DNA, 15 bp, Homo sapiens
aaaaatgtaaaactc

SEQ ID NO: 22619 - DNA, 15 bp, Homo sapiens
aaaaaatgtaaaact

SEQ ID NO: 22620 - DNA, 15 bp, Homo sapiens
taaaaaatgtaaaac

SEQ ID NO: 22621 - DNA, 15 bp, Homo sapiens
ttaaaaaatgtaaaa

SEQ ID NO: 22622 - DNA, 15 bp, Homo sapiens
tttaaaaaatgtaaa

SEQ ID NO: 22623 - DNA, 15 bp, Homo sapiens
atttaaaaaatgtaa

SEQ ID NO: 22624 - DNA, 15 bp, Homo sapiens
aatttaaaaaatgta

SEQ ID NO: 22625 - DNA, 15 bp, Homo sapiens
gaatttaaaaaatgt

SEQ ID NO: 22626 - DNA, 15 bp, Homo sapiens
ggaatttaaaaaatg

SEQ ID NO: 22627 - DNA, 15 bp, Homo sapiens
gggaatttaaaaaat

SEQ ID NO: 22628 - DNA, 15 bp, Homo sapiens
ggggaatttaaaaaa

SEQ ID NO: 22629 - DNA, 15 bp, Homo sapiens
aggggaatttaaaaa

SEQ ID NO: 22630 - DNA, 15 bp, Homo sapiens
aaggggaatttaaaa

SEQ ID NO: 22631 - DNA, 15 bp, Homo sapiens
taaggggaatttaaa

SEQ ID NO: 22632 - DNA, 15 bp, Homo sapiens
ctaaggggaatttaa

SEQ ID NO: 22633 - DNA, 15 bp, Homo sapiens
tctaaggggaattta

SEQ ID NO: 22634 - DNA, 15 bp, Homo sapiens
ctctaaggggaattt

SEQ ID NO: 22635 - DNA, 15 bp, Homo sapiens
tctctaaggggaatt

SEQ ID NO: 22636 - DNA, 15 bp, Homo sapiens
ttctctaaggggaat

SEQ ID NO: 22637 - DNA, 15 bp, Homo sapiens
attctctaaggggaa

SEQ ID NO: 22638 - DNA, 15 bp, Homo sapiens
cattctctaagggga

SEQ ID NO: 22639 - DNA, 15 bp, Homo sapiens
tcattctctaagggg

SEQ ID NO: 22640 - DNA, 15 bp, Homo sapiens
atcattctctaaggg

SEQ ID NO: 22641 - DNA, 15 bp, Homo sapiens
aatcattctctaagg

SEQ ID NO: 22642 - DNA, 15 bp, Homo sapiens
aaatcattctctaag

SEQ ID NO: 22643 - DNA, 15 bp, Homo sapiens
caaatcattctctaa

SEQ ID NO: 22644 - DNA, 15 bp, Homo sapiens
tcaaatcattctcta

SEQ ID NO: 22645 - DNA, 15 bp, Homo sapiens
atcaaatcattctct

SEQ ID NO: 22646 - DNA, 15 bp, Homo sapiens
gatcaaatcattctc

SEQ ID NO: 22647 - DNA, 15 bp, Homo sapiens
tgatcaaatcattct

SEQ ID NO: 22648 - DNA, 15 bp, Homo sapiens
ctgatcaaatcattc

SEQ ID NO: 22649 - DNA, 15 bp, Homo sapiens
tctgatcaaatcatt

SEQ ID NO: 22650 - DNA, 15 bp, Homo sapiens
atctgatcaaatcat

SEQ ID NO: 22651 - DNA, 15 bp, Homo sapiens
aatctgatcaaatca

SEQ ID NO: 22652 - DNA, 15 bp, Homo sapiens
taatctgatcaaatc

SEQ ID NO: 22653 - DNA, 15 bp, Homo sapiens
ataatctgatcaaat

SEQ ID NO: 22654 - DNA, 15 bp, Homo sapiens
aataatctgatcaaa

SEQ ID NO: 22655 - DNA, 15 bp, Homo sapiens
taataatctgatcaa

SEQ ID NO: 22656 - DNA, 15 bp, Homo sapiens
ttaataatctgatca

SEQ ID NO: 22657 - DNA, 15 bp, Homo sapiens
attaataatctgatc

SEQ ID NO: 22658 - DNA, 15 bp, Homo sapiens
aattaataatctgat

SEQ ID NO: 22659 - DNA, 15 bp, Homo sapiens
caattaataatctga

SEQ ID NO: 22660 - DNA, 15 bp, Homo sapiens
gcaattaataatctg

SEQ ID NO: 22661 - DNA, 15 bp, Homo sapiens
agcaattaataatct

SEQ ID NO: 22662 - DNA, 15 bp, Homo sapiens
gagcaattaataatc

SEQ ID NO: 22663 - DNA, 15 bp, Homo sapiens
tgagcaattaataat

SEQ ID NO: 22664 - DNA, 15 bp, Homo sapiens
atgagcaattaataa

SEQ ID NO: 22665 - DNA, 15 bp, Homo sapiens
tatgagcaattaata

SEQ ID NO: 22666 - DNA, 15 bp, Homo sapiens
atatgagcaattaat

SEQ ID NO: 22667 - DNA, 15 bp, Homo sapiens
aatatgagcaattaa

SEQ ID NO: 22668 - DNA, 15 bp, Homo sapiens
aaatatgagcaatta

SEQ ID NO: 22669 - DNA, 15 bp, Homo sapiens
gaaatatgagcaatt

SEQ ID NO: 22670 - DNA, 15 bp, Homo sapiens
tgaaatatgagcaat

SEQ ID NO: 22671 - DNA, 15 bp, Homo sapiens
ctgaaatatgagcaa

SEQ ID NO: 22672 - DNA, 15 bp, Homo sapiens
tctgaaatatgagca

SEQ ID NO: 22673 - DNA, 15 bp, Homo sapiens
ctctgaaatatgagc

SEQ ID NO: 22674 - DNA, 15 bp, Homo sapiens
tctctgaaatatgag

SEQ ID NO: 22675 - DNA, 15 bp, Homo sapiens
ttctctgaaatatga

SEQ ID NO: 22676 - DNA, 15 bp, Homo sapiens
tttctctgaaatatg

SEQ ID NO: 22677 - DNA, 15 bp, Homo sapiens
ctttctctgaaatat

SEQ ID NO: 22678 - DNA, 15 bp, Homo sapiens
gctttctctgaaata

SEQ ID NO: 22679 - DNA, 15 bp, Homo sapiens
tgctttctctgaaat

SEQ ID NO: 22680 - DNA, 15 bp, Homo sapiens
gtgctttctctgaaa

SEQ ID NO: 22681 - DNA, 15 bp, Homo sapiens
cgtgctttctctgaa

SEQ ID NO: 22682 - DNA, 15 bp, Homo sapiens
tcgtgctttctctga

SEQ ID NO: 22683 - DNA, 15 bp, Homo sapiens
ctcgtgctttctctg

SEQ ID NO: 22684 - DNA, 15 bp, Homo sapiens
tctcgtgctttctct

SEQ ID NO: 22685 - DNA, 15 bp, Homo sapiens
ttctcgtgctttctc

SEQ ID NO: 22686 - DNA, 15 bp, Homo sapiens
tttctcgtgctttct

SEQ ID NO: 22687 - DNA, 15 bp, Homo sapiens
ttttctcgtgctttc

SEQ ID NO: 22688 - DNA, 15 bp, Homo sapiens
attttctcgtgcttt

SEQ ID NO: 22689 - DNA, 15 bp, Homo sapiens
tattttctcgtgctt

SEQ ID NO: 22690 - DNA, 15 bp, Homo sapiens
atattttctcgtgct

SEQ ID NO: 22691 - DNA, 15 bp, Homo sapiens
tatattttctcgtgc

SEQ ID NO: 22692 - DNA, 15 bp, Homo sapiens
ctatattttctcgtg

SEQ ID NO: 22693 - DNA, 15 bp, Homo sapiens
actatattttctcgt

SEQ ID NO: 22694 - DNA, 15 bp, Homo sapiens
aactatattttctcg

SEQ ID NO: 22695 - DNA, 15 bp, Homo sapiens
aaactatattttctc

SEQ ID NO: 22696 - DNA, 15 bp, Homo sapiens
aaaactatattttct

SEQ ID NO: 22697 - DNA, 15 bp, Homo sapiens
caaaactatattttc

SEQ ID NO: 22698 - DNA, 15 bp, Homo sapiens
tcaaaactatatttt

SEQ ID NO: 22699 - DNA, 15 bp, Homo sapiens
gtcaaaactatattt

SEQ ID NO: 22700 - DNA, 15 bp, Homo sapiens
tgtcaaaactatatt

SEQ ID NO: 22701 - DNA, 15 bp, Homo sapiens
atgtcaaaactatat

SEQ ID NO: 22702 - DNA, 15 bp, Homo sapiens
gatgtcaaaactata

SEQ ID NO: 22703 - DNA, 15 bp, Homo sapiens
tgatgtcaaaactat

SEQ ID NO: 22704 - DNA, 15 bp, Homo sapiens
gtgatgtcaaaacta

SEQ ID NO: 22705 - DNA, 15 bp, Homo sapiens
agtgatgtcaaaact

SEQ ID NO: 22706 - DNA, 15 bp, Homo sapiens
aagtgatgtcaaaac

SEQ ID NO: 22707 - DNA, 15 bp, Homo sapiens
aaagtgatgtcaaaa

SEQ ID NO: 22708 - DNA, 15 bp, Homo sapiens
gaaagtgatgtcaaa

SEQ ID NO: 22709 - DNA, 15 bp, Homo sapiens
agaaagtgatgtcaa

SEQ ID NO: 22710 - DNA, 15 bp, Homo sapiens
cagaaagtgatgtca

SEQ ID NO: 22711 - DNA, 15 bp, Homo sapiens
acagaaagtgatgtc

SEQ ID NO: 22712 - DNA, 15 bp, Homo sapiens
tacagaaagtgatgt

SEQ ID NO: 22713 - DNA, 15 bp, Homo sapiens
ttacagaaagtgatg

SEQ ID NO: 22714 - DNA, 15 bp, Homo sapiens
attacagaaagtgat

SEQ ID NO: 22715 - DNA, 15 bp, Homo sapiens
aattacagaaagtga

SEQ ID NO: 22716 - DNA, 15 bp, Homo sapiens
aaattacagaaagtg

SEQ ID NO: 22717 - DNA, 15 bp, Homo sapiens
aaaattacagaaagt

SEQ ID NO: 22718 - DNA, 15 bp, Homo sapiens
aaaaattacagaaag

SEQ ID NO: 22719 - DNA, 15 bp, Homo sapiens
aaaaaattacagaaa

SEQ ID NO: 22720 - DNA, 15 bp, Homo sapiens
gaaaaaattacagaa

SEQ ID NO: 22721 - DNA, 15 bp, Homo sapiens
agaaaaaattacaga

SEQ ID NO: 22722 - DNA, 15 bp, Homo sapiens
aagaaaaaattacag

SEQ ID NO: 22723 - DNA, 15 bp, Homo sapiens
aaagaaaaaattaca

SEQ ID NO: 22724 - DNA, 15 bp, Homo sapiens
aaaagaaaaaattac

SEQ ID NO: 22725 - DNA, 15 bp, Homo sapiens
aaaaagaaaaaatta

SEQ ID NO: 22726 - DNA, 15 bp, Homo sapiens
taaaaagaaaaaatt

SEQ ID NO: 22727 - DNA, 15 bp, Homo sapiens
ctaaaaagaaaaaat

SEQ ID NO: 22728 - DNA, 15 bp, Homo sapiens
tctaaaaagaaaaaa

SEQ ID NO: 22729 - DNA, 15 bp, Homo sapiens
ctctaaaaagaaaaa

SEQ ID NO: 22730 - DNA, 15 bp, Homo sapiens
cctctaaaaagaaaa

SEQ ID NO: 22731 - DNA, 15 bp, Homo sapiens
tcctctaaaaagaaa

SEQ ID NO: 22732 - DNA, 15 bp, Homo sapiens
ctcctctaaaaagaa

SEQ ID NO: 22733 - DNA, 15 bp, Homo sapiens
cctcctctaaaaaga

SEQ ID NO: 22734 - DNA, 15 bp, Homo sapiens
acctcctctaaaaag

SEQ ID NO: 22735 - DNA, 15 bp, Homo sapiens
aacctcctctaaaaa

SEQ ID NO: 22736 - DNA, 15 bp, Homo sapiens
aaacctcctctaaaa

SEQ ID NO: 22737 - DNA, 15 bp, Homo sapiens
aaaacctcctctaaa

SEQ ID NO: 22738 - DNA, 15 bp, Homo sapiens
taaaacctcctctaa

SEQ ID NO: 22739 - DNA, 15 bp, Homo sapiens
gtaaaacctcctcta

SEQ ID NO: 22740 - DNA, 15 bp, Homo sapiens
tgtaaaacctcctct

SEQ ID NO: 22741 - DNA, 15 bp, Homo sapiens
ttgtaaaacctcctc

SEQ ID NO: 22742 - DNA, 15 bp, Homo sapiens
cttgtaaaacctcct

SEQ ID NO: 22743 - DNA, 15 bp, Homo sapiens
acttgtaaaacctcc

SEQ ID NO: 22744 - DNA, 15 bp, Homo sapiens
aacttgtaaaacctc

SEQ ID NO: 22745 - DNA, 15 bp, Homo sapiens
aaacttgtaaaacct

SEQ ID NO: 22746 - DNA, 15 bp, Homo sapiens
aaaacttgtaaaacc

SEQ ID NO: 22747 - DNA, 15 bp, Homo sapiens
gaaaacttgtaaaac

SEQ ID NO: 22748 - DNA, 15 bp, Homo sapiens
tgaaaacttgtaaaa

SEQ ID NO: 22749 - DNA, 15 bp, Homo sapiens
atgaaaacttgtaaa

SEQ ID NO: 22750 - DNA, 15 bp, Homo sapiens
aatgaaaacttgtaa

SEQ ID NO: 22751 - DNA, 15 bp, Homo sapiens
aaatgaaaacttgta

SEQ ID NO: 22752 - DNA, 15 bp, Homo sapiens
caaatgaaaacttgt

SEQ ID NO: 22753 - DNA, 15 bp, Homo sapiens
gcaaatgaaaacttg

SEQ ID NO: 22754 - DNA, 15 bp, Homo sapiens
tgcaaatgaaaactt

SEQ ID NO: 22755 - DNA, 15 bp, Homo sapiens
ttgcaaatgaaaact

SEQ ID NO: 22756 - DNA, 15 bp, Homo sapiens
attgcaaatgaaaac

SEQ ID NO: 22757 - DNA, 15 bp, Homo sapiens
cattgcaaatgaaaa

SEQ ID NO: 22758 - DNA, 15 bp, Homo sapiens
tcattgcaaatgaaa

SEQ ID NO: 22759 - DNA, 15 bp, Homo sapiens
ttcattgcaaatgaa

SEQ ID NO: 22760 - DNA, 15 bp, Homo sapiens
tttcattgcaaatga

SEQ ID NO: 22761 - DNA, 15 bp, Homo sapiens
ttttcattgcaaatg

SEQ ID NO: 22762 - DNA, 15 bp, Homo sapiens
gttttcattgcaaat

SEQ ID NO: 22763 - DNA, 15 bp, Homo sapiens
tgttttcattgcaaa

SEQ ID NO: 22764 - DNA, 15 bp, Homo sapiens
gtgttttcattgcaa

SEQ ID NO: 22765 - DNA, 15 bp, Homo sapiens
tgtgttttcattgca

SEQ ID NO: 22766 - DNA, 15 bp, Homo sapiens
ttgtgttttcattgc

SEQ ID NO: 22767 - DNA, 15 bp, Homo sapiens
cttgtgttttcattg

SEQ ID NO: 22768 - DNA, 15 bp, Homo sapiens
gcttgtgttttcatt

SEQ ID NO: 22769 - DNA, 15 bp, Homo sapiens
ggcttgtgttttcat

SEQ ID NO: 22770 - DNA, 15 bp, Homo sapiens
aggcttgtgttttca

SEQ ID NO: 22771 - DNA, 15 bp, Homo sapiens
taggcttgtgttttc

SEQ ID NO: 22772 - DNA, 15 bp, Homo sapiens
ttaggcttgtgtttt

SEQ ID NO: 22773 - DNA, 15 bp, Homo sapiens
tttaggcttgtgttt

SEQ ID NO: 22774 - DNA, 15 bp, Homo sapiens
atttaggcttgtgtt

SEQ ID NO: 22775 - DNA, 15 bp, Homo sapiens
gatttaggcttgtgt

SEQ ID NO: 22776 - DNA, 15 bp, Homo sapiens
agatttaggcttgtg

SEQ ID NO: 22777 - DNA, 15 bp, Homo sapiens
aagatttaggcttgt

SEQ ID NO: 22778 - DNA, 15 bp, Homo sapiens
taagatttaggcttg

SEQ ID NO: 22779 - DNA, 15 bp, Homo sapiens
gtaagatttaggctt

SEQ ID NO: 22780 - DNA, 15 bp, Homo sapiens
agtaagatttaggct

SEQ ID NO: 22781 - DNA, 15 bp, Homo sapiens
aagtaagatttaggc

SEQ ID NO: 22782 - DNA, 15 bp, Homo sapiens
aaagtaagatttagg

SEQ ID NO: 22783 - DNA, 15 bp, Homo sapiens
aaaagtaagatttag

SEQ ID NO: 22784 - DNA, 15 bp, Homo sapiens
gaaaagtaagattta

SEQ ID NO: 22785 - DNA, 15 bp, Homo sapiens
ggaaaagtaagattt

SEQ ID NO: 22786 - DNA, 15 bp, Homo sapiens
tggaaaagtaagatt

SEQ ID NO: 22787 - DNA, 15 bp, Homo sapiens
ttggaaaagtaagat

SEQ ID NO: 22788 - DNA, 15 bp, Homo sapiens
tttggaaaagtaaga

SEQ ID NO: 22789 - DNA, 15 bp, Homo sapiens
gtttggaaaagtaag

SEQ ID NO: 22790 - DNA, 15 bp, Homo sapiens
agtttggaaaagtaa

SEQ ID NO: 22791 - DNA, 15 bp, Homo sapiens
cagtttggaaaagta

SEQ ID NO: 22792 - DNA, 15 bp, Homo sapiens
ccagtttggaaaagt

SEQ ID NO: 22793 - DNA, 15 bp, Homo sapiens
cccagtttggaaaag

SEQ ID NO: 22794 - DNA, 15 bp, Homo sapiens
gcccagtttggaaaa

SEQ ID NO: 22795 - DNA, 15 bp, Homo sapiens
agcccagtttggaaa

SEQ ID NO: 22796 - DNA, 15 bp, Homo sapiens
aagcccagtttggaa

SEQ ID NO: 22797 - DNA, 15 bp, Homo sapiens
gaagcccagtttgga

SEQ ID NO: 22798 - DNA, 15 bp, Homo sapiens
agaagcccagtttgg

SEQ ID NO: 22799 - DNA, 15 bp, Homo sapiens
cagaagcccagtttg

SEQ ID NO: 22800 - DNA, 15 bp, Homo sapiens
tcagaagcccagttt

SEQ ID NO: 22801 - DNA, 15 bp, Homo sapiens
ttcagaagcccagtt

SEQ ID NO: 22802 - DNA, 15 bp, Homo sapiens
attcagaagcccagt

SEQ ID NO: 22803 - DNA, 15 bp, Homo sapiens
aattcagaagcccag

SEQ ID NO: 22804 - DNA, 15 bp, Homo sapiens
taattcagaagccca

SEQ ID NO: 22805 - DNA, 15 bp, Homo sapiens
ataattcagaagccc

SEQ ID NO: 22806 - DNA, 15 bp, Homo sapiens
tataattcagaagcc

SEQ ID NO: 22807 - DNA, 15 bp, Homo sapiens
ttataattcagaagc

SEQ ID NO: 22808 - DNA, 15 bp, Homo sapiens
attataattcagaag

SEQ ID NO: 22809 - DNA, 15 bp, Homo sapiens
aattataattcagaa

SEQ ID NO: 22810 - DNA, 15 bp, Homo sapiens
aaattataattcaga

SEQ ID NO: 22811 - DNA, 15 bp, Homo sapiens
caaattataattcag

SEQ ID NO: 22812 - DNA, 15 bp, Homo sapiens
acaaattataattca

SEQ ID NO: 22813 - DNA, 15 bp, Homo sapiens
cacaaattataattc

SEQ ID NO: 22814 - DNA, 15 bp, Homo sapiens
tcacaaattataatt

SEQ ID NO: 22815 - DNA, 15 bp, Homo sapiens
ttcacaaattataat

SEQ ID NO: 22816 - DNA, 15 bp, Homo sapiens
attcacaaattataa

SEQ ID NO: 22817 - DNA, 15 bp, Homo sapiens
cattcacaaattata

SEQ ID NO: 22818 - DNA, 15 bp, Homo sapiens
gcattcacaaattat

SEQ ID NO: 22819 - DNA, 15 bp, Homo sapiens
tgcattcacaaatta

SEQ ID NO: 22820 - DNA, 15 bp, Homo sapiens
ttgcattcacaaatt

SEQ ID NO: 22821 - DNA, 15 bp, Homo sapiens
tttgcattcacaaat

SEQ ID NO: 22822 - DNA, 15 bp, Homo sapiens
atttgcattcacaaa

SEQ ID NO: 22823 - DNA, 15 bp, Homo sapiens
gatttgcattcacaa

SEQ ID NO: 22824 - DNA, 15 bp, Homo sapiens
tgatttgcattcaca

SEQ ID NO: 22825 - DNA, 15 bp, Homo sapiens
ttgatttgcattcac

SEQ ID NO: 22826 - DNA, 15 bp, Homo sapiens
cttgatttgcattca

SEQ ID NO: 22827 - DNA, 15 bp, Homo sapiens
gcttgatttgcattc

SEQ ID NO: 22828 - DNA, 15 bp, Homo sapiens
tgcttgatttgcatt

SEQ ID NO: 22829 - DNA, 15 bp, Homo sapiens
ctgcttgatttgcat

SEQ ID NO: 22830 - DNA, 15 bp, Homo sapiens
actgcttgatttgca

SEQ ID NO: 22831 - DNA, 15 bp, Homo sapiens
cactgcttgatttgc

SEQ ID NO: 22832 - DNA, 15 bp, Homo sapiens
ccactgcttgatttg

SEQ ID NO: 22833 - DNA, 15 bp, Homo sapiens
tccactgcttgattt

SEQ ID NO: 22834 - DNA, 15 bp, Homo sapiens
ttccactgcttgatt

SEQ ID NO: 22835 - DNA, 15 bp, Homo sapiens
tttccactgcttgat

SEQ ID NO: 22836 - DNA, 15 bp, Homo sapiens
ttttccactgcttga

SEQ ID NO: 22837 - DNA, 15 bp, Homo sapiens
tttttccactgcttg

SEQ ID NO: 22838 - DNA, 15 bp, Homo sapiens
atttttccactgctt

SEQ ID NO: 22839 - DNA, 15 bp, Homo sapiens
aatttttccactgct

SEQ ID NO: 22840 - DNA, 15 bp, Homo sapiens
taatttttccactgc

SEQ ID NO: 22841 - DNA, 15 bp, Homo sapiens
ataatttttccactg

SEQ ID NO: 22842 - DNA, 15 bp, Homo sapiens
gataatttttccact

SEQ ID NO: 22843 - DNA, 15 bp, Homo sapiens
agataatttttccac

SEQ ID NO: 22844 - DNA, 15 bp, Homo sapiens
aagataatttttcca

SEQ ID NO: 22845 - DNA, 15 bp, Homo sapiens
aaagataatttttcc

SEQ ID NO: 22846 - DNA, 15 bp, Homo sapiens
taaagataatttttc

SEQ ID NO: 22847 - DNA, 15 bp, Homo sapiens
ttaaagataattttt

SEQ ID NO: 22848 - DNA, 15 bp, Homo sapiens
cttaaagataatttt

SEQ ID NO: 22849 - DNA, 15 bp, Homo sapiens
tcttaaagataattt

SEQ ID NO: 22850 - DNA, 15 bp, Homo sapiens
ttcttaaagataatt

SEQ ID NO: 22851 - DNA, 15 bp, Homo sapiens
tttcttaaagataat

SEQ ID NO: 22852 - DNA, 15 bp, Homo sapiens
ttttcttaaagataa

SEQ ID NO: 22853 - DNA, 15 bp, Homo sapiens
attttcttaaagata

SEQ ID NO: 22854 - DNA, 15 bp, Homo sapiens
tattttcttaaagat

SEQ ID NO: 22855 - DNA, 15 bp, Homo sapiens
ctattttcttaaaga

SEQ ID NO: 22856 - DNA, 15 bp, Homo sapiens
gctattttcttaaag

SEQ ID NO: 22857 - DNA, 15 bp, Homo sapiens
agctattttcttaaa

SEQ ID NO: 22858 - DNA, 15 bp, Homo sapiens
aagctattttcttaa

SEQ ID NO: 22859 - DNA, 15 bp, Homo sapiens
taagctattttctta

SEQ ID NO: 22860 - DNA, 15 bp, Homo sapiens
ataagctattttctt

SEQ ID NO: 22861 - DNA, 15 bp, Homo sapiens
cataagctattttct

SEQ ID NO: 22862 - DNA, 15 bp, Homo sapiens
acataagctattttc

SEQ ID NO: 22863 - DNA, 15 bp, Homo sapiens
gacataagctatttt

SEQ ID NO: 22864 - DNA, 15 bp, Homo sapiens
cgacataagctattt

SEQ ID NO: 22865 - DNA, 15 bp, Homo sapiens
gcgacataagctatt

SEQ ID NO: 22866 - DNA, 15 bp, Homo sapiens
agcgacataagctat

SEQ ID NO: 22867 - DNA, 15 bp, Homo sapiens
aagcgacataagcta

SEQ ID NO: 22868 - DNA, 15 bp, Homo sapiens
aaagcgacataagct

SEQ ID NO: 22869 - DNA, 15 bp, Homo sapiens
taaagcgacataagc

SEQ ID NO: 22870 - DNA, 15 bp, Homo sapiens
ttaaagcgacataag

SEQ ID NO: 22871 - DNA, 15 bp, Homo sapiens
tttaaagcgacataa

SEQ ID NO: 22872 - DNA, 15 bp, Homo sapiens
ttttaaagcgacata

SEQ ID NO: 22873 - DNA, 15 bp, Homo sapiens
tttttaaagcgacat

SEQ ID NO: 22874 - DNA, 15 bp, Homo sapiens
ttttttaaagcgaca

SEQ ID NO: 22875 - DNA, 15 bp, Homo sapiens
attttttaaagcgac

SEQ ID NO: 22876 - DNA, 15 bp, Homo sapiens
tattttttaaagcga

SEQ ID NO: 22877 - DNA, 15 bp, Homo sapiens
ttattttttaaagcg

SEQ ID NO: 22878 - DNA, 15 bp, Homo sapiens
tttattttttaaagc

SEQ ID NO: 22879 - DNA, 15 bp, Homo sapiens
ttttattttttaaag

SEQ ID NO: 22880 - DNA, 15 bp, Homo sapiens
attttattttttaaa

SEQ ID NO: 22881 - DNA, 15 bp, Homo sapiens
aattttattttttaa

SEQ ID NO: 22882 - DNA, 15 bp, Homo sapiens
taattttatttttta

SEQ ID NO: 22883 - DNA, 15 bp, Homo sapiens
ttaattttatttttt

SEQ ID NO: 22884 - DNA, 15 bp, Homo sapiens
attaattttattttt

SEQ ID NO: 22885 - DNA, 15 bp, Homo sapiens
gattaattttatttt

SEQ ID NO: 22886 - DNA, 15 bp, Homo sapiens
ggattaattttattt

SEQ ID NO: 22887 - DNA, 15 bp, Homo sapiens
aggattaattttatt

SEQ ID NO: 22888 - DNA, 15 bp, Homo sapiens
aaggattaattttat

SEQ ID NO: 22889 - DNA, 15 bp, Homo sapiens
aaaggattaatttta

SEQ ID NO: 22890 - DNA, 15 bp, Homo sapiens
gaaaggattaatttt

SEQ ID NO: 22891 - DNA, 15 bp, Homo sapiens
ggaaaggattaattt

SEQ ID NO: 22892 - DNA, 15 bp, Homo sapiens
aggaaaggattaatt

SEQ ID NO: 22893 - DNA, 15 bp, Homo sapiens
taggaaaggattaat

SEQ ID NO: 22894 - DNA, 15 bp, Homo sapiens
ttaggaaaggattaa

SEQ ID NO: 22895 - DNA, 15 bp, Homo sapiens
cttaggaaaggatta

SEQ ID NO: 22896 - DNA, 15 bp, Homo sapiens
gcttaggaaaggatt

SEQ ID NO: 22897 - DNA, 15 bp, Homo sapiens
tgcttaggaaaggat

SEQ ID NO: 22898 - DNA, 15 bp, Homo sapiens
atgcttaggaaagga

SEQ ID NO: 22899 - DNA, 15 bp, Homo sapiens
catgcttaggaaagg

SEQ ID NO: 22900 - DNA, 15 bp, Homo sapiens
gcatgcttaggaaag

SEQ ID NO: 22901 - DNA, 15 bp, Homo sapiens
agcatgcttaggaaa

SEQ ID NO: 22902 - DNA, 15 bp, Homo sapiens
aagcatgcttaggaa

SEQ ID NO: 22903 - DNA, 15 bp, Homo sapiens
gaagcatgcttagga

SEQ ID NO: 22904 - DNA, 15 bp, Homo sapiens
ggaagcatgcttagg

SEQ ID NO: 22905 - DNA, 15 bp, Homo sapiens
tggaagcatgcttag

SEQ ID NO: 22906 - DNA, 15 bp, Homo sapiens
atggaagcatgctta

SEQ ID NO: 22907 - DNA, 15 bp, Homo sapiens
gatggaagcatgctt

SEQ ID NO: 22908 - DNA, 15 bp, Homo sapiens
agatggaagcatgct

SEQ ID NO: 22909 - DNA, 15 bp, Homo sapiens
cagatggaagcatgc

SEQ ID NO: 22910 - DNA, 15 bp, Homo sapiens
acagatggaagcatg

SEQ ID NO: 22911 - DNA, 15 bp, Homo sapiens
tacagatggaagcat

SEQ ID NO: 22912 - DNA, 15 bp, Homo sapiens
atacagatggaagca

SEQ ID NO: 22913 - DNA, 15 bp, Homo sapiens
aatacagatggaagc

SEQ ID NO: 22914 - DNA, 15 bp, Homo sapiens
caatacagatggaag

SEQ ID NO: 22915 - DNA, 15 bp, Homo sapiens
acaatacagatggaa

SEQ ID NO: 22916 - DNA, 15 bp, Homo sapiens
gacaatacagatgga

SEQ ID NO: 22917 - DNA, 15 bp, Homo sapiens
agacaatacagatgg

SEQ ID NO: 22918 - DNA, 15 bp, Homo sapiens
tagacaatacagatg

SEQ ID NO: 22919 - DNA, 15 bp, Homo sapiens
ctagacaatacagat

SEQ ID NO: 22920 - DNA, 15 bp, Homo sapiens
cctagacaatacaga

SEQ ID NO: 22921 - DNA, 15 bp, Homo sapiens
ccctagacaatacag

SEQ ID NO: 22922 - DNA, 15 bp, Homo sapiens
tccctagacaataca

SEQ ID NO: 22923 - DNA, 15 bp, Homo sapiens
ttccctagacaatac

SEQ ID NO: 22924 - DNA, 15 bp, Homo sapiens
gttccctagacaata

SEQ ID NO: 22925 - DNA, 15 bp, Homo sapiens
tgttccctagacaat

SEQ ID NO: 22926 - DNA, 15 bp, Homo sapiens
atgttccctagacaa

SEQ ID NO: 22927 - DNA, 15 bp, Homo sapiens
gatgttccctagaca

SEQ ID NO: 22928 - DNA, 15 bp, Homo sapiens
tgatgttccctagac

SEQ ID NO: 22929 - DNA, 15 bp, Homo sapiens
ttgatgttccctaga

SEQ ID NO: 22930 - DNA, 15 bp, Homo sapiens
attgatgttccctag

SEQ ID NO: 22931 - DNA, 15 bp, Homo sapiens
aattgatgttcccta

SEQ ID NO: 22932 - DNA, 15 bp, Homo sapiens
gaattgatgttccct

SEQ ID NO: 22933 - DNA, 15 bp, Homo sapiens
tgaattgatgttccc

SEQ ID NO: 22934 - DNA, 15 bp, Homo sapiens
atgaattgatgttcc

SEQ ID NO: 22935 - DNA, 15 bp, Homo sapiens
aatgaattgatgttc

SEQ ID NO: 22936 - DNA, 15 bp, Homo sapiens
gaatgaattgatgtt

SEQ ID NO: 22937 - DNA, 15 bp, Homo sapiens
tgaatgaattgatgt

SEQ ID NO: 22938 - DNA, 15 bp, Homo sapiens
ctgaatgaattgatg

SEQ ID NO: 22939 - DNA, 15 bp, Homo sapiens
gctgaatgaattgat

SEQ ID NO: 22940 - DNA, 15 bp, Homo sapiens
agctgaatgaattga

SEQ ID NO: 22941 - DNA, 15 bp, Homo sapiens
gagctgaatgaattg

SEQ ID NO: 22942 - DNA, 15 bp, Homo sapiens
agagctgaatgaatt

SEQ ID NO: 22943 - DNA, 15 bp, Homo sapiens
cagagctgaatgaat

SEQ ID NO: 22944 - DNA, 15 bp, Homo sapiens
gcagagctgaatgaa

SEQ ID NO: 22945 - DNA, 15 bp, Homo sapiens
cgcagagctgaatga

SEQ ID NO: 22946 - DNA, 15 bp, Homo sapiens
ccgcagagctgaatg

SEQ ID NO: 22947 - DNA, 15 bp, Homo sapiens
cccgcagagctgaat

SEQ ID NO: 22948 - DNA, 15 bp, Homo sapiens
gcccgcagagctgaa

SEQ ID NO: 22949 - DNA, 15 bp, Homo sapiens
agcccgcagagctga

SEQ ID NO: 22950 - DNA, 15 bp, Homo sapiens
gagcccgcagagctg

SEQ ID NO: 22951 - DNA, 15 bp, Homo sapiens
ggagcccgcagagct

SEQ ID NO: 22952 - DNA, 15 bp, Homo sapiens
aggagcccgcagagc

SEQ ID NO: 22953 - DNA, 15 bp, Homo sapiens
aaggagcccgcagag

SEQ ID NO: 22954 - DNA, 15 bp, Homo sapiens
taaggagcccgcaga

SEQ ID NO: 22955 - DNA, 15 bp, Homo sapiens
gtaaggagcccgcag

SEQ ID NO: 22956 - DNA, 15 bp, Homo sapiens
agtaaggagcccgca

SEQ ID NO: 22957 - DNA, 15 bp, Homo sapiens
cagtaaggagcccgc

SEQ ID NO: 22958 - DNA, 15 bp, Homo sapiens
acagtaaggagcccg

SEQ ID NO: 22959 - DNA, 15 bp, Homo sapiens
tacagtaaggagccc

SEQ ID NO: 22960 - DNA, 15 bp, Homo sapiens
atacagtaaggagcc

SEQ ID NO: 22961 - DNA, 15 bp, Homo sapiens
tatacagtaaggagc

SEQ ID NO: 22962 - DNA, 15 bp, Homo sapiens
gtatacagtaaggag

SEQ ID NO: 22963 - DNA, 15 bp, Homo sapiens
tgtatacagtaagga

SEQ ID NO: 22964 - DNA, 15 bp, Homo sapiens
atgtatacagtaagg

SEQ ID NO: 22965 - DNA, 15 bp, Homo sapiens
tatgtatacagtaag

SEQ ID NO: 22966 - DNA, 15 bp, Homo sapiens
atatgtatacagtaa

SEQ ID NO: 22967 - DNA, 15 bp, Homo sapiens
tatatgtatacagta

SEQ ID NO: 22968 - DNA, 15 bp, Homo sapiens
ctatatgtatacagt

SEQ ID NO: 22969 - DNA, 15 bp, Homo sapiens
actatatgtatacag

SEQ ID NO: 22970 - DNA, 15 bp, Homo sapiens
aactatatgtataca

SEQ ID NO: 22971 - DNA, 15 bp, Homo sapiens
taactatatgtatac

SEQ ID NO: 22972 - DNA, 15 bp, Homo sapiens
ataactatatgtata

SEQ ID NO: 22973 - DNA, 15 bp, Homo sapiens
cataactatatgtat

SEQ ID NO: 22974 - DNA, 15 bp, Homo sapiens
gcataactatatgta

SEQ ID NO: 22975 - DNA, 15 bp, Homo sapiens
tgcataactatatgt

SEQ ID NO: 22976 - DNA, 15 bp, Homo sapiens
ctgcataactatatg

SEQ ID NO: 22977 - DNA, 15 bp, Homo sapiens
gctgcataactatat

SEQ ID NO: 22978 - DNA, 15 bp, Homo sapiens
agctgcataactata

SEQ ID NO: 22979 - DNA, 15 bp, Homo sapiens
aagctgcataactat

SEQ ID NO: 22980 - DNA, 15 bp, Homo sapiens
gaagctgcataacta

SEQ ID NO: 22981 - DNA, 15 bp, Homo sapiens
tgaagctgcataact

SEQ ID NO: 22982 - DNA, 15 bp, Homo sapiens
atgaagctgcataac

SEQ ID NO: 22983 - DNA, 15 bp, Homo sapiens
tatgaagctgcataa

SEQ ID NO: 22984 - DNA, 15 bp, Homo sapiens
ctatgaagctgcata

SEQ ID NO: 22985 - DNA, 15 bp, Homo sapiens
tctatgaagctgcat

SEQ ID NO: 22986 - DNA, 15 bp, Homo sapiens
ttctatgaagctgca

SEQ ID NO: 22987 - DNA, 15 bp, Homo sapiens
gttctatgaagctgc

SEQ ID NO: 22988 - DNA, 15 bp, Homo sapiens
tgttctatgaagctg

SEQ ID NO: 22989 - DNA, 15 bp, Homo sapiens
atgttctatgaagct

SEQ ID NO: 22990 - DNA, 15 bp, Homo sapiens
catgttctatgaagc

SEQ ID NO: 22991 - DNA, 15 bp, Homo sapiens
tcatgttctatgaag

SEQ ID NO: 22992 - DNA, 15 bp, Homo sapiens
ctcatgttctatgaa

SEQ ID NO: 22993 - DNA, 15 bp, Homo sapiens
gctcatgttctatga

SEQ ID NO: 22994 - DNA, 15 bp, Homo sapiens
agctcatgttctatg

SEQ ID NO: 22995 - DNA, 15 bp, Homo sapiens
tagctcatgttctat

SEQ ID NO: 22996 - DNA, 15 bp, Homo sapiens
atagctcatgttcta

SEQ ID NO: 22997 - DNA, 15 bp, Homo sapiens
aatagctcatgttct

SEQ ID NO: 22998 - DNA, 15 bp, Homo sapiens
caatagctcatgttc

SEQ ID NO: 22999 - DNA, 15 bp, Homo sapiens
gcaatagctcatgtt

SEQ ID NO: 23000 - DNA, 15 bp, Homo sapiens
ggcaatagctcatgt

SEQ ID NO: 23001 - DNA, 15 bp, Homo sapiens
tggcaatagctcatg

SEQ ID NO: 23002 - DNA, 15 bp, Homo sapiens
gtggcaatagctcat

SEQ ID NO: 23003 - DNA, 15 bp, Homo sapiens
tgtggcaatagctca

SEQ ID NO: 23004 - DNA, 15 bp, Homo sapiens
ttgtggcaatagctc

SEQ ID NO: 23005 - DNA, 15 bp, Homo sapiens
attgtggcaatagct

SEQ ID NO: 23006 - DNA, 15 bp, Homo sapiens
tattgtggcaatagc

SEQ ID NO: 23007 - DNA, 15 bp, Homo sapiens
ttattgtggcaatag

SEQ ID NO: 23008 - DNA, 15 bp, Homo sapiens
tttattgtggcaata

SEQ ID NO: 23009 - DNA, 15 bp, Homo sapiens
ttttattgtggcaat

SEQ ID NO: 23010 - DNA, 15 bp, Homo sapiens
tttttattgtggcaa

SEQ ID NO: 23011 - DNA, 15 bp, Homo sapiens
atttttattgtggca

SEQ ID NO: 23012 - DNA, 15 bp, Homo sapiens
tatttttattgtggc

SEQ ID NO: 23013 - DNA, 15 bp, Homo sapiens
ttatttttattgtgg

SEQ ID NO: 23014 - DNA, 15 bp, Homo sapiens
cttatttttattgtg

SEQ ID NO: 23015 - DNA, 15 bp, Homo sapiens
acttatttttattgt

SEQ ID NO: 23016 - DNA, 15 bp, Homo sapiens
cacttatttttattg

SEQ ID NO: 23017 - DNA, 15 bp, Homo sapiens
ccacttatttttatt

SEQ ID NO: 23018 - DNA, 15 bp, Homo sapiens
cccacttatttttat

SEQ ID NO: 23019 - DNA, 15 bp, Homo sapiens
tcccacttattttta

SEQ ID NO: 23020 - DNA, 15 bp, Homo sapiens
ttcccacttattttt

SEQ ID NO: 23021 - DNA, 15 bp, Homo sapiens
cttcccacttatttt

SEQ ID NO: 23022 - DNA, 15 bp, Homo sapiens
ccttcccacttattt

SEQ ID NO: 23023 - DNA, 15 bp, Homo sapiens
tccttcccacttatt

SEQ ID NO: 23024 - DNA, 15 bp, Homo sapiens
ctccttcccacttat

SEQ ID NO: 23025 - DNA, 15 bp, Homo sapiens
gctccttcccactta

SEQ ID NO: 23026 - DNA, 15 bp, Homo sapiens
tgctccttcccactt

SEQ ID NO: 23027 - DNA, 15 bp, Homo sapiens
ctgctccttcccact

SEQ ID NO: 23028 - DNA, 15 bp, Homo sapiens
tctgctccttcccac

SEQ ID NO: 23029 - DNA, 15 bp, Homo sapiens
ctctgctccttccca

SEQ ID NO: 23030 - DNA, 15 bp, Homo sapiens
tctctgctccttccc

SEQ ID NO: 23031 - DNA, 15 bp, Homo sapiens
ttctctgctccttcc

SEQ ID NO: 23032 - DNA, 15 bp, Homo sapiens
cttctctgctccttc

SEQ ID NO: 23033 - DNA, 15 bp, Homo sapiens
gcttctctgctcctt

SEQ ID NO: 23034 - DNA, 15 bp, Homo sapiens
tgcttctctgctcct

SEQ ID NO: 23035 - DNA, 15 bp, Homo sapiens
ctgcttctctgctcc

SEQ ID NO: 23036 - DNA, 15 bp, Homo sapiens
actgcttctctgctc

SEQ ID NO: 23037 - DNA, 15 bp, Homo sapiens
aactgcttctctgct

SEQ ID NO: 23038 - DNA, 15 bp, Homo sapiens
aaactgcttctctgc

SEQ ID NO: 23039 - DNA, 15 bp, Homo sapiens
caaactgcttctctg

SEQ ID NO: 23040 - DNA, 15 bp, Homo sapiens
acaaactgcttctct

SEQ ID NO: 23041 - DNA, 15 bp, Homo sapiens
gacaaactgcttctc

SEQ ID NO: 23042 - DNA, 15 bp, Homo sapiens
agacaaactgcttct

SEQ ID NO: 23043 - DNA, 15 bp, Homo sapiens
aagacaaactgcttc

SEQ ID NO: 23044 - DNA, 15 bp, Homo sapiens
taagacaaactgctt

SEQ ID NO: 23045 - DNA, 15 bp, Homo sapiens
ataagacaaactgct

SEQ ID NO: 23046 - DNA, 15 bp, Homo sapiens
aataagacaaactgc

SEQ ID NO: 23047 - DNA, 15 bp, Homo sapiens
aaataagacaaactg

SEQ ID NO: 23048 - DNA, 15 bp, Homo sapiens
aaaataagacaaact

SEQ ID NO: 23049 - DNA, 15 bp, Homo sapiens
taaaataagacaaac

SEQ ID NO: 23050 - DNA, 15 bp, Homo sapiens
gtaaaataagacaaa

SEQ ID NO: 23051 - DNA, 15 bp, Homo sapiens
agtaaaataagacaa

SEQ ID NO: 23052 - DNA, 15 bp, Homo sapiens
gagtaaaataagaca

SEQ ID NO: 23053 - DNA, 15 bp, Homo sapiens
cgagtaaaataagac

SEQ ID NO: 23054 - DNA, 15 bp, Homo sapiens
ccgagtaaaataaga

SEQ ID NO: 23055 - DNA, 15 bp, Homo sapiens
cccgagtaaaataag

SEQ ID NO: 23056 - DNA, 15 bp, Homo sapiens
tcccgagtaaaataa

SEQ ID NO: 23057 - DNA, 15 bp, Homo sapiens
ttcccgagtaaaata

SEQ ID NO: 23058 - DNA, 15 bp, Homo sapiens
tttcccgagtaaaat

SEQ ID NO: 23059 - DNA, 15 bp, Homo sapiens
atttcccgagtaaaa

SEQ ID NO: 23060 - DNA, 15 bp, Homo sapiens
catttcccgagtaaa

SEQ ID NO: 23061 - DNA, 15 bp, Homo sapiens
acatttcccgagtaa

SEQ ID NO: 23062 - DNA, 15 bp, Homo sapiens
aacatttcccgagta

SEQ ID NO: 23063 - DNA, 15 bp, Homo sapiens
aaacatttcccgagt

SEQ ID NO: 23064 - DNA, 15 bp, Homo sapiens
taaacatttcccgag

SEQ ID NO: 23065 - DNA, 15 bp, Homo sapiens
ataaacatttcccga

SEQ ID NO: 23066 - DNA, 15 bp, Homo sapiens
cataaacatttcccg

SEQ ID NO: 23067 - DNA, 15 bp, Homo sapiens
gcataaacatttccc

SEQ ID NO: 23068 - DNA, 15 bp, Homo sapiens
tgcataaacatttcc

SEQ ID NO: 23069 - DNA, 15 bp, Homo sapiens
ttgcataaacatttc

SEQ ID NO: 23070 - DNA, 15 bp, Homo sapiens
gttgcataaacattt

SEQ ID NO: 23071 - DNA, 15 bp, Homo sapiens
agttgcataaacatt

SEQ ID NO: 23072 - DNA, 15 bp, Homo sapiens
gagttgcataaacat

SEQ ID NO: 23073 - DNA, 15 bp, Homo sapiens
agagttgcataaaca

SEQ ID NO: 23074 - DNA, 15 bp, Homo sapiens
cagagttgcataaac

SEQ ID NO: 23075 - DNA, 15 bp, Homo sapiens
tcagagttgcataaa

SEQ ID NO: 23076 - DNA, 15 bp, Homo sapiens
ttcagagttgcataa

SEQ ID NO: 23077 - DNA, 15 bp, Homo sapiens
tttcagagttgcata

SEQ ID NO: 23078 - DNA, 15 bp, Homo sapiens
atttcagagttgcat

SEQ ID NO: 23079 - DNA, 15 bp, Homo sapiens
catttcagagttgca

SEQ ID NO: 23080 - DNA, 15 bp, Homo sapiens
acatttcagagttgc

SEQ ID NO: 23081 - DNA, 15 bp, Homo sapiens
cacatttcagagttg

SEQ ID NO: 23082 - DNA, 15 bp, Homo sapiens
tcacatttcagagtt

SEQ ID NO: 23083 - DNA, 15 bp, Homo sapiens
ctcacatttcagagt

SEQ ID NO: 23084 - DNA, 15 bp, Homo sapiens
actcacatttcagag

SEQ ID NO: 23085 - DNA, 15 bp, Homo sapiens
aactcacatttcaga

SEQ ID NO: 23086 - DNA, 15 bp, Homo sapiens
aaactcacatttcag

SEQ ID NO: 23087 - DNA, 15 bp, Homo sapiens
taaactcacatttca

SEQ ID NO: 23088 - DNA, 15 bp, Homo sapiens
ataaactcacatttc

SEQ ID NO: 23089 - DNA, 15 bp, Homo sapiens
aataaactcacattt

SEQ ID NO: 23090 - DNA, 15 bp, Homo sapiens
gaataaactcacatt

SEQ ID NO: 23091 - DNA, 15 bp, Homo sapiens
agaataaactcacat

SEQ ID NO: 23092 - DNA, 15 bp, Homo sapiens
aagaataaactcaca

SEQ ID NO: 23093 - DNA, 15 bp, Homo sapiens
gaagaataaactcac

SEQ ID NO: 23094 - DNA, 15 bp, Homo sapiens
ggaagaataaactca

SEQ ID NO: 23095 - DNA, 15 bp, Homo sapiens
gggaagaataaactc

SEQ ID NO: 23096 - DNA, 15 bp, Homo sapiens
tgggaagaataaact

SEQ ID NO: 23097 - DNA, 15 bp, Homo sapiens
ttgggaagaataaac

SEQ ID NO: 23098 - DNA, 15 bp, Homo sapiens
cttgggaagaataaa

SEQ ID NO: 23099 - DNA, 15 bp, Homo sapiens
gcttgggaagaataa

SEQ ID NO: 23100 - DNA, 15 bp, Homo sapiens
agcttgggaagaata

SEQ ID NO: 23101 - DNA, 15 bp, Homo sapiens
aagcttgggaagaat

SEQ ID NO: 23102 - DNA, 15 bp, Homo sapiens
aaagcttgggaagaa

SEQ ID NO: 23103 - DNA, 15 bp, Homo sapiens
aaaagcttgggaaga

SEQ ID NO: 23104 - DNA, 15 bp, Homo sapiens
caaaagcttgggaag

SEQ ID NO: 23105 - DNA, 15 bp, Homo sapiens
acaaaagcttgggaa

SEQ ID NO: 23106 - DNA, 15 bp, Homo sapiens
cacaaaagcttggga

SEQ ID NO: 23107 - DNA, 15 bp, Homo sapiens
gcacaaaagcttggg

SEQ ID NO: 23108 - DNA, 15 bp, Homo sapiens
agcacaaaagcttgg

SEQ ID NO: 23109 - DNA, 15 bp, Homo sapiens
aagcacaaaagcttg

SEQ ID NO: 23110 - DNA, 15 bp, Homo sapiens
taagcacaaaagctt

SEQ ID NO: 23111 - DNA, 15 bp, Homo sapiens
ctaagcacaaaagct

SEQ ID NO: 23112 - DNA, 15 bp, Homo sapiens
gctaagcacaaaagc

SEQ ID NO: 23113 - DNA, 15 bp, Homo sapiens
agctaagcacaaaag

SEQ ID NO: 23114 - DNA, 15 bp, Homo sapiens
gagctaagcacaaaa

SEQ ID NO: 23115 - DNA, 15 bp, Homo sapiens
agagctaagcacaaa

SEQ ID NO: 23116 - DNA, 15 bp, Homo sapiens
tagagctaagcacaa

SEQ ID NO: 23117 - DNA, 15 bp, Homo sapiens
ttagagctaagcaca

SEQ ID NO: 23118 - DNA, 15 bp, Homo sapiens
cttagagctaagcac

SEQ ID NO: 23119 - DNA, 15 bp, Homo sapiens
ccttagagctaagca

SEQ ID NO: 23120 - DNA, 15 bp, Homo sapiens
gccttagagctaagc

SEQ ID NO: 23121 - DNA, 15 bp, Homo sapiens
tgccttagagctaag

SEQ ID NO: 23122 - DNA, 15 bp, Homo sapiens
ctgccttagagctaa

SEQ ID NO: 23123 - DNA, 15 bp, Homo sapiens
cctgccttagagcta

SEQ ID NO: 23124 - DNA, 15 bp, Homo sapiens
tcctgccttagagct

SEQ ID NO: 23125 - DNA, 15 bp, Homo sapiens
gtcctgccttagagc

SEQ ID NO: 23126 - DNA, 15 bp, Homo sapiens
agtcctgccttagag

SEQ ID NO: 23127 - DNA, 15 bp, Homo sapiens
tagtcctgccttaga

SEQ ID NO: 23128 - DNA, 15 bp, Homo sapiens
gtagtcctgccttag

SEQ ID NO: 23129 - DNA, 15 bp, Homo sapiens
ggtagtcctgcctta

SEQ ID NO: 23130 - DNA, 15 bp, Homo sapiens
aggtagtcctgcctt

SEQ ID NO: 23131 - DNA, 15 bp, Homo sapiens
taggtagtcctgcct

SEQ ID NO: 23132 - DNA, 15 bp, Homo sapiens
ttaggtagtcctgcc

SEQ ID NO: 23133 - DNA, 15 bp, Homo sapiens
attaggtagtcctgc

SEQ ID NO: 23134 - DNA, 15 bp, Homo sapiens
tattaggtagtcctg

SEQ ID NO: 23135 - DNA, 15 bp, Homo sapiens
gtattaggtagtcct

SEQ ID NO: 23136 - DNA, 15 bp, Homo sapiens
ggtattaggtagtcc

SEQ ID NO: 23137 - DNA, 15 bp, Homo sapiens
tggtattaggtagtc

SEQ ID NO: 23138 - DNA, 15 bp, Homo sapiens
gtggtattaggtagt

SEQ ID NO: 23139 - DNA, 15 bp, Homo sapiens
agtggtattaggtag

SEQ ID NO: 23140 - DNA, 15 bp, Homo sapiens
gagtggtattaggta

SEQ ID NO: 23141 - DNA, 15 bp, Homo sapiens
agagtggtattaggt

SEQ ID NO: 23142 - DNA, 15 bp, Homo sapiens
gagagtggtattagg

SEQ ID NO: 23143 - DNA, 15 bp, Homo sapiens
tgagagtggtattag

SEQ ID NO: 23144 - DNA, 15 bp, Homo sapiens
gtgagagtggtatta

SEQ ID NO: 23145 - DNA, 15 bp, Homo sapiens
tgtgagagtggtatt

SEQ ID NO: 23146 - DNA, 15 bp, Homo sapiens
ctgtgagagtggtat

SEQ ID NO: 23147 - DNA, 15 bp, Homo sapiens
gctgtgagagtggta

SEQ ID NO: 23148 - DNA, 15 bp, Homo sapiens
ggctgtgagagtggt

SEQ ID NO: 23149 - DNA, 15 bp, Homo sapiens
tggctgtgagagtgg

SEQ ID NO: 23150 - DNA, 15 bp, Homo sapiens
ctggctgtgagagtg

SEQ ID NO: 23151 - DNA, 15 bp, Homo sapiens
gctggctgtgagagt

SEQ ID NO: 23152 - DNA, 15 bp, Homo sapiens
ggctggctgtgagag

SEQ ID NO: 23153 - DNA, 15 bp, Homo sapiens
tggctggctgtgaga

SEQ ID NO: 23154 - DNA, 15 bp, Homo sapiens
atggctggctgtgag

SEQ ID NO: 23155 - DNA, 15 bp, Homo sapiens
aatggctggctgtga

SEQ ID NO: 23156 - DNA, 15 bp, Homo sapiens
aaatggctggctgtg

SEQ ID NO: 23157 - DNA, 15 bp, Homo sapiens
caaatggctggctgt

SEQ ID NO: 23158 - DNA, 15 bp, Homo sapiens
tcaaatggctggctg

SEQ ID NO: 23159 - DNA, 15 bp, Homo sapiens
ttcaaatggctggct

SEQ ID NO: 23160 - DNA, 15 bp, Homo sapiens
tttcaaatggctggc

SEQ ID NO: 23161 - DNA, 15 bp, Homo sapiens
atttcaaatggctgg

SEQ ID NO: 23162 - DNA, 15 bp, Homo sapiens
aatttcaaatggctg

SEQ ID NO: 23163 - DNA, 15 bp, Homo sapiens
aaatttcaaatggct

SEQ ID NO: 23164 - DNA, 15 bp, Homo sapiens
caaatttcaaatggc

SEQ ID NO: 23165 - DNA, 15 bp, Homo sapiens
ccaaatttcaaatgg

SEQ ID NO: 23166 - DNA, 15 bp, Homo sapiens
cccaaatttcaaatg

SEQ ID NO: 23167 - DNA, 15 bp, Homo sapiens
tcccaaatttcaaat

SEQ ID NO: 23168 - DNA, 15 bp, Homo sapiens
atcccaaatttcaaa

SEQ ID NO: 23169 - DNA, 15 bp, Homo sapiens
aatcccaaatttcaa

SEQ ID NO: 23170 - DNA, 15 bp, Homo sapiens
gaatcccaaatttca

SEQ ID NO: 23171 - DNA, 15 bp, Homo sapiens
agaatcccaaatttc

SEQ ID NO: 23172 - DNA, 15 bp, Homo sapiens
cagaatcccaaattt

SEQ ID NO: 23173 - DNA, 15 bp, Homo sapiens
tcagaatcccaaatt

SEQ ID NO: 23174 - DNA, 15 bp, Homo sapiens
ctcagaatcccaaat

SEQ ID NO: 23175 - DNA, 15 bp, Homo sapiens
gctcagaatcccaaa

SEQ ID NO: 23176 - DNA, 15 bp, Homo sapiens
tgctcagaatcccaa

SEQ ID NO: 23177 - DNA, 15 bp, Homo sapiens
ttgctcagaatccca

SEQ ID NO: 23178 - DNA, 15 bp, Homo sapiens
attgctcagaatccc

SEQ ID NO: 23179 - DNA, 15 bp, Homo sapiens
gattgctcagaatcc

SEQ ID NO: 23180 - DNA, 15 bp, Homo sapiens
agattgctcagaatc

SEQ ID NO: 23181 - DNA, 15 bp, Homo sapiens
tagattgctcagaat

SEQ ID NO: 23182 - DNA, 15 bp, Homo sapiens
ttagattgctcagaa

SEQ ID NO: 23183 - DNA, 15 bp, Homo sapiens
tttagattgctcaga

SEQ ID NO: 23184 - DNA, 15 bp, Homo sapiens
ctttagattgctcag

SEQ ID NO: 23185 - DNA, 15 bp, Homo sapiens
tctttagattgctca

SEQ ID NO: 23186 - DNA, 15 bp, Homo sapiens
ctctttagattgctc

SEQ ID NO: 23187 - DNA, 15 bp, Homo sapiens
actctttagattgct

SEQ ID NO: 23188 - DNA, 15 bp, Homo sapiens
tactctttagattgc

SEQ ID NO: 23189 - DNA, 15 bp, Homo sapiens
ttactctttagattg

SEQ ID NO: 23190 - DNA, 15 bp, Homo sapiens
gttactctttagatt

SEQ ID NO: 23191 - DNA, 15 bp, Homo sapiens
agttactctttagat

SEQ ID NO: 23192 - DNA, 15 bp, Homo sapiens
aagttactctttaga

SEQ ID NO: 23193 - DNA, 15 bp, Homo sapiens
caagttactctttag

SEQ ID NO: 23194 - DNA, 15 bp, Homo sapiens
acaagttactcttta

SEQ ID NO: 23195 - DNA, 15 bp, Homo sapiens
gacaagttactcttt

SEQ ID NO: 23196 - DNA, 15 bp, Homo sapiens
agacaagttactctt

SEQ ID NO: 23197 - DNA, 15 bp, Homo sapiens
gagacaagttactct

SEQ ID NO: 23198 - DNA, 15 bp, Homo sapiens
agagacaagttactc

SEQ ID NO: 23199 - DNA, 15 bp, Homo sapiens
cagagacaagttact

SEQ ID NO: 23200 - DNA, 15 bp, Homo sapiens
ccagagacaagttac

SEQ ID NO: 23201 - DNA, 15 bp, Homo sapiens
tccagagacaagtta

SEQ ID NO: 23202 - DNA, 15 bp, Homo sapiens
ttccagagacaagtt

SEQ ID NO: 23203 - DNA, 15 bp, Homo sapiens
gttccagagacaagt

SEQ ID NO: 23204 - DNA, 15 bp, Homo sapiens
agttccagagacaag

SEQ ID NO: 23205 - DNA, 15 bp, Homo sapiens
cagttccagagacaa

SEQ ID NO: 23206 - DNA, 15 bp, Homo sapiens
tcagttccagagaca

SEQ ID NO: 23207 - DNA, 15 bp, Homo sapiens
gtcagttccagagac

SEQ ID NO: 23208 - DNA, 15 bp, Homo sapiens
ggtcagttccagaga

SEQ ID NO: 23209 - DNA, 15 bp, Homo sapiens
aggtcagttccagag

SEQ ID NO: 23210 - DNA, 15 bp, Homo sapiens
aaggtcagttccaga

SEQ ID NO: 23211 - DNA, 15 bp, Homo sapiens
aaaggtcagttccag

SEQ ID NO: 23212 - DNA, 15 bp, Homo sapiens
aaaaggtcagttcca

SEQ ID NO: 23213 - DNA, 15 bp, Homo sapiens
caaaaggtcagttcc

SEQ ID NO: 23214 - DNA, 15 bp, Homo sapiens
gcaaaaggtcagttc

SEQ ID NO: 23215 - DNA, 15 bp, Homo sapiens
agcaaaaggtcagtt

SEQ ID NO: 23216 - DNA, 15 bp, Homo sapiens
cagcaaaaggtcagt

SEQ ID NO: 23217 - DNA, 15 bp, Homo sapiens
tcagcaaaaggtcag

SEQ ID NO: 23218 - DNA, 15 bp, Homo sapiens
gtcagcaaaaggtca

SEQ ID NO: 23219 - DNA, 15 bp, Homo sapiens
ggtcagcaaaaggtc

SEQ ID NO: 23220 - DNA, 15 bp, Homo sapiens
cggtcagcaaaaggt

SEQ ID NO: 23221 - DNA, 15 bp, Homo sapiens
ccggtcagcaaaagg

SEQ ID NO: 23222 - DNA, 15 bp, Homo sapiens
cccggtcagcaaaag

SEQ ID NO: 23223 - DNA, 15 bp, Homo sapiens
tcccggtcagcaaaa

SEQ ID NO: 23224 - DNA, 15 bp, Homo sapiens
ctcccggtcagcaaa

SEQ ID NO: 23225 - DNA, 15 bp, Homo sapiens
actcccggtcagcaa

SEQ ID NO: 23226 - DNA, 15 bp, Homo sapiens
gactcccggtcagca

SEQ ID NO: 23227 - DNA, 15 bp, Homo sapiens
ggactcccggtcagc

SEQ ID NO: 23228 - DNA, 15 bp, Homo sapiens
aggactcccggtcag

SEQ ID NO: 23229 - DNA, 15 bp, Homo sapiens
gaggactcccggtca

SEQ ID NO: 23230 - DNA, 15 bp, Homo sapiens
tgaggactcccggtc

SEQ ID NO: 23231 - DNA, 15 bp, Homo sapiens
atgaggactcccggt

SEQ ID NO: 23232 - DNA, 15 bp, Homo sapiens
tatgaggactcccgg

SEQ ID NO: 23233 - DNA, 15 bp, Homo sapiens
ttatgaggactcccg

SEQ ID NO: 23234 - DNA, 15 bp, Homo sapiens
gttatgaggactccc

SEQ ID NO: 23235 - DNA, 15 bp, Homo sapiens
agttatgaggactcc

SEQ ID NO: 23236 - DNA, 15 bp, Homo sapiens
aagttatgaggactc

SEQ ID NO: 23237 - DNA, 15 bp, Homo sapiens
caagttatgaggact

SEQ ID NO: 23238 - DNA, 15 bp, Homo sapiens
ccaagttatgaggac

SEQ ID NO: 23239 - DNA, 15 bp, Homo sapiens
tccaagttatgagga

SEQ ID NO: 23240 - DNA, 15 bp, Homo sapiens
atccaagttatgagg

SEQ ID NO: 23241 - DNA, 15 bp, Homo sapiens
aatccaagttatgag

SEQ ID NO: 23242 - DNA, 15 bp, Homo sapiens
aaatccaagttatga

SEQ ID NO: 23243 - DNA, 15 bp, Homo sapiens
aaaatccaagttatg

SEQ ID NO: 23244 - DNA, 15 bp, Homo sapiens
caaaatccaagttat

SEQ ID NO: 23245 - DNA, 15 bp, Homo sapiens
acaaaatccaagtta

SEQ ID NO: 23246 - DNA, 15 bp, Homo sapiens
cacaaaatccaagtt

SEQ ID NO: 23247 - DNA, 15 bp, Homo sapiens
acacaaaatccaagt

SEQ ID NO: 23248 - DNA, 15 bp, Homo sapiens
cacacaaaatccaag

SEQ ID NO: 23249 - DNA, 15 bp, Homo sapiens
ccacacaaaatccaa

SEQ ID NO: 23250 - DNA, 15 bp, Homo sapiens
cccacacaaaatcca

SEQ ID NO: 23251 - DNA, 15 bp, Homo sapiens
acccacacaaaatcc

SEQ ID NO: 23252 - DNA, 15 bp, Homo sapiens
aacccacacaaaatc

SEQ ID NO: 23253 - DNA, 15 bp, Homo sapiens
caacccacacaaaat

SEQ ID NO: 23254 - DNA, 15 bp, Homo sapiens
acaacccacacaaaa

SEQ ID NO: 23255 - DNA, 15 bp, Homo sapiens
aacaacccacacaaa

SEQ ID NO: 23256 - DNA, 15 bp, Homo sapiens
caacaacccacacaa

SEQ ID NO: 23257 - DNA, 15 bp, Homo sapiens
acaacaacccacaca

SEQ ID NO: 23258 - DNA, 15 bp, Homo sapiens
cacaacaacccacac

SEQ ID NO: 23259 - DNA, 15 bp, Homo sapiens
acacaacaacccaca

SEQ ID NO: 23260 - DNA, 15 bp, Homo sapiens
gacacaacaacccac

SEQ ID NO: 23261 - DNA, 15 bp, Homo sapiens
agacacaacaaccca

SEQ ID NO: 23262 - DNA, 15 bp, Homo sapiens
aagacacaacaaccc

SEQ ID NO: 23263 - DNA, 15 bp, Homo sapiens
aaagacacaacaacc

SEQ ID NO: 23264 - DNA, 15 bp, Homo sapiens
caaagacacaacaac

SEQ ID NO: 23265 - DNA, 15 bp, Homo sapiens
ccaaagacacaacaa

SEQ ID NO: 23266 - DNA, 15 bp, Homo sapiens
accaaagacacaaca

SEQ ID NO: 23267 - DNA, 15 bp, Homo sapiens
caccaaagacacaac

SEQ ID NO: 23268 - DNA, 15 bp, Homo sapiens
gcaccaaagacacaa

SEQ ID NO: 23269 - DNA, 15 bp, Homo sapiens
ggcaccaaagacaca

SEQ ID NO: 23270 - DNA, 15 bp, Homo sapiens
tggcaccaaagacac

SEQ ID NO: 23271 - DNA, 15 bp, Homo sapiens
gtggcaccaaagaca

SEQ ID NO: 23272 - DNA, 15 bp, Homo sapiens
agtggcaccaaagac

SEQ ID NO: 23273 - DNA, 15 bp, Homo sapiens
cagtggcaccaaaga

SEQ ID NO: 23274 - DNA, 15 bp, Homo sapiens
gcagtggcaccaaag

SEQ ID NO: 23275 - DNA, 15 bp, Homo sapiens
agcagtggcaccaaa

SEQ ID NO: 23276 - DNA, 15 bp, Homo sapiens
cagcagtggcaccaa

SEQ ID NO: 23277 - DNA, 15 bp, Homo sapiens
gcagcagtggcacca

SEQ ID NO: 23278 - DNA, 15 bp, Homo sapiens
agcagcagtggcacc

SEQ ID NO: 23279 - DNA, 15 bp, Homo sapiens
gagcagcagtggcac

SEQ ID NO: 23280 - DNA, 15 bp, Homo sapiens
tgagcagcagtggca

SEQ ID NO: 23281 - DNA, 15 bp, Homo sapiens
atgagcagcagtggc

SEQ ID NO: 23282 - DNA, 15 bp, Homo sapiens
aatgagcagcagtgg

SEQ ID NO: 23283 - DNA, 15 bp, Homo sapiens
gaatgagcagcagtg

SEQ ID NO: 23284 - DNA, 15 bp, Homo sapiens
tgaatgagcagcagt

SEQ ID NO: 23285 - DNA, 15 bp, Homo sapiens
atgaatgagcagcag

SEQ ID NO: 23286 - DNA, 15 bp, Homo sapiens
aatgaatgagcagca

SEQ ID NO: 23287 - DNA, 15 bp, Homo sapiens
gaatgaatgagcagc

SEQ ID NO: 23288 - DNA, 15 bp, Homo sapiens
tgaatgaatgagcag

SEQ ID NO: 23289 - DNA, 15 bp, Homo sapiens
ctgaatgaatgagca

SEQ ID NO: 23290 - DNA, 15 bp, Homo sapiens
gctgaatgaatgagc

SEQ ID NO: 23291 - DNA, 15 bp, Homo sapiens
tgctgaatgaatgag

SEQ ID NO: 23292 - DNA, 15 bp, Homo sapiens
gtgctgaatgaatga

SEQ ID NO: 23293 - DNA, 15 bp, Homo sapiens
ggtgctgaatgaatg

SEQ ID NO: 23294 - DNA, 15 bp, Homo sapiens
aggtgctgaatgaat

SEQ ID NO: 23295 - DNA, 15 bp, Homo sapiens
gaggtgctgaatgaa

SEQ ID NO: 23296 - DNA, 15 bp, Homo sapiens
tgaggtgctgaatga

SEQ ID NO: 23297 - DNA, 15 bp, Homo sapiens
ctgaggtgctgaatg

SEQ ID NO: 23298 - DNA, 15 bp, Homo sapiens
actgaggtgctgaat

SEQ ID NO: 23299 - DNA, 15 bp, Homo sapiens
cactgaggtgctgaa

SEQ ID NO: 23300 - DNA, 15 bp, Homo sapiens
tcactgaggtgctga

SEQ ID NO: 23301 - DNA, 15 bp, Homo sapiens
atcactgaggtgctg

SEQ ID NO: 23302 - DNA, 15 bp, Homo sapiens
catcactgaggtgct

SEQ ID NO: 23303 - DNA, 15 bp, Homo sapiens
gcatcactgaggtgc

SEQ ID NO: 23304 - DNA, 15 bp, Homo sapiens
agcatcactgaggtg

SEQ ID NO: 23305 - DNA, 15 bp, Homo sapiens
cagcatcactgaggt

SEQ ID NO: 23306 - DNA, 15 bp, Homo sapiens
acagcatcactgagg

SEQ ID NO: 23307 - DNA, 15 bp, Homo sapiens
aacagcatcactgag

SEQ ID NO: 23308 - DNA, 15 bp, Homo sapiens
aaacagcatcactga

SEQ ID NO: 23309 - DNA, 15 bp, Homo sapiens
aaaacagcatcactg

SEQ ID NO: 23310 - DNA, 15 bp, Homo sapiens
aaaaacagcatcact

SEQ ID NO: 23311 - DNA, 15 bp, Homo sapiens
gaaaaacagcatcac

SEQ ID NO: 23312 - DNA, 15 bp, Homo sapiens
tgaaaaacagcatca

SEQ ID NO: 23313 - DNA, 15 bp, Homo sapiens
atgaaaaacagcatc

SEQ ID NO: 23314 - DNA, 15 bp, Homo sapiens
tatgaaaaacagcat

SEQ ID NO: 23315 - DNA, 15 bp, Homo sapiens
gtatgaaaaacagca

SEQ ID NO: 23316 - DNA, 15 bp, Homo sapiens
agtatgaaaaacagc

SEQ ID NO: 23317 - DNA, 15 bp, Homo sapiens
cagtatgaaaaacag

SEQ ID NO: 23318 - DNA, 15 bp, Homo sapiens
acagtatgaaaaaca

SEQ ID NO: 23319 - DNA, 15 bp, Homo sapiens
aacagtatgaaaaac

SEQ ID NO: 23320 - DNA, 15 bp, Homo sapiens
gaacagtatgaaaaa

SEQ ID NO: 23321 - DNA, 15 bp, Homo sapiens
cgaacagtatgaaaa

SEQ ID NO: 23322 - DNA, 15 bp, Homo sapiens
tcgaacagtatgaaa

SEQ ID NO: 23323 - DNA, 15 bp, Homo sapiens
atcgaacagtatgaa

SEQ ID NO: 23324 - DNA, 15 bp, Homo sapiens
aatcgaacagtatga

SEQ ID NO: 23325 - DNA, 15 bp, Homo sapiens
caatcgaacagtatg

SEQ ID NO: 23326 - DNA, 15 bp, Homo sapiens
ccaatcgaacagtat

SEQ ID NO: 23327 - DNA, 15 bp, Homo sapiens
accaatcgaacagta

SEQ ID NO: 23328 - DNA, 15 bp, Homo sapiens
gaccaatcgaacagt

SEQ ID NO: 23329 - DNA, 15 bp, Homo sapiens
cgaccaatcgaacag

SEQ ID NO: 23330 - DNA, 15 bp, Homo sapiens
ccgaccaatcgaaca

SEQ ID NO: 23331 - DNA, 15 bp, Homo sapiens
cccgaccaatcgaac

SEQ ID NO: 23332 - DNA, 15 bp, Homo sapiens
ccccgaccaatcgaa

SEQ ID NO: 23333 - DNA, 15 bp, Homo sapiens
cccccgaccaatcga

SEQ ID NO: 23334 - DNA, 15 bp, Homo sapiens
acccccgaccaatcg

SEQ ID NO: 23335 - DNA, 15 bp, Homo sapiens
cacccccgaccaatc

SEQ ID NO: 23336 - DNA, 15 bp, Homo sapiens
acacccccgaccaat

SEQ ID NO: 23337 - DNA, 15 bp, Homo sapiens
cacacccccgaccaa

SEQ ID NO: 23338 - DNA, 15 bp, Homo sapiens
tcacacccccgacca

SEQ ID NO: 23339 - DNA, 15 bp, Homo sapiens
atcacacccccgacc

SEQ ID NO: 23340 - DNA, 15 bp, Homo sapiens
catcacacccccgac

SEQ ID NO: 23341 - DNA, 15 bp, Homo sapiens
ccatcacacccccga

SEQ ID NO: 23342 - DNA, 15 bp, Homo sapiens
cccatcacacccccg

SEQ ID NO: 23343 - DNA, 15 bp, Homo sapiens
gcccatcacaccccc

SEQ ID NO: 23344 - DNA, 15 bp, Homo sapiens
cgcccatcacacccc

SEQ ID NO: 23345 - DNA, 15 bp, Homo sapiens
tcgcccatcacaccc

SEQ ID NO: 23346 - DNA, 15 bp, Homo sapiens
ttcgcccatcacacc

SEQ ID NO: 23347 - DNA, 15 bp, Homo sapiens
cttcgcccatcacac

SEQ ID NO: 23348 - DNA, 15 bp, Homo sapiens
gcttcgcccatcaca

SEQ ID NO: 23349 - DNA, 15 bp, Homo sapiens
tgcttcgcccatcac

SEQ ID NO: 23350 - DNA, 15 bp, Homo sapiens
ctgcttcgcccatca

SEQ ID NO: 23351 - DNA, 15 bp, Homo sapiens
actgcttcgcccatc

SEQ ID NO: 23352 - DNA, 15 bp, Homo sapiens
gactgcttcgcccat

SEQ ID NO: 23353 - DNA, 15 bp, Homo sapiens
agactgcttcgccca

SEQ ID NO: 23354 - DNA, 15 bp, Homo sapiens
tagactgcttcgccc

SEQ ID NO: 23355 - DNA, 15 bp, Homo sapiens
ttagactgcttcgcc

SEQ ID NO: 23356 - DNA, 15 bp, Homo sapiens
attagactgcttcgc

SEQ ID NO: 23357 - DNA, 15 bp, Homo sapiens
tattagactgcttcg

SEQ ID NO: 23358 - DNA, 15 bp, Homo sapiens
atattagactgcttc

SEQ ID NO: 23359 - DNA, 15 bp, Homo sapiens
tatattagactgctt

SEQ ID NO: 23360 - DNA, 15 bp, Homo sapiens
ttatattagactgct

SEQ ID NO: 23361 - DNA, 15 bp, Homo sapiens
attatattagactgc

SEQ ID NO: 23362 - DNA, 15 bp, Homo sapiens
aattatattagactg

SEQ ID NO: 23363 - DNA, 15 bp, Homo sapiens
taattatattagact

SEQ ID NO: 23364 - DNA, 15 bp, Homo sapiens
ttaattatattagac

SEQ ID NO: 23365 - DNA, 15 bp, Homo sapiens
cttaattatattaga

SEQ ID NO: 23366 - DNA, 15 bp, Homo sapiens
gcttaattatattag

SEQ ID NO: 23367 - DNA, 15 bp, Homo sapiens
agcttaattatatta

SEQ ID NO: 23368 - DNA, 15 bp, Homo sapiens
tagcttaattatatt

SEQ ID NO: 23369 - DNA, 15 bp, Homo sapiens
ctagcttaattatat

SEQ ID NO: 23370 - DNA, 15 bp, Homo sapiens
actagcttaattata

SEQ ID NO: 23371 - DNA, 15 bp, Homo sapiens
aactagcttaattat

SEQ ID NO: 23372 - DNA, 15 bp, Homo sapiens
taactagcttaatta

SEQ ID NO: 23373 - DNA, 15 bp, Homo sapiens
ctaactagcttaatt

SEQ ID NO: 23374 - DNA, 15 bp, Homo sapiens
cctaactagcttaat

SEQ ID NO: 23375 - DNA, 15 bp, Homo sapiens
ccctaactagcttaa

SEQ ID NO: 23376 - DNA, 15 bp, Homo sapiens
accctaactagctta

SEQ ID NO: 23377 - DNA, 15 bp, Homo sapiens
taccctaactagctt

SEQ ID NO: 23378 - DNA, 15 bp, Homo sapiens
ttaccctaactagct

SEQ ID NO: 23379 - DNA, 15 bp, Homo sapiens
cttaccctaactagc

SEQ ID NO: 23380 - DNA, 15 bp, Homo sapiens
ccttaccctaactag

SEQ ID NO: 23381 - DNA, 15 bp, Homo sapiens
cccttaccctaacta

SEQ ID NO: 23382 - DNA, 15 bp, Homo sapiens
tcccttaccctaact

SEQ ID NO: 23383 - DNA, 15 bp, Homo sapiens
gtcccttaccctaac

SEQ ID NO: 23384 - DNA, 15 bp, Homo sapiens
tgtcccttaccctaa

SEQ ID NO: 23385 - DNA, 15 bp, Homo sapiens
ctgtcccttacccta

SEQ ID NO: 23386 - DNA, 15 bp, Homo sapiens
actgtcccttaccct

SEQ ID NO: 23387 - DNA, 15 bp, Homo sapiens
tactgtcccttaccc

SEQ ID NO: 23388 - DNA, 15 bp, Homo sapiens
gtactgtcccttacc

SEQ ID NO: 23389 - DNA, 15 bp, Homo sapiens
agtactgtcccttac

SEQ ID NO: 23390 - DNA, 15 bp, Homo sapiens
cagtactgtccctta

SEQ ID NO: 23391 - DNA, 15 bp, Homo sapiens
gcagtactgtccctt

SEQ ID NO: 23392 - DNA, 15 bp, Homo sapiens
agcagtactgtccct

SEQ ID NO: 23393 - DNA, 15 bp, Homo sapiens
cagcagtactgtccc

SEQ ID NO: 23394 - DNA, 15 bp, Homo sapiens
tcagcagtactgtcc

SEQ ID NO: 23395 - DNA, 15 bp, Homo sapiens
atcagcagtactgtc

SEQ ID NO: 23396 - DNA, 15 bp, Homo sapiens
catcagcagtactgt

SEQ ID NO: 23397 - DNA, 15 bp, Homo sapiens
gcatcagcagtactg

SEQ ID NO: 23398 - DNA, 15 bp, Homo sapiens
agcatcagcagtact

SEQ ID NO: 23399 - DNA, 15 bp, Homo sapiens
cagcatcagcagtac

SEQ ID NO: 23400 - DNA, 15 bp, Homo sapiens
tcagcatcagcagta

SEQ ID NO: 23401 - DNA, 15 bp, Homo sapiens
ctcagcatcagcagt

SEQ ID NO: 23402 - DNA, 15 bp, Homo sapiens
actcagcatcagcag

SEQ ID NO: 23403 - DNA, 15 bp, Homo sapiens
cactcagcatcagca

SEQ ID NO: 23404 - DNA, 15 bp, Homo sapiens
tcactcagcatcagc

SEQ ID NO: 23405 - DNA, 15 bp, Homo sapiens
ctcactcagcatcag

SEQ ID NO: 23406 - DNA, 15 bp, Homo sapiens
gctcactcagcatca

SEQ ID NO: 23407 - DNA, 15 bp, Homo sapiens
ggctcactcagcatc

SEQ ID NO: 23408 - DNA, 15 bp, Homo sapiens
aggctcactcagcat

SEQ ID NO: 23409 - DNA, 15 bp, Homo sapiens
gaggctcactcagca

SEQ ID NO: 23410 - DNA, 15 bp, Homo sapiens
tgaggctcactcagc

SEQ ID NO: 23411 - DNA, 15 bp, Homo sapiens
ctgaggctcactcag

SEQ ID NO: 23412 - DNA, 15 bp, Homo sapiens
actgaggctcactca

SEQ ID NO: 23413 - DNA, 15 bp, Homo sapiens
cactgaggctcactc

SEQ ID NO: 23414 - DNA, 15 bp, Homo sapiens
tcactgaggctcact

SEQ ID NO: 23415 - DNA, 15 bp, Homo sapiens
ctcactgaggctcac

SEQ ID NO: 23416 - DNA, 15 bp, Homo sapiens
actcactgaggctca

SEQ ID NO: 23417 - DNA, 15 bp, Homo sapiens
aactcactgaggctc

SEQ ID NO: 23418 - DNA, 15 bp, Homo sapiens
aaactcactgaggct

SEQ ID NO: 23419 - DNA, 15 bp, Homo sapiens
aaaactcactgaggc

SEQ ID NO: 23420 - DNA, 15 bp, Homo sapiens
taaaactcactgagg

SEQ ID NO: 23421 - DNA, 15 bp, Homo sapiens
ataaaactcactgag

SEQ ID NO: 23422 - DNA, 15 bp, Homo sapiens
aataaaactcactga

SEQ ID NO: 23423 - DNA, 15 bp, Homo sapiens
taataaaactcactg

SEQ ID NO: 23424 - DNA, 15 bp, Homo sapiens
ttaataaaactcact

SEQ ID NO: 23425 - DNA, 15 bp, Homo sapiens
tttaataaaactcac

SEQ ID NO: 23426 - DNA, 15 bp, Homo sapiens
ctttaataaaactca

SEQ ID NO: 23427 - DNA, 15 bp, Homo sapiens
actttaataaaactc

SEQ ID NO: 23428 - DNA, 15 bp, Homo sapiens
aactttaataaaact

SEQ ID NO: 23429 - DNA, 15 bp, Homo sapiens
caactttaataaaac

SEQ ID NO: 23430 - DNA, 15 bp, Homo sapiens
acaactttaataaaa

SEQ ID NO: 23431 - DNA, 15 bp, Homo sapiens
aacaactttaataaa

SEQ ID NO: 23432 - DNA, 15 bp, Homo sapiens
aaacaactttaataa

SEQ ID NO: 23433 - DNA, 15 bp, Homo sapiens
aaaacaactttaata

SEQ ID NO: 23434 - DNA, 15 bp, Homo sapiens
gaaaacaactttaat

SEQ ID NO: 23435 - DNA, 15 bp, Homo sapiens
cgaaaacaactttaa

SEQ ID NO: 23436 - DNA, 15 bp, Homo sapiens
acgaaaacaacttta

SEQ ID NO: 23437 - DNA, 15 bp, Homo sapiens
tacgaaaacaacttt

SEQ ID NO: 23438 - DNA, 15 bp, Homo sapiens
ttacgaaaacaactt

SEQ ID NO: 23439 - DNA, 15 bp, Homo sapiens
tttacgaaaacaact

SEQ ID NO: 23440 - DNA, 15 bp, Homo sapiens
atttacgaaaacaac

SEQ ID NO: 23441 - DNA, 15 bp, Homo sapiens
catttacgaaaacaa

SEQ ID NO: 23442 - DNA, 15 bp, Homo sapiens
tcatttacgaaaaca

SEQ ID NO: 23443 - DNA, 15 bp, Homo sapiens
ttcatttacgaaaac

SEQ ID NO: 23444 - DNA, 15 bp, Homo sapiens
tttcatttacgaaaa

SEQ ID NO: 23445 - DNA, 15 bp, Homo sapiens
ctttcatttacgaaa

SEQ ID NO: 23446 - DNA, 15 bp, Homo sapiens
tctttcatttacgaa

SEQ ID NO: 23447 - DNA, 15 bp, Homo sapiens
ctctttcatttacga

SEQ ID NO: 23448 - DNA, 15 bp, Homo sapiens
cctctttcatttacg

SEQ ID NO: 23449 - DNA, 15 bp, Homo sapiens
acctctttcatttac

SEQ ID NO: 23450 - DNA, 15 bp, Homo sapiens
aacctctttcattta

SEQ ID NO: 23451 - DNA, 15 bp, Homo sapiens
caacctctttcattt

SEQ ID NO: 23452 - DNA, 15 bp, Homo sapiens
acaacctctttcatt

SEQ ID NO: 23453 - DNA, 15 bp, Homo sapiens
aacaacctctttcat

SEQ ID NO: 23454 - DNA, 15 bp, Homo sapiens
aaacaacctctttca

SEQ ID NO: 23455 - DNA, 15 bp, Homo sapiens
caaacaacctctttc

SEQ ID NO: 23456 - DNA, 15 bp, Homo sapiens
gcaaacaacctcttt

SEQ ID NO: 23457 - DNA, 15 bp, Homo sapiens
ggcaaacaacctctt

SEQ ID NO: 23458 - DNA, 15 bp, Homo sapiens
aggcaaacaacctct

SEQ ID NO: 23459 - DNA, 15 bp, Homo sapiens
aaggcaaacaacctc

SEQ ID NO: 23460 - DNA, 15 bp, Homo sapiens
aaaggcaaacaacct

SEQ ID NO: 23461 - DNA, 15 bp, Homo sapiens
caaaggcaaacaacc

SEQ ID NO: 23462 - DNA, 15 bp, Homo sapiens
acaaaggcaaacaac

SEQ ID NO: 23463 - DNA, 15 bp, Homo sapiens
gacaaaggcaaacaa

SEQ ID NO: 23464 - DNA, 15 bp, Homo sapiens
ggacaaaggcaaaca

SEQ ID NO: 23465 - DNA, 15 bp, Homo sapiens
aggacaaaggcaaac

SEQ ID NO: 23466 - DNA, 15 bp, Homo sapiens
taggacaaaggcaaa

SEQ ID NO: 23467 - DNA, 15 bp, Homo sapiens
ttaggacaaaggcaa

SEQ ID NO: 23468 - DNA, 15 bp, Homo sapiens
cttaggacaaaggca

SEQ ID NO: 23469 - DNA, 15 bp, Homo sapiens
gcttaggacaaaggc

SEQ ID NO: 23470 - DNA, 15 bp, Homo sapiens
agcttaggacaaagg

SEQ ID NO: 23471 - DNA, 15 bp, Homo sapiens
tagcttaggacaaag

SEQ ID NO: 23472 - DNA, 15 bp, Homo sapiens
ttagcttaggacaaa

SEQ ID NO: 23473 - DNA, 15 bp, Homo sapiens
gttagcttaggacaa

SEQ ID NO: 23474 - DNA, 15 bp, Homo sapiens
tgttagcttaggaca

SEQ ID NO: 23475 - DNA, 15 bp, Homo sapiens
ttgttagcttaggac

SEQ ID NO: 23476 - DNA, 15 bp, Homo sapiens
tttgttagcttagga

SEQ ID NO: 23477 - DNA, 15 bp, Homo sapiens
ctttgttagcttagg

SEQ ID NO: 23478 - DNA, 15 bp, Homo sapiens
cctttgttagcttag

SEQ ID NO: 23479 - DNA, 15 bp, Homo sapiens
acctttgttagctta

SEQ ID NO: 23480 - DNA, 15 bp, Homo sapiens
tacctttgttagctt

SEQ ID NO: 23481 - DNA, 15 bp, Homo sapiens
ctacctttgttagct

SEQ ID NO: 23482 - DNA, 15 bp, Homo sapiens
actacctttgttagc

SEQ ID NO: 23483 - DNA, 15 bp, Homo sapiens
aactacctttgttag

SEQ ID NO: 23484 - DNA, 15 bp, Homo sapiens
aaactacctttgtta

SEQ ID NO: 23485 - DNA, 15 bp, Homo sapiens
taaactacctttgtt

SEQ ID NO: 23486 - DNA, 15 bp, Homo sapiens
ataaactacctttgt

SEQ ID NO: 23487 - DNA, 15 bp, Homo sapiens
aataaactacctttg

SEQ ID NO: 23488 - DNA, 15 bp, Homo sapiens
aaataaactaccttt

SEQ ID NO: 23489 - DNA, 15 bp, Homo sapiens
caaataaactacctt

SEQ ID NO: 23490 - DNA, 15 bp, Homo sapiens
acaaataaactacct

SEQ ID NO: 23491 - DNA, 15 bp, Homo sapiens
cacaaataaactacc

SEQ ID NO: 23492 - DNA, 15 bp, Homo sapiens
acacaaataaactac

SEQ ID NO: 23493 - DNA, 15 bp, Homo sapiens
tacacaaataaacta

SEQ ID NO: 23494 - DNA, 15 bp, Homo sapiens
ctacacaaataaact

SEQ ID NO: 23495 - DNA, 15 bp, Homo sapiens
gctacacaaataaac

SEQ ID NO: 23496 - DNA, 15 bp, Homo sapiens
tgctacacaaataaa

SEQ ID NO: 23497 - DNA, 15 bp, Homo sapiens
atgctacacaaataa

SEQ ID NO: 23498 - DNA, 15 bp, Homo sapiens
aatgctacacaaata

SEQ ID NO: 23499 - DNA, 15 bp, Homo sapiens
aaatgctacacaaat

SEQ ID NO: 23500 - DNA, 15 bp, Homo sapiens
aaaatgctacacaaa

SEQ ID NO: 23501 - DNA, 15 bp, Homo sapiens
aaaaatgctacacaa

SEQ ID NO: 23502 - DNA, 15 bp, Homo sapiens
aaaaaatgctacaca

SEQ ID NO: 23503 - DNA, 15 bp, Homo sapiens
taaaaaatgctacac

SEQ ID NO: 23504 - DNA, 15 bp, Homo sapiens
ttaaaaaatgctaca

SEQ ID NO: 23505 - DNA, 15 bp, Homo sapiens
tttaaaaaatgctac

SEQ ID NO: 23506 - DNA, 15 bp, Homo sapiens
ttttaaaaaatgcta

SEQ ID NO: 23507 - DNA, 15 bp, Homo sapiens
tttttaaaaaatgct

SEQ ID NO: 23508 - DNA, 15 bp, Homo sapiens
atttttaaaaaatgc

SEQ ID NO: 23509 - DNA, 15 bp, Homo sapiens
gatttttaaaaaatg

SEQ ID NO: 23510 - DNA, 15 bp, Homo sapiens
ggatttttaaaaaat

SEQ ID NO: 23511 - DNA, 15 bp, Homo sapiens
gggatttttaaaaaa

SEQ ID NO: 23512 - DNA, 15 bp, Homo sapiens
agggatttttaaaaa

SEQ ID NO: 23513 - DNA, 15 bp, Homo sapiens
aagggatttttaaaa

SEQ ID NO: 23514 - DNA, 15 bp, Homo sapiens
aaagggatttttaaa

SEQ ID NO: 23515 - DNA, 15 bp, Homo sapiens
aaaagggatttttaa

SEQ ID NO: 23516 - DNA, 15 bp, Homo sapiens
taaaagggattttta

SEQ ID NO: 23517 - DNA, 15 bp, Homo sapiens
ttaaaagggattttt

SEQ ID NO: 23518 - DNA, 15 bp, Homo sapiens
tttaaaagggatttt

SEQ ID NO: 23519 - DNA, 15 bp, Homo sapiens
atttaaaagggattt

SEQ ID NO: 23520 - DNA, 15 bp, Homo sapiens
tatttaaaagggatt

SEQ ID NO: 23521 - DNA, 15 bp, Homo sapiens
gtatttaaaagggat

SEQ ID NO: 23522 - DNA, 15 bp, Homo sapiens
agtatttaaaaggga

SEQ ID NO: 23523 - DNA, 15 bp, Homo sapiens
gagtatttaaaaggg

SEQ ID NO: 23524 - DNA, 15 bp, Homo sapiens
agagtatttaaaagg

SEQ ID NO: 23525 - DNA, 15 bp, Homo sapiens
cagagtatttaaaag

SEQ ID NO: 23526 - DNA, 15 bp, Homo sapiens
tcagagtatttaaaa

SEQ ID NO: 23527 - DNA, 15 bp, Homo sapiens
atcagagtatttaaa

SEQ ID NO: 23528 - DNA, 15 bp, Homo sapiens
catcagagtatttaa

SEQ ID NO: 23529 - DNA, 15 bp, Homo sapiens
gcatcagagtattta

SEQ ID NO: 23530 - DNA, 15 bp, Homo sapiens
cgcatcagagtattt

SEQ ID NO: 23531 - DNA, 15 bp, Homo sapiens
gcgcatcagagtatt

SEQ ID NO: 23532 - DNA, 15 bp, Homo sapiens
agcgcatcagagtat

SEQ ID NO: 23533 - DNA, 15 bp, Homo sapiens
gagcgcatcagagta

SEQ ID NO: 23534 - DNA, 15 bp, Homo sapiens
agagcgcatcagagt

SEQ ID NO: 23535 - DNA, 15 bp, Homo sapiens
gagagcgcatcagag

SEQ ID NO: 23536 - DNA, 15 bp, Homo sapiens
ggagagcgcatcaga

SEQ ID NO: 23537 - DNA, 15 bp, Homo sapiens
gggagagcgcatcag

SEQ ID NO: 23538 - DNA, 15 bp, Homo sapiens
ggggagagcgcatca

SEQ ID NO: 23539 - DNA, 15 bp, Homo sapiens
gggggagagcgcatc

SEQ ID NO: 23540 - DNA, 15 bp, Homo sapiens
agggggagagcgcat

SEQ ID NO: 23541 - DNA, 15 bp, Homo sapiens
tagggggagagcgca

SEQ ID NO: 23542 - DNA, 15 bp, Homo sapiens
gtagggggagagcgc

SEQ ID NO: 23543 - DNA, 15 bp, Homo sapiens
tgtagggggagagcg

SEQ ID NO: 23544 - DNA, 15 bp, Homo sapiens
ctgtagggggagagc

SEQ ID NO: 23545 - DNA, 15 bp, Homo sapiens
tctgtagggggagag

SEQ ID NO: 23546 - DNA, 15 bp, Homo sapiens
atctgtagggggaga

SEQ ID NO: 23547 - DNA, 15 bp, Homo sapiens
catctgtagggggag

SEQ ID NO: 23548 - DNA, 15 bp, Homo sapiens
acatctgtaggggga

SEQ ID NO: 23549 - DNA, 15 bp, Homo sapiens
aacatctgtaggggg

SEQ ID NO: 23550 - DNA, 15 bp, Homo sapiens
gaacatctgtagggg

SEQ ID NO: 23551 - DNA, 15 bp, Homo sapiens
tgaacatctgtaggg

SEQ ID NO: 23552 - DNA, 15 bp, Homo sapiens
atgaacatctgtagg

SEQ ID NO: 23553 - DNA, 15 bp, Homo sapiens
aatgaacatctgtag

SEQ ID NO: 23554 - DNA, 15 bp, Homo sapiens
gaatgaacatctgta

SEQ ID NO: 23555 - DNA, 15 bp, Homo sapiens
agaatgaacatctgt

SEQ ID NO: 23556 - DNA, 15 bp, Homo sapiens
cagaatgaacatctg

SEQ ID NO: 23557 - DNA, 15 bp, Homo sapiens
ccagaatgaacatct

SEQ ID NO: 23558 - DNA, 15 bp, Homo sapiens
tccagaatgaacatc

SEQ ID NO: 23559 - DNA, 15 bp, Homo sapiens
gtccagaatgaacat

SEQ ID NO: 23560 - DNA, 15 bp, Homo sapiens
tgtccagaatgaaca

SEQ ID NO: 23561 - DNA, 15 bp, Homo sapiens
ctgtccagaatgaac

SEQ ID NO: 23562 - DNA, 15 bp, Homo sapiens
tctgtccagaatgaa

SEQ ID NO: 23563 - DNA, 15 bp, Homo sapiens
ctctgtccagaatga

SEQ ID NO: 23564 - DNA, 15 bp, Homo sapiens
actctgtccagaatg

SEQ ID NO: 23565 - DNA, 15 bp, Homo sapiens
cactctgtccagaat

SEQ ID NO: 23566 - DNA, 15 bp, Homo sapiens
ccactctgtccagaa

SEQ ID NO: 23567 - DNA, 15 bp, Homo sapiens
tccactctgtccaga

SEQ ID NO: 23568 - DNA, 15 bp, Homo sapiens
ttccactctgtccag

SEQ ID NO: 23569 - DNA, 15 bp, Homo sapiens
cttccactctgtcca

SEQ ID NO: 23570 - DNA, 15 bp, Homo sapiens
ccttccactctgtcc

SEQ ID NO: 23571 - DNA, 15 bp, Homo sapiens
accttccactctgtc

SEQ ID NO: 23572 - DNA, 15 bp, Homo sapiens
caccttccactctgt

SEQ ID NO: 23573 - DNA, 15 bp, Homo sapiens
tcaccttccactctg

SEQ ID NO: 23574 - DNA, 15 bp, Homo sapiens
atcaccttccactct

SEQ ID NO: 23575 - DNA, 15 bp, Homo sapiens
tatcaccttccactc

SEQ ID NO: 23576 - DNA, 15 bp, Homo sapiens
gtatcaccttccact

SEQ ID NO: 23577 - DNA, 15 bp, Homo sapiens
agtatcaccttccac

SEQ ID NO: 23578 - DNA, 15 bp, Homo sapiens
aagtatcaccttcca

SEQ ID NO: 23579 - DNA, 15 bp, Homo sapiens
caagtatcaccttcc

SEQ ID NO: 23580 - DNA, 15 bp, Homo sapiens
acaagtatcaccttc

SEQ ID NO: 23581 - DNA, 15 bp, Homo sapiens
aacaagtatcacctt

SEQ ID NO: 23582 - DNA, 15 bp, Homo sapiens
gaacaagtatcacct

SEQ ID NO: 23583 - DNA, 15 bp, Homo sapiens
ggaacaagtatcacc

SEQ ID NO: 23584 - DNA, 15 bp, Homo sapiens
gggaacaagtatcac

SEQ ID NO: 23585 - DNA, 15 bp, Homo sapiens
agggaacaagtatca

SEQ ID NO: 23586 - DNA, 15 bp, Homo sapiens
aagggaacaagtatc

SEQ ID NO: 23587 - DNA, 15 bp, Homo sapiens
taagggaacaagtat

SEQ ID NO: 23588 - DNA, 15 bp, Homo sapiens
ttaagggaacaagta

SEQ ID NO: 23589 - DNA, 15 bp, Homo sapiens
attaagggaacaagt

SEQ ID NO: 23590 - DNA, 15 bp, Homo sapiens
cattaagggaacaag

SEQ ID NO: 23591 - DNA, 15 bp, Homo sapiens
tcattaagggaacaa

SEQ ID NO: 23592 - DNA, 15 bp, Homo sapiens
ctcattaagggaaca

SEQ ID NO: 23593 - DNA, 15 bp, Homo sapiens
actcattaagggaac

SEQ ID NO: 23594 - DNA, 15 bp, Homo sapiens
aactcattaagggaa

SEQ ID NO: 23595 - DNA, 15 bp, Homo sapiens
aaactcattaaggga

SEQ ID NO: 23596 - DNA, 15 bp, Homo sapiens
taaactcattaaggg

SEQ ID NO: 23597 - DNA, 15 bp, Homo sapiens
gtaaactcattaagg

SEQ ID NO: 23598 - DNA, 15 bp, Homo sapiens
ggtaaactcattaag

SEQ ID NO: 23599 - DNA, 15 bp, Homo sapiens
tggtaaactcattaa

SEQ ID NO: 23600 - DNA, 15 bp, Homo sapiens
atggtaaactcatta

SEQ ID NO: 23601 - DNA, 15 bp, Homo sapiens
tatggtaaactcatt

SEQ ID NO: 23602 - DNA, 15 bp, Homo sapiens
ttatggtaaactcat

SEQ ID NO: 23603 - DNA, 15 bp, Homo sapiens
gttatggtaaactca

SEQ ID NO: 23604 - DNA, 15 bp, Homo sapiens
agttatggtaaactc

SEQ ID NO: 23605 - DNA, 15 bp, Homo sapiens
cagttatggtaaact

SEQ ID NO: 23606 - DNA, 15 bp, Homo sapiens
ccagttatggtaaac

SEQ ID NO: 23607 - DNA, 15 bp, Homo sapiens
tccagttatggtaaa

SEQ ID NO: 23608 - DNA, 15 bp, Homo sapiens
atccagttatggtaa

SEQ ID NO: 23609 - DNA, 15 bp, Homo sapiens
gatccagttatggta

SEQ ID NO: 23610 - DNA, 15 bp, Homo sapiens
tgatccagttatggt

SEQ ID NO: 23611 - DNA, 15 bp, Homo sapiens
ttgatccagttatgg

SEQ ID NO: 23612 - DNA, 15 bp, Homo sapiens
gttgatccagttatg

SEQ ID NO: 23613 - DNA, 15 bp, Homo sapiens
agttgatccagttat

SEQ ID NO: 23614 - DNA, 15 bp, Homo sapiens
aagttgatccagtta

SEQ ID NO: 23615 - DNA, 15 bp, Homo sapiens
taagttgatccagtt

SEQ ID NO: 23616 - DNA, 15 bp, Homo sapiens
ataagttgatccagt

SEQ ID NO: 23617 - DNA, 15 bp, Homo sapiens
cataagttgatccag

SEQ ID NO: 23618 - DNA, 15 bp, Homo sapiens
gcataagttgatcca

SEQ ID NO: 23619 - DNA, 15 bp, Homo sapiens
tgcataagttgatcc

SEQ ID NO: 23620 - DNA, 15 bp, Homo sapiens
gtgcataagttgatc

SEQ ID NO: 23621 - DNA, 15 bp, Homo sapiens
ggtgcataagttgat

SEQ ID NO: 23622 - DNA, 15 bp, Homo sapiens
aggtgcataagttga

SEQ ID NO: 23623 - DNA, 15 bp, Homo sapiens
taggtgcataagttg

SEQ ID NO: 23624 - DNA, 15 bp, Homo sapiens
ataggtgcataagtt

SEQ ID NO: 23625 - DNA, 15 bp, Homo sapiens
aataggtgcataagt

SEQ ID NO: 23626 - DNA, 15 bp, Homo sapiens
caataggtgcataag

SEQ ID NO: 23627 - DNA, 15 bp, Homo sapiens
ccaataggtgcataa

SEQ ID NO: 23628 - DNA, 15 bp, Homo sapiens
tccaataggtgcata

SEQ ID NO: 23629 - DNA, 15 bp, Homo sapiens
ctccaataggtgcat

SEQ ID NO: 23630 - DNA, 15 bp, Homo sapiens
tctccaataggtgca

SEQ ID NO: 23631 - DNA, 15 bp, Homo sapiens
ttctccaataggtgc

SEQ ID NO: 23632 - DNA, 15 bp, Homo sapiens
cttctccaataggtg

SEQ ID NO: 23633 - DNA, 15 bp, Homo sapiens
acttctccaataggt

SEQ ID NO: 23634 - DNA, 15 bp, Homo sapiens
cacttctccaatagg

SEQ ID NO: 23635 - DNA, 15 bp, Homo sapiens
acacttctccaatag

SEQ ID NO: 23636 - DNA, 15 bp, Homo sapiens
cacacttctccaata

SEQ ID NO: 23637 - DNA, 15 bp, Homo sapiens
tcacacttctccaat

SEQ ID NO: 23638 - DNA, 15 bp, Homo sapiens
ctcacacttctccaa

SEQ ID NO: 23639 - DNA, 15 bp, Homo sapiens
actcacacttctcca

SEQ ID NO: 23640 - DNA, 15 bp, Homo sapiens
tactcacacttctcc

SEQ ID NO: 23641 - DNA, 15 bp, Homo sapiens
ttactcacacttctc

SEQ ID NO: 23642 - DNA, 15 bp, Homo sapiens
gttactcacacttct

SEQ ID NO: 23643 - DNA, 15 bp, Homo sapiens
ggttactcacacttc

SEQ ID NO: 23644 - DNA, 15 bp, Homo sapiens
gggttactcacactt

SEQ ID NO: 23645 - DNA, 15 bp, Homo sapiens
agggttactcacact

SEQ ID NO: 23646 - DNA, 15 bp, Homo sapiens
gagggttactcacac

SEQ ID NO: 23647 - DNA, 15 bp, Homo sapiens
ggagggttactcaca

SEQ ID NO: 23648 - DNA, 15 bp, Homo sapiens
aggagggttactcac

SEQ ID NO: 23649 - DNA, 15 bp, Homo sapiens
gaggagggttactca

SEQ ID NO: 23650 - DNA, 15 bp, Homo sapiens
ggaggagggttactc

SEQ ID NO: 23651 - DNA, 15 bp, Homo sapiens
aggaggagggttact

SEQ ID NO: 23652 - DNA, 15 bp, Homo sapiens
gaggaggagggttac

SEQ ID NO: 23653 - DNA, 15 bp, Homo sapiens
tgaggaggagggtta

SEQ ID NO: 23654 - DNA, 15 bp, Homo sapiens
atgaggaggagggtt

SEQ ID NO: 23655 - DNA, 15 bp, Homo sapiens
aatgaggaggagggt

SEQ ID NO: 23656 - DNA, 15 bp, Homo sapiens
aaatgaggaggaggg

SEQ ID NO: 23657 - DNA, 15 bp, Homo sapiens
taaatgaggaggagg

SEQ ID NO: 23658 - DNA, 15 bp, Homo sapiens
ttaaatgaggaggag

SEQ ID NO: 23659 - DNA, 15 bp, Homo sapiens
tttaaatgaggagga

SEQ ID NO: 23660 - DNA, 15 bp, Homo sapiens
ctttaaatgaggagg

SEQ ID NO: 23661 - DNA, 15 bp, Homo sapiens
cctttaaatgaggag

SEQ ID NO: 23662 - DNA, 15 bp, Homo sapiens
tcctttaaatgagga

SEQ ID NO: 23663 - DNA, 15 bp, Homo sapiens
atcctttaaatgagg

SEQ ID NO: 23664 - DNA, 15 bp, Homo sapiens
gatcctttaaatgag

SEQ ID NO: 23665 - DNA, 15 bp, Homo sapiens
agatcctttaaatga

SEQ ID NO: 23666 - DNA, 15 bp, Homo sapiens
cagatcctttaaatg

SEQ ID NO: 23667 - DNA, 15 bp, Homo sapiens
ccagatcctttaaat

SEQ ID NO: 23668 - DNA, 15 bp, Homo sapiens
accagatcctttaaa

SEQ ID NO: 23669 - DNA, 15 bp, Homo sapiens
caccagatcctttaa

SEQ ID NO: 23670 - DNA, 15 bp, Homo sapiens
acaccagatccttta

SEQ ID NO: 23671 - DNA, 15 bp, Homo sapiens
cacaccagatccttt

SEQ ID NO: 23672 - DNA, 15 bp, Homo sapiens
ccacaccagatcctt

SEQ ID NO: 23673 - DNA, 15 bp, Homo sapiens
gccacaccagatcct

SEQ ID NO: 23674 - DNA, 15 bp, Homo sapiens
tgccacaccagatcc

SEQ ID NO: 23675 - DNA, 15 bp, Homo sapiens
ctgccacaccagatc

SEQ ID NO: 23676 - DNA, 15 bp, Homo sapiens
actgccacaccagat

SEQ ID NO: 23677 - DNA, 15 bp, Homo sapiens
aactgccacaccaga

SEQ ID NO: 23678 - DNA, 15 bp, Homo sapiens
aaactgccacaccag

SEQ ID NO: 23679 - DNA, 15 bp, Homo sapiens
taaactgccacacca

SEQ ID NO: 23680 - DNA, 15 bp, Homo sapiens
ctaaactgccacacc

SEQ ID NO: 23681 - DNA, 15 bp, Homo sapiens
actaaactgccacac

SEQ ID NO: 23682 - DNA, 15 bp, Homo sapiens
tactaaactgccaca

SEQ ID NO: 23683 - DNA, 15 bp, Homo sapiens
atactaaactgccac

SEQ ID NO: 23684 - DNA, 15 bp, Homo sapiens
aatactaaactgcca

SEQ ID NO: 23685 - DNA, 15 bp, Homo sapiens
aaatactaaactgcc

SEQ ID NO: 23686 - DNA, 15 bp, Homo sapiens
caaatactaaactgc

SEQ ID NO: 23687 - DNA, 15 bp, Homo sapiens
acaaatactaaactg

SEQ ID NO: 23688 - DNA, 15 bp, Homo sapiens
tacaaatactaaact

SEQ ID NO: 23689 - DNA, 15 bp, Homo sapiens
atacaaatactaaac

SEQ ID NO: 23690 - DNA, 15 bp, Homo sapiens
aatacaaatactaaa

SEQ ID NO: 23691 - DNA, 15 bp, Homo sapiens
caatacaaatactaa

SEQ ID NO: 23692 - DNA, 15 bp, Homo sapiens
tcaatacaaatacta

SEQ ID NO: 23693 - DNA, 15 bp, Homo sapiens
atcaatacaaatact

SEQ ID NO: 23694 - DNA, 15 bp, Homo sapiens
aatcaatacaaatac

SEQ ID NO: 23695 - DNA, 15 bp, Homo sapiens
aaatcaatacaaata

SEQ ID NO: 23696 - DNA, 15 bp, Homo sapiens
caaatcaatacaaat

SEQ ID NO: 23697 - DNA, 15 bp, Homo sapiens
gcaaatcaatacaaa

SEQ ID NO: 23698 - DNA, 15 bp, Homo sapiens
tgcaaatcaatacaa

SEQ ID NO: 23699 - DNA, 15 bp, Homo sapiens
ctgcaaatcaataca

SEQ ID NO: 23700 - DNA, 15 bp, Homo sapiens
gctgcaaatcaatac

SEQ ID NO: 23701 - DNA, 15 bp, Homo sapiens
tgctgcaaatcaata

SEQ ID NO: 23702 - DNA, 15 bp, Homo sapiens
atgctgcaaatcaat

SEQ ID NO: 23703 - DNA, 15 bp, Homo sapiens
catgctgcaaatcaa

SEQ ID NO: 23704 - DNA, 15 bp, Homo sapiens
acatgctgcaaatca

SEQ ID NO: 23705 - DNA, 15 bp, Homo sapiens
gacatgctgcaaatc

SEQ ID NO: 23706 - DNA, 15 bp, Homo sapiens
agacatgctgcaaat

SEQ ID NO: 23707 - DNA, 15 bp, Homo sapiens
tagacatgctgcaaa

SEQ ID NO: 23708 - DNA, 15 bp, Homo sapiens
gtagacatgctgcaa

SEQ ID NO: 23709 - DNA, 15 bp, Homo sapiens
tgtagacatgctgca

SEQ ID NO: 23710 - DNA, 15 bp, Homo sapiens
ttgtagacatgctgc

SEQ ID NO: 23711 - DNA, 15 bp, Homo sapiens
tttgtagacatgctg

SEQ ID NO: 23712 - DNA, 15 bp, Homo sapiens
ctttgtagacatgct

SEQ ID NO: 23713 - DNA, 15 bp, Homo sapiens
actttgtagacatgc

SEQ ID NO: 23714 - DNA, 15 bp, Homo sapiens
aactttgtagacatg

SEQ ID NO: 23715 - DNA, 15 bp, Homo sapiens
taactttgtagacat

SEQ ID NO: 23716 - DNA, 15 bp, Homo sapiens
ttaactttgtagaca

SEQ ID NO: 23717 - DNA, 15 bp, Homo sapiens
cttaactttgtagac

SEQ ID NO: 23718 - DNA, 15 bp, Homo sapiens
tcttaactttgtaga

SEQ ID NO: 23719 - DNA, 15 bp, Homo sapiens
gtcttaactttgtag

SEQ ID NO: 23720 - DNA, 15 bp, Homo sapiens
tgtcttaactttgta

SEQ ID NO: 23721 - DNA, 15 bp, Homo sapiens
ctgtcttaactttgt

SEQ ID NO: 23722 - DNA, 15 bp, Homo sapiens
gctgtcttaactttg

SEQ ID NO: 23723 - DNA, 15 bp, Homo sapiens
agctgtcttaacttt

SEQ ID NO: 23724 - DNA, 15 bp, Homo sapiens
aagctgtcttaactt

SEQ ID NO: 23725 - DNA, 15 bp, Homo sapiens
aaagctgtcttaact

SEQ ID NO: 23726 - DNA, 15 bp, Homo sapiens
gaaagctgtcttaac

SEQ ID NO: 23727 - DNA, 15 bp, Homo sapiens
agaaagctgtcttaa

SEQ ID NO: 23728 - DNA, 15 bp, Homo sapiens
cagaaagctgtctta

SEQ ID NO: 23729 - DNA, 15 bp, Homo sapiens
tcagaaagctgtctt

SEQ ID NO: 23730 - DNA, 15 bp, Homo sapiens
ttcagaaagctgtct

SEQ ID NO: 23731 - DNA, 15 bp, Homo sapiens
attcagaaagctgtc

SEQ ID NO: 23732 - DNA, 15 bp, Homo sapiens
cattcagaaagctgt

SEQ ID NO: 23733 - DNA, 15 bp, Homo sapiens
acattcagaaagctg

SEQ ID NO: 23734 - DNA, 15 bp, Homo sapiens
cacattcagaaagct

SEQ ID NO: 23735 - DNA, 15 bp, Homo sapiens
ccacattcagaaagc

SEQ ID NO: 23736 - DNA, 15 bp, Homo sapiens
gccacattcagaaag

SEQ ID NO: 23737 - DNA, 15 bp, Homo sapiens
agccacattcagaaa

SEQ ID NO: 23738 - DNA, 15 bp, Homo sapiens
gagccacattcagaa

SEQ ID NO: 23739 - DNA, 15 bp, Homo sapiens
tgagccacattcaga

SEQ ID NO: 23740 - DNA, 15 bp, Homo sapiens
ttgagccacattcag

SEQ ID NO: 23741 - DNA, 15 bp, Homo sapiens
cttgagccacattca

SEQ ID NO: 23742 - DNA, 15 bp, Homo sapiens
acttgagccacattc

SEQ ID NO: 23743 - DNA, 15 bp, Homo sapiens
gacttgagccacatt

SEQ ID NO: 23744 - DNA, 15 bp, Homo sapiens
tgacttgagccacat

SEQ ID NO: 23745 - DNA, 15 bp, Homo sapiens
ttgacttgagccaca

SEQ ID NO: 23746 - DNA, 15 bp, Homo sapiens
gttgacttgagccac

SEQ ID NO: 23747 - DNA, 15 bp, Homo sapiens
tgttgacttgagcca

SEQ ID NO: 23748 - DNA, 15 bp, Homo sapiens
gtgttgacttgagcc

SEQ ID NO: 23749 - DNA, 15 bp, Homo sapiens
agtgttgacttgagc

SEQ ID NO: 23750 - DNA, 15 bp, Homo sapiens
aagtgttgacttgag

SEQ ID NO: 23751 - DNA, 15 bp, Homo sapiens
taagtgttgacttga

SEQ ID NO: 23752 - DNA, 15 bp, Homo sapiens
ataagtgttgacttg

SEQ ID NO: 23753 - DNA, 15 bp, Homo sapiens
aataagtgttgactt

SEQ ID NO: 23754 - DNA, 15 bp, Homo sapiens
taataagtgttgact

SEQ ID NO: 23755 - DNA, 15 bp, Homo sapiens
gtaataagtgttgac

SEQ ID NO: 23756 - DNA, 15 bp, Homo sapiens
agtaataagtgttga

SEQ ID NO: 23757 - DNA, 15 bp, Homo sapiens
tagtaataagtgttg

SEQ ID NO: 23758 - DNA, 15 bp, Homo sapiens
ttagtaataagtgtt

SEQ ID NO: 23759 - DNA, 15 bp, Homo sapiens
tttagtaataagtgt

SEQ ID NO: 23760 - DNA, 15 bp, Homo sapiens
ctttagtaataagtg

SEQ ID NO: 23761 - DNA, 15 bp, Homo sapiens
actttagtaataagt

SEQ ID NO: 23762 - DNA, 15 bp, Homo sapiens
tactttagtaataag

SEQ ID NO: 23763 - DNA, 15 bp, Homo sapiens
ctactttagtaataa

SEQ ID NO: 23764 - DNA, 15 bp, Homo sapiens
actactttagtaata

SEQ ID NO: 23765 - DNA, 15 bp, Homo sapiens
tactactttagtaat

SEQ ID NO: 23766 - DNA, 15 bp, Homo sapiens
ttactactttagtaa

SEQ ID NO: 23767 - DNA, 15 bp, Homo sapiens
tttactactttagta

SEQ ID NO: 23768 - DNA, 15 bp, Homo sapiens
atttactactttagt

SEQ ID NO: 23769 - DNA, 15 bp, Homo sapiens
catttactactttag

SEQ ID NO: 23770 - DNA, 15 bp, Homo sapiens
acatttactacttta

SEQ ID NO: 23771 - DNA, 15 bp, Homo sapiens
aacatttactacttt

SEQ ID NO: 23772 - DNA, 15 bp, Homo sapiens
aaacatttactactt

SEQ ID NO: 23773 - DNA, 15 bp, Homo sapiens
aaaacatttactact

SEQ ID NO: 23774 - DNA, 15 bp, Homo sapiens
aaaaacatttactac

SEQ ID NO: 23775 - DNA, 15 bp, Homo sapiens
taaaaacatttacta

SEQ ID NO: 23776 - DNA, 15 bp, Homo sapiens
ttaaaaacatttact

SEQ ID NO: 23777 - DNA, 15 bp, Homo sapiens
tttaaaaacatttac

SEQ ID NO: 23778 - DNA, 15 bp, Homo sapiens
ttttaaaaacattta

SEQ ID NO: 23779 - DNA, 15 bp, Homo sapiens
gttttaaaaacattt

SEQ ID NO: 23780 - DNA, 15 bp, Homo sapiens
tgttttaaaaacatt

SEQ ID NO: 23781 - DNA, 15 bp, Homo sapiens
ttgttttaaaaacat

SEQ ID NO: 23782 - DNA, 15 bp, Homo sapiens
tttgttttaaaaaca

SEQ ID NO: 23783 - DNA, 15 bp, Homo sapiens
ttttgttttaaaaac

SEQ ID NO: 23784 - DNA, 15 bp, Homo sapiens
tttttgttttaaaaa

SEQ ID NO: 23785 - DNA, 15 bp, Homo sapiens
gtttttgttttaaaa

SEQ ID NO: 23786 - DNA, 15 bp, Homo sapiens
agtttttgttttaaa

SEQ ID NO: 23787 - DNA, 15 bp, Homo sapiens
aagtttttgttttaa

SEQ ID NO: 23788 - DNA, 15 bp, Homo sapiens
aaagtttttgtttta

SEQ ID NO: 23789 - DNA, 15 bp, Homo sapiens
caaagtttttgtttt

SEQ ID NO: 23790 - DNA, 15 bp, Homo sapiens
tcaaagtttttgttt

SEQ ID NO: 23791 - DNA, 15 bp, Homo sapiens
ttcaaagtttttgtt

SEQ ID NO: 23792 - DNA, 15 bp, Homo sapiens
tttcaaagtttttgt

SEQ ID NO: 23793 - DNA, 15 bp, Homo sapiens
ctttcaaagtttttg

SEQ ID NO: 23794 - DNA, 15 bp, Homo sapiens
tctttcaaagttttt

SEQ ID NO: 23795 - DNA, 15 bp, Homo sapiens
atctttcaaagtttt

SEQ ID NO: 23796 - DNA, 15 bp, Homo sapiens
catctttcaaagttt

SEQ ID NO: 23797 - DNA, 15 bp, Homo sapiens
tcatctttcaaagtt

SEQ ID NO: 23798 - DNA, 15 bp, Homo sapiens
ttcatctttcaaagt

SEQ ID NO: 23799 - DNA, 15 bp, Homo sapiens
gttcatctttcaaag

SEQ ID NO: 23800 - DNA, 15 bp, Homo sapiens
ggttcatctttcaaa

SEQ ID NO: 23801 - DNA, 15 bp, Homo sapiens
tggttcatctttcaa

SEQ ID NO: 23802 - DNA, 15 bp, Homo sapiens
ttggttcatctttca

SEQ ID NO: 23803 - DNA, 15 bp, Homo sapiens
tttggttcatctttc

SEQ ID NO: 23804 - DNA, 15 bp, Homo sapiens
ctttggttcatcttt

SEQ ID NO: 23805 - DNA, 15 bp, Homo sapiens
cctttggttcatctt

SEQ ID NO: 23806 - DNA, 15 bp, Homo sapiens
acctttggttcatct

SEQ ID NO: 23807 - DNA, 15 bp, Homo sapiens
aacctttggttcatc

SEQ ID NO: 23808 - DNA, 15 bp, Homo sapiens
taacctttggttcat

SEQ ID NO: 23809 - DNA, 15 bp, Homo sapiens
ataacctttggttca

SEQ ID NO: 23810 - DNA, 15 bp, Homo sapiens
tataacctttggttc

SEQ ID NO: 23811 - DNA, 15 bp, Homo sapiens
ttataacctttggtt

SEQ ID NO: 23812 - DNA, 15 bp, Homo sapiens
attataacctttggt

SEQ ID NO: 23813 - DNA, 15 bp, Homo sapiens
gattataacctttgg

SEQ ID NO: 23814 - DNA, 15 bp, Homo sapiens
ggattataacctttg

SEQ ID NO: 23815 - DNA, 15 bp, Homo sapiens
tggattataaccttt

SEQ ID NO: 23816 - DNA, 15 bp, Homo sapiens
ctggattataacctt

SEQ ID NO: 23817 - DNA, 15 bp, Homo sapiens
actggattataacct

SEQ ID NO: 23818 - DNA, 15 bp, Homo sapiens
gactggattataacc

SEQ ID NO: 23819 - DNA, 15 bp, Homo sapiens
tgactggattataac

SEQ ID NO: 23820 - DNA, 15 bp, Homo sapiens
atgactggattataa

SEQ ID NO: 23821 - DNA, 15 bp, Homo sapiens
gatgactggattata

SEQ ID NO: 23822 - DNA, 15 bp, Homo sapiens
agatgactggattat

SEQ ID NO: 23823 - DNA, 15 bp, Homo sapiens
aagatgactggatta

SEQ ID NO: 23824 - DNA, 15 bp, Homo sapiens
aaagatgactggatt

SEQ ID NO: 23825 - DNA, 15 bp, Homo sapiens
aaaagatgactggat

SEQ ID NO: 23826 - DNA, 15 bp, Homo sapiens
aaaaagatgactgga

SEQ ID NO: 23827 - DNA, 15 bp, Homo sapiens
caaaaagatgactgg

SEQ ID NO: 23828 - DNA, 15 bp, Homo sapiens
gcaaaaagatgactg

SEQ ID NO: 23829 - DNA, 15 bp, Homo sapiens
tgcaaaaagatgact

SEQ ID NO: 23830 - DNA, 15 bp, Homo sapiens
atgcaaaaagatgac

SEQ ID NO: 23831 - DNA, 15 bp, Homo sapiens
gatgcaaaaagatga

SEQ ID NO: 23832 - DNA, 15 bp, Homo sapiens
agatgcaaaaagatg

SEQ ID NO: 23833 - DNA, 15 bp, Homo sapiens
aagatgcaaaaagat

SEQ ID NO: 23834 - DNA, 15 bp, Homo sapiens
gaagatgcaaaaaga

SEQ ID NO: 23835 - DNA, 15 bp, Homo sapiens
agaagatgcaaaaag

SEQ ID NO: 23836 - DNA, 15 bp, Homo sapiens
cagaagatgcaaaaa

SEQ ID NO: 23837 - DNA, 15 bp, Homo sapiens
ccagaagatgcaaaa

SEQ ID NO: 23838 - DNA, 15 bp, Homo sapiens
cccagaagatgcaaa

SEQ ID NO: 23839 - DNA, 15 bp, Homo sapiens
gcccagaagatgcaa

SEQ ID NO: 23840 - DNA, 15 bp, Homo sapiens
agcccagaagatgca

SEQ ID NO: 23841 - DNA, 15 bp, Homo sapiens
gagcccagaagatgc

SEQ ID NO: 23842 - DNA, 15 bp, Homo sapiens
ggagcccagaagatg

SEQ ID NO: 23843 - DNA, 15 bp, Homo sapiens
tggagcccagaagat

SEQ ID NO: 23844 - DNA, 15 bp, Homo sapiens
ttggagcccagaaga

SEQ ID NO: 23845 - DNA, 15 bp, Homo sapiens
tttggagcccagaag

SEQ ID NO: 23846 - DNA, 15 bp, Homo sapiens
gtttggagcccagaa

SEQ ID NO: 23847 - DNA, 15 bp, Homo sapiens
agtttggagcccaga

SEQ ID NO: 23848 - DNA, 15 bp, Homo sapiens
aagtttggagcccag

SEQ ID NO: 23849 - DNA, 15 bp, Homo sapiens
aaagtttggagccca

SEQ ID NO: 23850 - DNA, 15 bp, Homo sapiens
gaaagtttggagccc

SEQ ID NO: 23851 - DNA, 15 bp, Homo sapiens
tgaaagtttggagcc

SEQ ID NO: 23852 - DNA, 15 bp, Homo sapiens
ttgaaagtttggagc

SEQ ID NO: 23853 - DNA, 15 bp, Homo sapiens
cttgaaagtttggag

SEQ ID NO: 23854 - DNA, 15 bp, Homo sapiens
tcttgaaagtttgga

SEQ ID NO: 23855 - DNA, 15 bp, Homo sapiens
ctcttgaaagtttgg

SEQ ID NO: 23856 - DNA, 15 bp, Homo sapiens
cctcttgaaagtttg

SEQ ID NO: 23857 - DNA, 15 bp, Homo sapiens
ccctcttgaaagttt

SEQ ID NO: 23858 - DNA, 15 bp, Homo sapiens
tccctcttgaaagtt

SEQ ID NO: 23859 - DNA, 15 bp, Homo sapiens
atccctcttgaaagt

SEQ ID NO: 23860 - DNA, 15 bp, Homo sapiens
aatccctcttgaaag

SEQ ID NO: 23861 - DNA, 15 bp, Homo sapiens
aaatccctcttgaaa

SEQ ID NO: 23862 - DNA, 15 bp, Homo sapiens
caaatccctcttgaa

SEQ ID NO: 23863 - DNA, 15 bp, Homo sapiens
acaaatccctcttga

SEQ ID NO: 23864 - DNA, 15 bp, Homo sapiens
cacaaatccctcttg

SEQ ID NO: 23865 - DNA, 15 bp, Homo sapiens
acacaaatccctctt

SEQ ID NO: 23866 - DNA, 15 bp, Homo sapiens
aacacaaatccctct

SEQ ID NO: 23867 - DNA, 15 bp, Homo sapiens
aaacacaaatccctc

SEQ ID NO: 23868 - DNA, 15 bp, Homo sapiens
caaacacaaatccct

SEQ ID NO: 23869 - DNA, 15 bp, Homo sapiens
acaaacacaaatccc

SEQ ID NO: 23870 - DNA, 15 bp, Homo sapiens
aacaaacacaaatcc

SEQ ID NO: 23871 - DNA, 15 bp, Homo sapiens
taacaaacacaaatc

SEQ ID NO: 23872 - DNA, 15 bp, Homo sapiens
ataacaaacacaaat

SEQ ID NO: 23873 - DNA, 15 bp, Homo sapiens
aataacaaacacaaa

SEQ ID NO: 23874 - DNA, 15 bp, Homo sapiens
gaataacaaacacaa

SEQ ID NO: 23875 - DNA, 15 bp, Homo sapiens
tgaataacaaacaca

SEQ ID NO: 23876 - DNA, 15 bp, Homo sapiens
gtgaataacaaacac

SEQ ID NO: 23877 - DNA, 15 bp, Homo sapiens
agtgaataacaaaca

SEQ ID NO: 23878 - DNA, 15 bp, Homo sapiens
cagtgaataacaaac

SEQ ID NO: 23879 - DNA, 15 bp, Homo sapiens
acagtgaataacaaa

SEQ ID NO: 23880 - DNA, 15 bp, Homo sapiens
tacagtgaataacaa

SEQ ID NO: 23881 - DNA, 15 bp, Homo sapiens
ctacagtgaataaca

SEQ ID NO: 23882 - DNA, 15 bp, Homo sapiens
gctacagtgaataac

SEQ ID NO: 23883 - DNA, 15 bp, Homo sapiens
ggctacagtgaataa

SEQ ID NO: 23884 - DNA, 15 bp, Homo sapiens
tggctacagtgaata

SEQ ID NO: 23885 - DNA, 15 bp, Homo sapiens
ctggctacagtgaat

SEQ ID NO: 23886 - DNA, 15 bp, Homo sapiens
actggctacagtgaa

SEQ ID NO: 23887 - DNA, 15 bp, Homo sapiens
cactggctacagtga

SEQ ID NO: 23888 - DNA, 15 bp, Homo sapiens
ccactggctacagtg

SEQ ID NO: 23889 - DNA, 15 bp, Homo sapiens
accactggctacagt

SEQ ID NO: 23890 - DNA, 15 bp, Homo sapiens
caccactggctacag

SEQ ID NO: 23891 - DNA, 15 bp, Homo sapiens
ccaccactggctaca

SEQ ID NO: 23892 - DNA, 15 bp, Homo sapiens
tccaccactggctac

SEQ ID NO: 23893 - DNA, 15 bp, Homo sapiens
ttccaccactggcta

SEQ ID NO: 23894 - DNA, 15 bp, Homo sapiens
cttccaccactggct

SEQ ID NO: 23895 - DNA, 15 bp, Homo sapiens
tcttccaccactggc

SEQ ID NO: 23896 - DNA, 15 bp, Homo sapiens
ttcttccaccactgg

SEQ ID NO: 23897 - DNA, 15 bp, Homo sapiens
attcttccaccactg

SEQ ID NO: 23898 - DNA, 15 bp, Homo sapiens
aattcttccaccact

SEQ ID NO: 23899 - DNA, 15 bp, Homo sapiens
caattcttccaccac

SEQ ID NO: 23900 - DNA, 15 bp, Homo sapiens
tcaattcttccacca

SEQ ID NO: 23901 - DNA, 15 bp, Homo sapiens
ttcaattcttccacc

SEQ ID NO: 23902 - DNA, 15 bp, Homo sapiens
attcaattcttccac

SEQ ID NO: 23903 - DNA, 15 bp, Homo sapiens
aattcaattcttcca

SEQ ID NO: 23904 - DNA, 15 bp, Homo sapiens
taattcaattcttcc

SEQ ID NO: 23905 - DNA, 15 bp, Homo sapiens
ttaattcaattcttc

SEQ ID NO: 23906 - DNA, 15 bp, Homo sapiens
cttaattcaattctt

SEQ ID NO: 23907 - DNA, 15 bp, Homo sapiens
tcttaattcaattct

SEQ ID NO: 23908 - DNA, 15 bp, Homo sapiens
ttcttaattcaattc

SEQ ID NO: 23909 - DNA, 15 bp, Homo sapiens
attcttaattcaatt

SEQ ID NO: 23910 - DNA, 15 bp, Homo sapiens
aattcttaattcaat

SEQ ID NO: 23911 - DNA, 15 bp, Homo sapiens
aaattcttaattcaa

SEQ ID NO: 23912 - DNA, 15 bp, Homo sapiens
gaaattcttaattca

SEQ ID NO: 23913 - DNA, 15 bp, Homo sapiens
agaaattcttaattc

SEQ ID NO: 23914 - DNA, 15 bp, Homo sapiens
cagaaattcttaatt

SEQ ID NO: 23915 - DNA, 15 bp, Homo sapiens
ccagaaattcttaat

SEQ ID NO: 23916 - DNA, 15 bp, Homo sapiens
accagaaattcttaa

SEQ ID NO: 23917 - DNA, 15 bp, Homo sapiens
gaccagaaattctta

SEQ ID NO: 23918 - DNA, 15 bp, Homo sapiens
agaccagaaattctt

SEQ ID NO: 23919 - DNA, 15 bp, Homo sapiens
aagaccagaaattct

SEQ ID NO: 23920 - DNA, 15 bp, Homo sapiens
aaagaccagaaattc

SEQ ID NO: 23921 - DNA, 15 bp, Homo sapiens
aaaagaccagaaatt

SEQ ID NO: 23922 - DNA, 15 bp, Homo sapiens
aaaaagaccagaaat

SEQ ID NO: 23923 - DNA, 15 bp, Homo sapiens
taaaaagaccagaaa

SEQ ID NO: 23924 - DNA, 15 bp, Homo sapiens
gtaaaaagaccagaa

SEQ ID NO: 23925 - DNA, 15 bp, Homo sapiens
agtaaaaagaccaga

SEQ ID NO: 23926 - DNA, 15 bp, Homo sapiens
cagtaaaaagaccag

SEQ ID NO: 23927 - DNA, 15 bp, Homo sapiens
tcagtaaaaagacca

SEQ ID NO: 23928 - DNA, 15 bp, Homo sapiens
atcagtaaaaagacc

SEQ ID NO: 23929 - DNA, 15 bp, Homo sapiens
aatcagtaaaaagac

SEQ ID NO: 23930 - DNA, 15 bp, Homo sapiens
caatcagtaaaaaga

SEQ ID NO: 23931 - DNA, 15 bp, Homo sapiens
tcaatcagtaaaaag

SEQ ID NO: 23932 - DNA, 15 bp, Homo sapiens
atcaatcagtaaaaa

SEQ ID NO: 23933 - DNA, 15 bp, Homo sapiens
aatcaatcagtaaaa

SEQ ID NO: 23934 - DNA, 15 bp, Homo sapiens
aaatcaatcagtaaa

SEQ ID NO: 23935 - DNA, 15 bp, Homo sapiens
gaaatcaatcagtaa

SEQ ID NO: 23936 - DNA, 15 bp, Homo sapiens
agaaatcaatcagta

SEQ ID NO: 23937 - DNA, 15 bp, Homo sapiens
cagaaatcaatcagt

SEQ ID NO: 23938 - DNA, 15 bp, Homo sapiens
tcagaaatcaatcag

SEQ ID NO: 23939 - DNA, 15 bp, Homo sapiens
atcagaaatcaatca

SEQ ID NO: 23940 - DNA, 15 bp, Homo sapiens
tatcagaaatcaatc

SEQ ID NO: 23941 - DNA, 15 bp, Homo sapiens
gtatcagaaatcaat

SEQ ID NO: 23942 - DNA, 15 bp, Homo sapiens
ggtatcagaaatcaa

SEQ ID NO: 23943 - DNA, 15 bp, Homo sapiens
tggtatcagaaatca

SEQ ID NO: 23944 - DNA, 15 bp, Homo sapiens
ctggtatcagaaatc

SEQ ID NO: 23945 - DNA, 15 bp, Homo sapiens
tctggtatcagaaat

SEQ ID NO: 23946 - DNA, 15 bp, Homo sapiens
ctctggtatcagaaa

SEQ ID NO: 23947 - DNA, 15 bp, Homo sapiens
tctctggtatcagaa

SEQ ID NO: 23948 - DNA, 15 bp, Homo sapiens
atctctggtatcaga

SEQ ID NO: 23949 - DNA, 15 bp, Homo sapiens
catctctggtatcag

SEQ ID NO: 23950 - DNA, 15 bp, Homo sapiens
gcatctctggtatca

SEQ ID NO: 23951 - DNA, 15 bp, Homo sapiens
tgcatctctggtatc

SEQ ID NO: 23952 - DNA, 15 bp, Homo sapiens
atgcatctctggtat

SEQ ID NO: 23953 - DNA, 15 bp, Homo sapiens
aatgcatctctggta

SEQ ID NO: 23954 - DNA, 15 bp, Homo sapiens
gaatgcatctctggt

SEQ ID NO: 23955 - DNA, 15 bp, Homo sapiens
agaatgcatctctgg

SEQ ID NO: 23956 - DNA, 15 bp, Homo sapiens
gagaatgcatctctg

SEQ ID NO: 23957 - DNA, 15 bp, Homo sapiens
agagaatgcatctct

SEQ ID NO: 23958 - DNA, 15 bp, Homo sapiens
gagagaatgcatctc

SEQ ID NO: 23959 - DNA, 15 bp, Homo sapiens
agagagaatgcatct

SEQ ID NO: 23960 - DNA, 15 bp, Homo sapiens
aagagagaatgcatc

SEQ ID NO: 23961 - DNA, 15 bp, Homo sapiens
aaagagagaatgcat

SEQ ID NO: 23962 - DNA, 15 bp, Homo sapiens
aaaagagagaatgca

SEQ ID NO: 23963 - DNA, 15 bp, Homo sapiens
caaaagagagaatgc

SEQ ID NO: 23964 - DNA, 15 bp, Homo sapiens
acaaaagagagaatg

SEQ ID NO: 23965 - DNA, 15 bp, Homo sapiens
aacaaaagagagaat

SEQ ID NO: 23966 - DNA, 15 bp, Homo sapiens
aaacaaaagagagaa

SEQ ID NO: 23967 - DNA, 15 bp, Homo sapiens
aaaacaaaagagaga

SEQ ID NO: 23968 - DNA, 15 bp, Homo sapiens
aaaaacaaaagagag

SEQ ID NO: 23969 - DNA, 15 bp, Homo sapiens
caaaaacaaaagaga

SEQ ID NO: 23970 - DNA, 15 bp, Homo sapiens
acaaaaacaaaagag

SEQ ID NO: 23971 - DNA, 15 bp, Homo sapiens
gacaaaaacaaaaga

SEQ ID NO: 23972 - DNA, 15 bp, Homo sapiens
agacaaaaacaaaag

SEQ ID NO: 23973 - DNA, 15 bp, Homo sapiens
tagacaaaaacaaaa

SEQ ID NO: 23974 - DNA, 15 bp, Homo sapiens
ttagacaaaaacaaa

SEQ ID NO: 23975 - DNA, 15 bp, Homo sapiens
attagacaaaaacaa

SEQ ID NO: 23976 - DNA, 15 bp, Homo sapiens
tattagacaaaaaca

SEQ ID NO: 23977 - DNA, 15 bp, Homo sapiens
atattagacaaaaac

SEQ ID NO: 23978 - DNA, 15 bp, Homo sapiens
aatattagacaaaaa

SEQ ID NO: 23979 - DNA, 15 bp, Homo sapiens
caatattagacaaaa

SEQ ID NO: 23980 - DNA, 15 bp, Homo sapiens
ccaatattagacaaa

SEQ ID NO: 23981 - DNA, 15 bp, Homo sapiens
gccaatattagacaa

SEQ ID NO: 23982 - DNA, 15 bp, Homo sapiens
agccaatattagaca

SEQ ID NO: 23983 - DNA, 15 bp, Homo sapiens
gagccaatattagac

SEQ ID NO: 23984 - DNA, 15 bp, Homo sapiens
agagccaatattaga

SEQ ID NO: 23985 - DNA, 15 bp, Homo sapiens
cagagccaatattag

SEQ ID NO: 23986 - DNA, 15 bp, Homo sapiens
ccagagccaatatta

SEQ ID NO: 23987 - DNA, 15 bp, Homo sapiens
gccagagccaatatt

SEQ ID NO: 23988 - DNA, 15 bp, Homo sapiens
tgccagagccaatat

SEQ ID NO: 23989 - DNA, 15 bp, Homo sapiens
atgccagagccaata

SEQ ID NO: 23990 - DNA, 15 bp, Homo sapiens
gatgccagagccaat

SEQ ID NO: 23991 - DNA, 15 bp, Homo sapiens
tgatgccagagccaa

SEQ ID NO: 23992 - DNA, 15 bp, Homo sapiens
ttgatgccagagcca

SEQ ID NO: 23993 - DNA, 15 bp, Homo sapiens
tttgatgccagagcc

SEQ ID NO: 23994 - DNA, 15 bp, Homo sapiens
atttgatgccagagc

SEQ ID NO: 23995 - DNA, 15 bp, Homo sapiens
aatttgatgccagag

SEQ ID NO: 23996 - DNA, 15 bp, Homo sapiens
caatttgatgccaga

SEQ ID NO: 23997 - DNA, 15 bp, Homo sapiens
acaatttgatgccag

SEQ ID NO: 23998 - DNA, 15 bp, Homo sapiens
aacaatttgatgcca

SEQ ID NO: 23999 - DNA, 15 bp, Homo sapiens
aaacaatttgatgcc

SEQ ID NO: 24000 - DNA, 15 bp, Homo sapiens
caaacaatttgatgc

SEQ ID NO: 24001 - DNA, 15 bp, Homo sapiens
ccaaacaatttgatg

SEQ ID NO: 24002 - DNA, 15 bp, Homo sapiens
tccaaacaatttgat

SEQ ID NO: 24003 - DNA, 15 bp, Homo sapiens
ttccaaacaatttga

SEQ ID NO: 24004 - DNA, 15 bp, Homo sapiens
attccaaacaatttg

SEQ ID NO: 24005 - DNA, 15 bp, Homo sapiens
aattccaaacaattt

SEQ ID NO: 24006 - DNA, 15 bp, Homo sapiens
aaattccaaacaatt

SEQ ID NO: 24007 - DNA, 15 bp, Homo sapiens
aaaattccaaacaat

SEQ ID NO: 24008 - DNA, 15 bp, Homo sapiens
aaaaattccaaacaa

SEQ ID NO: 24009 - DNA, 15 bp, Homo sapiens
aaaaaattccaaaca

SEQ ID NO: 24010 - DNA, 15 bp, Homo sapiens
gaaaaaattccaaac

SEQ ID NO: 24011 - DNA, 15 bp, Homo sapiens
ggaaaaaattccaaa

SEQ ID NO: 24012 - DNA, 15 bp, Homo sapiens
tggaaaaaattccaa

SEQ ID NO: 24013 - DNA, 15 bp, Homo sapiens
ctggaaaaaattcca

SEQ ID NO: 24014 - DNA, 15 bp, Homo sapiens
actggaaaaaattcc

SEQ ID NO: 24015 - DNA, 15 bp, Homo sapiens
tactggaaaaaattc

SEQ ID NO: 24016 - DNA, 15 bp, Homo sapiens
atactggaaaaaatt

SEQ ID NO: 24017 - DNA, 15 bp, Homo sapiens
catactggaaaaaat

SEQ ID NO: 24018 - DNA, 15 bp, Homo sapiens
acatactggaaaaaa

SEQ ID NO: 24019 - DNA, 15 bp, Homo sapiens
aacatactggaaaaa

SEQ ID NO: 24020 - DNA, 15 bp, Homo sapiens
caacatactggaaaa

SEQ ID NO: 24021 - DNA, 15 bp, Homo sapiens
acaacatactggaaa

SEQ ID NO: 24022 - DNA, 15 bp, Homo sapiens
gacaacatactggaa

SEQ ID NO: 24023 - DNA, 15 bp, Homo sapiens
ggacaacatactgga

SEQ ID NO: 24024 - DNA, 15 bp, Homo sapiens
gggacaacatactgg

SEQ ID NO: 24025 - DNA, 15 bp, Homo sapiens
tgggacaacatactg

SEQ ID NO: 24026 - DNA, 15 bp, Homo sapiens
ctgggacaacatact

SEQ ID NO: 24027 - DNA, 15 bp, Homo sapiens
tctgggacaacatac

SEQ ID NO: 24028 - DNA, 15 bp, Homo sapiens
ttctgggacaacata

SEQ ID NO: 24029 - DNA, 15 bp, Homo sapiens
tttctgggacaacat

SEQ ID NO: 24030 - DNA, 15 bp, Homo sapiens
atttctgggacaaca

SEQ ID NO: 24031 - DNA, 15 bp, Homo sapiens
aatttctgggacaac

SEQ ID NO: 24032 - DNA, 15 bp, Homo sapiens
gaatttctgggacaa

SEQ ID NO: 24033 - DNA, 15 bp, Homo sapiens
agaatttctgggaca

SEQ ID NO: 24034 - DNA, 15 bp, Homo sapiens
cagaatttctgggac

SEQ ID NO: 24035 - DNA, 15 bp, Homo sapiens
acagaatttctggga

SEQ ID NO: 24036 - DNA, 15 bp, Homo sapiens
aacagaatttctggg

SEQ ID NO: 24037 - DNA, 15 bp, Homo sapiens
aaacagaatttctgg

SEQ ID NO: 24038 - DNA, 15 bp, Homo sapiens
aaaacagaatttctg

SEQ ID NO: 24039 - DNA, 15 bp, Homo sapiens
gaaaacagaatttct

SEQ ID NO: 24040 - DNA, 15 bp, Homo sapiens
tgaaaacagaatttc

SEQ ID NO: 24041 - DNA, 15 bp, Homo sapiens
atgaaaacagaattt

SEQ ID NO: 24042 - DNA, 15 bp, Homo sapiens
aatgaaaacagaatt

SEQ ID NO: 24043 - DNA, 15 bp, Homo sapiens
taatgaaaacagaat

SEQ ID NO: 24044 - DNA, 15 bp, Homo sapiens
ataatgaaaacagaa

SEQ ID NO: 24045 - DNA, 15 bp, Homo sapiens
aataatgaaaacaga

SEQ ID NO: 24046 - DNA, 15 bp, Homo sapiens
taataatgaaaacag

SEQ ID NO: 24047 - DNA, 15 bp, Homo sapiens
ttaataatgaaaaca

SEQ ID NO: 24048 - DNA, 15 bp, Homo sapiens
tttaataatgaaaac

SEQ ID NO: 24049 - DNA, 15 bp, Homo sapiens
gtttaataatgaaaa

SEQ ID NO: 24050 - DNA, 15 bp, Homo sapiens
tgtttaataatgaaa

SEQ ID NO: 24051 - DNA, 15 bp, Homo sapiens
ttgtttaataatgaa

SEQ ID NO: 24052 - DNA, 15 bp, Homo sapiens
attgtttaataatga

SEQ ID NO: 24053 - DNA, 15 bp, Homo sapiens
aattgtttaataatg

SEQ ID NO: 24054 - DNA, 15 bp, Homo sapiens
caattgtttaataat

SEQ ID NO: 24055 - DNA, 15 bp, Homo sapiens
gcaattgtttaataa

SEQ ID NO: 24056 - DNA, 15 bp, Homo sapiens
cgcaattgtttaata

SEQ ID NO: 24057 - DNA, 15 bp, Homo sapiens
ccgcaattgtttaat

SEQ ID NO: 24058 - DNA, 15 bp, Homo sapiens
cccgcaattgtttaa

SEQ ID NO: 24059 - DNA, 15 bp, Homo sapiens
ccccgcaattgttta

SEQ ID NO: 24060 - DNA, 15 bp, Homo sapiens
cccccgcaattgttt

SEQ ID NO: 24061 - DNA, 15 bp, Homo sapiens
ccccccgcaattgtt

SEQ ID NO: 24062 - DNA, 15 bp, Homo sapiens
cccccccgcaattgt

SEQ ID NO: 24063 - DNA, 15 bp, Homo sapiens
gcccccccgcaattg

SEQ ID NO: 24064 - DNA, 15 bp, Homo sapiens
tgcccccccgcaatt

SEQ ID NO: 24065 - DNA, 15 bp, Homo sapiens
ctgcccccccgcaat

SEQ ID NO: 24066 - DNA, 15 bp, Homo sapiens
cctgcccccccgcaa

SEQ ID NO: 24067 - DNA, 15 bp, Homo sapiens
ccctgcccccccgca

SEQ ID NO: 24068 - DNA, 15 bp, Homo sapiens
cccctgcccccccgc

SEQ ID NO: 24069 - DNA, 15 bp, Homo sapiens
ccccctgcccccccg

SEQ ID NO: 24070 - DNA, 15 bp, Homo sapiens
gccccctgccccccc

SEQ ID NO: 24071 - DNA, 15 bp, Homo sapiens
cgccccctgcccccc

SEQ ID NO: 24072 - DNA, 15 bp, Homo sapiens
ccgccccctgccccc

SEQ ID NO: 24073 - DNA, 15 bp, Homo sapiens
cccgccccctgcccc

SEQ ID NO: 24074 - DNA, 15 bp, Homo sapiens
tcccgccccctgccc

SEQ ID NO: 24075 - DNA, 15 bp, Homo sapiens
ctcccgccccctgcc

SEQ ID NO: 24076 - DNA, 15 bp, Homo sapiens
cctcccgccccctgc

SEQ ID NO: 24077 - DNA, 15 bp, Homo sapiens
tcctcccgccccctg

SEQ ID NO: 24078 - DNA, 15 bp, Homo sapiens
ttcctcccgccccct

SEQ ID NO: 24079 - DNA, 15 bp, Homo sapiens
attcctcccgccccc

SEQ ID NO: 24080 - DNA, 15 bp, Homo sapiens
gattcctcccgcccc

SEQ ID NO: 24081 - DNA, 15 bp, Homo sapiens
tgattcctcccgccc

SEQ ID NO: 24082 - DNA, 15 bp, Homo sapiens
ttgattcctcccgcc

SEQ ID NO: 24083 - DNA, 15 bp, Homo sapiens
attgattcctcccgc

SEQ ID NO: 24084 - DNA, 15 bp, Homo sapiens
tattgattcctcccg

SEQ ID NO: 24085 - DNA, 15 bp, Homo sapiens
ctattgattcctccc

SEQ ID NO: 24086 - DNA, 15 bp, Homo sapiens
actattgattcctcc

SEQ ID NO: 24087 - DNA, 15 bp, Homo sapiens
cactattgattcctc

SEQ ID NO: 24088 - DNA, 15 bp, Homo sapiens
ccactattgattcct

SEQ ID NO: 24089 - DNA, 15 bp, Homo sapiens
gccactattgattcc

SEQ ID NO: 24090 - DNA, 15 bp, Homo sapiens
cgccactattgattc

SEQ ID NO: 24091 - DNA, 15 bp, Homo sapiens
tcgccactattgatt

SEQ ID NO: 24092 - DNA, 15 bp, Homo sapiens
gtcgccactattgat

SEQ ID NO: 24093 - DNA, 15 bp, Homo sapiens
ggtcgccactattga

SEQ ID NO: 24094 - DNA, 15 bp, Homo sapiens
tggtcgccactattg

SEQ ID NO: 24095 - DNA, 15 bp, Homo sapiens
atggtcgccactatt

SEQ ID NO: 24096 - DNA, 15 bp, Homo sapiens
tatggtcgccactat

SEQ ID NO: 24097 - DNA, 15 bp, Homo sapiens
gtatggtcgccacta

SEQ ID NO: 24098 - DNA, 15 bp, Homo sapiens
ggtatggtcgccact

SEQ ID NO: 24099 - DNA, 15 bp, Homo sapiens
gggtatggtcgccac

SEQ ID NO: 24100 - DNA, 15 bp, Homo sapiens
agggtatggtcgcca

SEQ ID NO: 24101 - DNA, 15 bp, Homo sapiens
cagggtatggtcgcc

SEQ ID NO: 24102 - DNA, 15 bp, Homo sapiens
gcagggtatggtcgc

SEQ ID NO: 24103 - DNA, 15 bp, Homo sapiens
agcagggtatggtcg

SEQ ID NO: 24104 - DNA, 15 bp, Homo sapiens
gagcagggtatggtc

SEQ ID NO: 24105 - DNA, 15 bp, Homo sapiens
agagcagggtatggt

SEQ ID NO: 24106 - DNA, 15 bp, Homo sapiens
tagagcagggtatgg

SEQ ID NO: 24107 - DNA, 15 bp, Homo sapiens
ttagagcagggtatg

SEQ ID NO: 24108 - DNA, 15 bp, Homo sapiens
cttagagcagggtat

SEQ ID NO: 24109 - DNA, 15 bp, Homo sapiens
tcttagagcagggta

SEQ ID NO: 24110 - DNA, 15 bp, Homo sapiens
ctcttagagcagggt

SEQ ID NO: 24111 - DNA, 15 bp, Homo sapiens
actcttagagcaggg

SEQ ID NO: 24112 - DNA, 15 bp, Homo sapiens
cactcttagagcagg

SEQ ID NO: 24113 - DNA, 15 bp, Homo sapiens
acactcttagagcag

SEQ ID NO: 24114 - DNA, 15 bp, Homo sapiens
aacactcttagagca

SEQ ID NO: 24115 - DNA, 15 bp, Homo sapiens
aaacactcttagagc

SEQ ID NO: 24116 - DNA, 15 bp, Homo sapiens
aaaacactcttagag

SEQ ID NO: 24117 - DNA, 15 bp, Homo sapiens
gaaaacactcttaga

SEQ ID NO: 24118 - DNA, 15 bp, Homo sapiens
agaaaacactcttag

SEQ ID NO: 24119 - DNA, 15 bp, Homo sapiens
gagaaaacactctta

SEQ ID NO: 24120 - DNA, 15 bp, Homo sapiens
agagaaaacactctt

SEQ ID NO: 24121 - DNA, 15 bp, Homo sapiens
aagagaaaacactct

SEQ ID NO: 24122 - DNA, 15 bp, Homo sapiens
aaagagaaaacactc

SEQ ID NO: 24123 - DNA, 15 bp, Homo sapiens
caaagagaaaacact

SEQ ID NO: 24124 - DNA, 15 bp, Homo sapiens
ccaaagagaaaacac

SEQ ID NO: 24125 - DNA, 15 bp, Homo sapiens
cccaaagagaaaaca

SEQ ID NO: 24126 - DNA, 15 bp, Homo sapiens
gcccaaagagaaaac

SEQ ID NO: 24127 - DNA, 15 bp, Homo sapiens
tgcccaaagagaaaa

SEQ ID NO: 24128 - DNA, 15 bp, Homo sapiens
ctgcccaaagagaaa

SEQ ID NO: 24129 - DNA, 15 bp, Homo sapiens
cctgcccaaagagaa

SEQ ID NO: 24130 - DNA, 15 bp, Homo sapiens
gcctgcccaaagaga

SEQ ID NO: 24131 - DNA, 15 bp, Homo sapiens
tgcctgcccaaagag

SEQ ID NO: 24132 - DNA, 15 bp, Homo sapiens
atgcctgcccaaaga

SEQ ID NO: 24133 - DNA, 15 bp, Homo sapiens
tatgcctgcccaaag

SEQ ID NO: 24134 - DNA, 15 bp, Homo sapiens
ttatgcctgcccaaa

SEQ ID NO: 24135 - DNA, 15 bp, Homo sapiens
tttatgcctgcccaa

SEQ ID NO: 24136 - DNA, 15 bp, Homo sapiens
ctttatgcctgccca

SEQ ID NO: 24137 - DNA, 15 bp, Homo sapiens
tctttatgcctgccc

SEQ ID NO: 24138 - DNA, 15 bp, Homo sapiens
atctttatgcctgcc

SEQ ID NO: 24139 - DNA, 15 bp, Homo sapiens
catctttatgcctgc

SEQ ID NO: 24140 - DNA, 15 bp, Homo sapiens
tcatctttatgcctg

SEQ ID NO: 24141 - DNA, 15 bp, Homo sapiens
atcatctttatgcct

SEQ ID NO: 24142 - DNA, 15 bp, Homo sapiens
tatcatctttatgcc

SEQ ID NO: 24143 - DNA, 15 bp, Homo sapiens
ttatcatctttatgc

SEQ ID NO: 24144 - DNA, 15 bp, Homo sapiens
tttatcatctttatg

SEQ ID NO: 24145 - DNA, 15 bp, Homo sapiens
gtttatcatctttat

SEQ ID NO: 24146 - DNA, 15 bp, Homo sapiens
ggtttatcatcttta

SEQ ID NO: 24147 - DNA, 15 bp, Homo sapiens
tggtttatcatcttt

SEQ ID NO: 24148 - DNA, 15 bp, Homo sapiens
ctggtttatcatctt

SEQ ID NO: 24149 - DNA, 15 bp, Homo sapiens
actggtttatcatct

SEQ ID NO: 24150 - DNA, 15 bp, Homo sapiens
cactggtttatcatc

SEQ ID NO: 24151 - DNA, 15 bp, Homo sapiens
tcactggtttatcat

SEQ ID NO: 24152 - DNA, 15 bp, Homo sapiens
ttcactggtttatca

SEQ ID NO: 24153 - DNA, 15 bp, Homo sapiens
attcactggtttatc

SEQ ID NO: 24154 - DNA, 15 bp, Homo sapiens
aattcactggtttat

SEQ ID NO: 24155 - DNA, 15 bp, Homo sapiens
caattcactggttta

SEQ ID NO: 24156 - DNA, 15 bp, Homo sapiens
acaattcactggttt

SEQ ID NO: 24157 - DNA, 15 bp, Homo sapiens
gacaattcactggtt

SEQ ID NO: 24158 - DNA, 15 bp, Homo sapiens
tgacaattcactggt

SEQ ID NO: 24159 - DNA, 15 bp, Homo sapiens
gtgacaattcactgg

SEQ ID NO: 24160 - DNA, 15 bp, Homo sapiens
ggtgacaattcactg

SEQ ID NO: 24161 - DNA, 15 bp, Homo sapiens
tggtgacaattcact

SEQ ID NO: 24162 - DNA, 15 bp, Homo sapiens
ctggtgacaattcac

SEQ ID NO: 24163 - DNA, 15 bp, Homo sapiens
actggtgacaattca

SEQ ID NO: 24164 - DNA, 15 bp, Homo sapiens
tactggtgacaattc

SEQ ID NO: 24165 - DNA, 15 bp, Homo sapiens
atactggtgacaatt

SEQ ID NO: 24166 - DNA, 15 bp, Homo sapiens
catactggtgacaat

SEQ ID NO: 24167 - DNA, 15 bp, Homo sapiens
tcatactggtgacaa

SEQ ID NO: 24168 - DNA, 15 bp, Homo sapiens
atcatactggtgaca

SEQ ID NO: 24169 - DNA, 15 bp, Homo sapiens
catcatactggtgac

SEQ ID NO: 24170 - DNA, 15 bp, Homo sapiens
ccatcatactggtga

SEQ ID NO: 24171 - DNA, 15 bp, Homo sapiens
accatcatactggtg

SEQ ID NO: 24172 - DNA, 15 bp, Homo sapiens
gaccatcatactggt

SEQ ID NO: 24173 - DNA, 15 bp, Homo sapiens
agaccatcatactgg

SEQ ID NO: 24174 - DNA, 15 bp, Homo sapiens
cagaccatcatactg

SEQ ID NO: 24175 - DNA, 15 bp, Homo sapiens
ccagaccatcatact

SEQ ID NO: 24176 - DNA, 15 bp, Homo sapiens
accagaccatcatac

SEQ ID NO: 24177 - DNA, 15 bp, Homo sapiens
taccagaccatcata

SEQ ID NO: 24178 - DNA, 15 bp, Homo sapiens
ctaccagaccatcat

SEQ ID NO: 24179 - DNA, 15 bp, Homo sapiens
tctaccagaccatca

SEQ ID NO: 24180 - DNA, 15 bp, Homo sapiens
ttctaccagaccatc

SEQ ID NO: 24181 - DNA, 15 bp, Homo sapiens
attctaccagaccat

SEQ ID NO: 24182 - DNA, 15 bp, Homo sapiens
aattctaccagacca

SEQ ID NO: 24183 - DNA, 15 bp, Homo sapiens
taattctaccagacc

SEQ ID NO: 24184 - DNA, 15 bp, Homo sapiens
ctaattctaccagac

SEQ ID NO: 24185 - DNA, 15 bp, Homo sapiens
gctaattctaccaga

SEQ ID NO: 24186 - DNA, 15 bp, Homo sapiens
tgctaattctaccag

SEQ ID NO: 24187 - DNA, 15 bp, Homo sapiens
ttgctaattctacca

SEQ ID NO: 24188 - DNA, 15 bp, Homo sapiens
gttgctaattctacc

SEQ ID NO: 24189 - DNA, 15 bp, Homo sapiens
tgttgctaattctac

SEQ ID NO: 24190 - DNA, 15 bp, Homo sapiens
ttgttgctaattcta

SEQ ID NO: 24191 - DNA, 15 bp, Homo sapiens
attgttgctaattct

SEQ ID NO: 24192 - DNA, 15 bp, Homo sapiens
aattgttgctaattc

SEQ ID NO: 24193 - DNA, 15 bp, Homo sapiens
aaattgttgctaatt

SEQ ID NO: 24194 - DNA, 15 bp, Homo sapiens
caaattgttgctaat

SEQ ID NO: 24195 - DNA, 15 bp, Homo sapiens
acaaattgttgctaa

SEQ ID NO: 24196 - DNA, 15 bp, Homo sapiens
cacaaattgttgcta

SEQ ID NO: 24197 - DNA, 15 bp, Homo sapiens
gcacaaattgttgct

SEQ ID NO: 24198 - DNA, 15 bp, Homo sapiens
agcacaaattgttgc

SEQ ID NO: 24199 - DNA, 15 bp, Homo sapiens
gagcacaaattgttg

SEQ ID NO: 24200 - DNA, 15 bp, Homo sapiens
agagcacaaattgtt

SEQ ID NO: 24201 - DNA, 15 bp, Homo sapiens
aagagcacaaattgt

SEQ ID NO: 24202 - DNA, 15 bp, Homo sapiens
aaagagcacaaattg

SEQ ID NO: 24203 - DNA, 15 bp, Homo sapiens
caaagagcacaaatt

SEQ ID NO: 24204 - DNA, 15 bp, Homo sapiens
acaaagagcacaaat

SEQ ID NO: 24205 - DNA, 15 bp, Homo sapiens
tacaaagagcacaaa

SEQ ID NO: 24206 - DNA, 15 bp, Homo sapiens
ttacaaagagcacaa

SEQ ID NO: 24207 - DNA, 15 bp, Homo sapiens
attacaaagagcaca

SEQ ID NO: 24208 - DNA, 15 bp, Homo sapiens
cattacaaagagcac

SEQ ID NO: 24209 - DNA, 15 bp, Homo sapiens
tcattacaaagagca

SEQ ID NO: 24210 - DNA, 15 bp, Homo sapiens
gtcattacaaagagc

SEQ ID NO: 24211 - DNA, 15 bp, Homo sapiens
agtcattacaaagag

SEQ ID NO: 24212 - DNA, 15 bp, Homo sapiens
gagtcattacaaaga

SEQ ID NO: 24213 - DNA, 15 bp, Homo sapiens
agagtcattacaaag

SEQ ID NO: 24214 - DNA, 15 bp, Homo sapiens
cagagtcattacaaa

SEQ ID NO: 24215 - DNA, 15 bp, Homo sapiens
gcagagtcattacaa

SEQ ID NO: 24216 - DNA, 15 bp, Homo sapiens
agcagagtcattaca

SEQ ID NO: 24217 - DNA, 15 bp, Homo sapiens
aagcagagtcattac

SEQ ID NO: 24218 - DNA, 15 bp, Homo sapiens
aaagcagagtcatta

SEQ ID NO: 24219 - DNA, 15 bp, Homo sapiens
caaagcagagtcatt

SEQ ID NO: 24220 - DNA, 15 bp, Homo sapiens
ccaaagcagagtcat

SEQ ID NO: 24221 - DNA, 15 bp, Homo sapiens
tccaaagcagagtca

SEQ ID NO: 24222 - DNA, 15 bp, Homo sapiens
atccaaagcagagtc

SEQ ID NO: 24223 - DNA, 15 bp, Homo sapiens
aatccaaagcagagt

SEQ ID NO: 24224 - DNA, 15 bp, Homo sapiens
taatccaaagcagag

SEQ ID NO: 24225 - DNA, 15 bp, Homo sapiens
gtaatccaaagcaga

SEQ ID NO: 24226 - DNA, 15 bp, Homo sapiens
tgtaatccaaagcag

SEQ ID NO: 24227 - DNA, 15 bp, Homo sapiens
ttgtaatccaaagca

SEQ ID NO: 24228 - DNA, 15 bp, Homo sapiens
attgtaatccaaagc

SEQ ID NO: 24229 - DNA, 15 bp, Homo sapiens
cattgtaatccaaag

SEQ ID NO: 24230 - DNA, 15 bp, Homo sapiens
tcattgtaatccaaa

SEQ ID NO: 24231 - DNA, 15 bp, Homo sapiens
ctcattgtaatccaa

SEQ ID NO: 24232 - DNA, 15 bp, Homo sapiens
cctcattgtaatcca

SEQ ID NO: 24233 - DNA, 15 bp, Homo sapiens
acctcattgtaatcc

SEQ ID NO: 24234 - DNA, 15 bp, Homo sapiens
tacctcattgtaatc

SEQ ID NO: 24235 - DNA, 15 bp, Homo sapiens
ttacctcattgtaat

SEQ ID NO: 24236 - DNA, 15 bp, Homo sapiens
cttacctcattgtaa

SEQ ID NO: 24237 - DNA, 15 bp, Homo sapiens
acttacctcattgta

SEQ ID NO: 24238 - DNA, 15 bp, Homo sapiens
gacttacctcattgt

SEQ ID NO: 24239 - DNA, 15 bp, Homo sapiens
agacttacctcattg

SEQ ID NO: 24240 - DNA, 15 bp, Homo sapiens
gagacttacctcatt

SEQ ID NO: 24241 - DNA, 15 bp, Homo sapiens
agagacttacctcat

SEQ ID NO: 24242 - DNA, 15 bp, Homo sapiens
aagagacttacctca

SEQ ID NO: 24243 - DNA, 15 bp, Homo sapiens
gaagagacttacctc

SEQ ID NO: 24244 - DNA, 15 bp, Homo sapiens
tgaagagacttacct

SEQ ID NO: 24245 - DNA, 15 bp, Homo sapiens
atgaagagacttacc

SEQ ID NO: 24246 - DNA, 15 bp, Homo sapiens
tatgaagagacttac

SEQ ID NO: 24247 - DNA, 15 bp, Homo sapiens
ttatgaagagactta

SEQ ID NO: 24248 - DNA, 15 bp, Homo sapiens
tttatgaagagactt

SEQ ID NO: 24249 - DNA, 15 bp, Homo sapiens
atttatgaagagact

SEQ ID NO: 24250 - DNA, 15 bp, Homo sapiens
aatttatgaagagac

SEQ ID NO: 24251 - DNA, 15 bp, Homo sapiens
taatttatgaagaga

SEQ ID NO: 24252 - DNA, 15 bp, Homo sapiens
ctaatttatgaagag

SEQ ID NO: 24253 - DNA, 15 bp, Homo sapiens
tctaatttatgaaga

SEQ ID NO: 24254 - DNA, 15 bp, Homo sapiens
ttctaatttatgaag

SEQ ID NO: 24255 - DNA, 15 bp, Homo sapiens
cttctaatttatgaa

SEQ ID NO: 24256 - DNA, 15 bp, Homo sapiens
ccttctaatttatga

SEQ ID NO: 24257 - DNA, 15 bp, Homo sapiens
tccttctaatttatg

SEQ ID NO: 24258 - DNA, 15 bp, Homo sapiens
ttccttctaatttat

SEQ ID NO: 24259 - DNA, 15 bp, Homo sapiens
attccttctaattta

SEQ ID NO: 24260 - DNA, 15 bp, Homo sapiens
cattccttctaattt

SEQ ID NO: 24261 - DNA, 15 bp, Homo sapiens
ccattccttctaatt

SEQ ID NO: 24262 - DNA, 15 bp, Homo sapiens
gccattccttctaat

SEQ ID NO: 24263 - DNA, 15 bp, Homo sapiens
agccattccttctaa

SEQ ID NO: 24264 - DNA, 15 bp, Homo sapiens
cagccattccttcta

SEQ ID NO: 24265 - DNA, 15 bp, Homo sapiens
acagccattccttct

SEQ ID NO: 24266 - DNA, 15 bp, Homo sapiens
aacagccattccttc

SEQ ID NO: 24267 - DNA, 15 bp, Homo sapiens
gaacagccattcctt

SEQ ID NO: 24268 - DNA, 15 bp, Homo sapiens
ggaacagccattcct

SEQ ID NO: 24269 - DNA, 15 bp, Homo sapiens
aggaacagccattcc

SEQ ID NO: 24270 - DNA, 15 bp, Homo sapiens
taggaacagccattc

SEQ ID NO: 24271 - DNA, 15 bp, Homo sapiens
ctaggaacagccatt

SEQ ID NO: 24272 - DNA, 15 bp, Homo sapiens
actaggaacagccat

SEQ ID NO: 24273 - DNA, 15 bp, Homo sapiens
aactaggaacagcca

SEQ ID NO: 24274 - DNA, 15 bp, Homo sapiens
gaactaggaacagcc

SEQ ID NO: 24275 - DNA, 15 bp, Homo sapiens
tgaactaggaacagc

SEQ ID NO: 24276 - DNA, 15 bp, Homo sapiens
ttgaactaggaacag

SEQ ID NO: 24277 - DNA, 15 bp, Homo sapiens
cttgaactaggaaca

SEQ ID NO: 24278 - DNA, 15 bp, Homo sapiens
ccttgaactaggaac

SEQ ID NO: 24279 - DNA, 15 bp, Homo sapiens
cccttgaactaggaa

SEQ ID NO: 24280 - DNA, 15 bp, Homo sapiens
acccttgaactagga

SEQ ID NO: 24281 - DNA, 15 bp, Homo sapiens
cacccttgaactagg

SEQ ID NO: 24282 - DNA, 15 bp, Homo sapiens
ccacccttgaactag

SEQ ID NO: 24283 - DNA, 15 bp, Homo sapiens
cccacccttgaacta

SEQ ID NO: 24284 - DNA, 15 bp, Homo sapiens
ccccacccttgaact

SEQ ID NO: 24285 - DNA, 15 bp, Homo sapiens
accccacccttgaac

SEQ ID NO: 24286 - DNA, 15 bp, Homo sapiens
caccccacccttgaa

SEQ ID NO: 24287 - DNA, 15 bp, Homo sapiens
ccaccccacccttga

SEQ ID NO: 24288 - DNA, 15 bp, Homo sapiens
cccaccccacccttg

SEQ ID NO: 24289 - DNA, 15 bp, Homo sapiens
acccaccccaccctt

SEQ ID NO: 24290 - DNA, 15 bp, Homo sapiens
cacccaccccaccct

SEQ ID NO: 24291 - DNA, 15 bp, Homo sapiens
ccacccaccccaccc

SEQ ID NO: 24292 - DNA, 15 bp, Homo sapiens
tccacccaccccacc

SEQ ID NO: 24293 - DNA, 15 bp, Homo sapiens
ttccacccaccccac

SEQ ID NO: 24294 - DNA, 15 bp, Homo sapiens
attccacccacccca

SEQ ID NO: 24295 - DNA, 15 bp, Homo sapiens
cattccacccacccc

SEQ ID NO: 24296 - DNA, 15 bp, Homo sapiens
tcattccacccaccc

SEQ ID NO: 24297 - DNA, 15 bp, Homo sapiens
ttcattccacccacc

SEQ ID NO: 24298 - DNA, 15 bp, Homo sapiens
tttcattccacccac

SEQ ID NO: 24299 - DNA, 15 bp, Homo sapiens
ctttcattccaccca

SEQ ID NO: 24300 - DNA, 15 bp, Homo sapiens
actttcattccaccc

SEQ ID NO: 24301 - DNA, 15 bp, Homo sapiens
gactttcattccacc

SEQ ID NO: 24302 - DNA, 15 bp, Homo sapiens
agactttcattccac

SEQ ID NO: 24303 - DNA, 15 bp, Homo sapiens
tagactttcattcca

SEQ ID NO: 24304 - DNA, 15 bp, Homo sapiens
ctagactttcattcc

SEQ ID NO: 24305 - DNA, 15 bp, Homo sapiens
gctagactttcattc

SEQ ID NO: 24306 - DNA, 15 bp, Homo sapiens
ggctagactttcatt

SEQ ID NO: 24307 - DNA, 15 bp, Homo sapiens
aggctagactttcat

SEQ ID NO: 24308 - DNA, 15 bp, Homo sapiens
caggctagactttca

SEQ ID NO: 24309 - DNA, 15 bp, Homo sapiens
gcaggctagactttc

SEQ ID NO: 24310 - DNA, 15 bp, Homo sapiens
ggcaggctagacttt

SEQ ID NO: 24311 - DNA, 15 bp, Homo sapiens
aggcaggctagactt

SEQ ID NO: 24312 - DNA, 15 bp, Homo sapiens
aaggcaggctagact

SEQ ID NO: 24313 - DNA, 15 bp, Homo sapiens
gaaggcaggctagac

SEQ ID NO: 24314 - DNA, 15 bp, Homo sapiens
ggaaggcaggctaga

SEQ ID NO: 24315 - DNA, 15 bp, Homo sapiens
aggaaggcaggctag

SEQ ID NO: 24316 - DNA, 15 bp, Homo sapiens
gaggaaggcaggcta

SEQ ID NO: 24317 - DNA, 15 bp, Homo sapiens
ggaggaaggcaggct

SEQ ID NO: 24318 - DNA, 15 bp, Homo sapiens
gggaggaaggcaggc

SEQ ID NO: 24319 - DNA, 15 bp, Homo sapiens
agggaggaaggcagg

SEQ ID NO: 24320 - DNA, 15 bp, Homo sapiens
aagggaggaaggcag

SEQ ID NO: 24321 - DNA, 15 bp, Homo sapiens
aaagggaggaaggca

SEQ ID NO: 24322 - DNA, 15 bp, Homo sapiens
aaaagggaggaaggc

SEQ ID NO: 24323 - DNA, 15 bp, Homo sapiens
caaaagggaggaagg

SEQ ID NO: 24324 - DNA, 15 bp, Homo sapiens
tcaaaagggaggaag

SEQ ID NO: 24325 - DNA, 15 bp, Homo sapiens
ttcaaaagggaggaa

SEQ ID NO: 24326 - DNA, 15 bp, Homo sapiens
tttcaaaagggagga

SEQ ID NO: 24327 - DNA, 15 bp, Homo sapiens
ctttcaaaagggagg

SEQ ID NO: 24328 - DNA, 15 bp, Homo sapiens
actttcaaaagggag

SEQ ID NO: 24329 - DNA, 15 bp, Homo sapiens
gactttcaaaaggga

SEQ ID NO: 24330 - DNA, 15 bp, Homo sapiens
tgactttcaaaaggg

SEQ ID NO: 24331 - DNA, 15 bp, Homo sapiens
ttgactttcaaaagg

SEQ ID NO: 24332 - DNA, 15 bp, Homo sapiens
cttgactttcaaaag

SEQ ID NO: 24333 - DNA, 15 bp, Homo sapiens
ccttgactttcaaaa

SEQ ID NO: 24334 - DNA, 15 bp, Homo sapiens
cccttgactttcaaa

SEQ ID NO: 24335 - DNA, 15 bp, Homo sapiens
acccttgactttcaa

SEQ ID NO: 24336 - DNA, 15 bp, Homo sapiens
cacccttgactttca

SEQ ID NO: 24337 - DNA, 15 bp, Homo sapiens
gcacccttgactttc

SEQ ID NO: 24338 - DNA, 15 bp, Homo sapiens
ggcacccttgacttt

SEQ ID NO: 24339 - DNA, 15 bp, Homo sapiens
aggcacccttgactt

SEQ ID NO: 24340 - DNA, 15 bp, Homo sapiens
caggcacccttgact

SEQ ID NO: 24341 - DNA, 15 bp, Homo sapiens
tcaggcacccttgac

SEQ ID NO: 24342 - DNA, 15 bp, Homo sapiens
atcaggcacccttga

SEQ ID NO: 24343 - DNA, 15 bp, Homo sapiens
aatcaggcacccttg

SEQ ID NO: 24344 - DNA, 15 bp, Homo sapiens
aaatcaggcaccctt

SEQ ID NO: 24345 - DNA, 15 bp, Homo sapiens
aaaatcaggcaccct

SEQ ID NO: 24346 - DNA, 15 bp, Homo sapiens
caaaatcaggcaccc

SEQ ID NO: 24347 - DNA, 15 bp, Homo sapiens
acaaaatcaggcacc

SEQ ID NO: 24348 - DNA, 15 bp, Homo sapiens
aacaaaatcaggcac

SEQ ID NO: 24349 - DNA, 15 bp, Homo sapiens
aaacaaaatcaggca

SEQ ID NO: 24350 - DNA, 15 bp, Homo sapiens
gaaacaaaatcaggc

SEQ ID NO: 24351 - DNA, 15 bp, Homo sapiens
ggaaacaaaatcagg

SEQ ID NO: 24352 - DNA, 15 bp, Homo sapiens
gggaaacaaaatcag

SEQ ID NO: 24353 - DNA, 15 bp, Homo sapiens
ggggaaacaaaatca

SEQ ID NO: 24354 - DNA, 15 bp, Homo sapiens
gggggaaacaaaatc

SEQ ID NO: 24355 - DNA, 15 bp, Homo sapiens
agggggaaacaaaat

SEQ ID NO: 24356 - DNA, 15 bp, Homo sapiens
aagggggaaacaaaa

SEQ ID NO: 24357 - DNA, 15 bp, Homo sapiens
gaagggggaaacaaa

SEQ ID NO: 24358 - DNA, 15 bp, Homo sapiens
ggaagggggaaacaa

SEQ ID NO: 24359 - DNA, 15 bp, Homo sapiens
tggaagggggaaaca

SEQ ID NO: 24360 - DNA, 15 bp, Homo sapiens
atggaagggggaaac

SEQ ID NO: 24361 - DNA, 15 bp, Homo sapiens
aatggaagggggaaa

SEQ ID NO: 24362 - DNA, 15 bp, Homo sapiens
gaatggaagggggaa

SEQ ID NO: 24363 - DNA, 15 bp, Homo sapiens
tgaatggaaggggga

SEQ ID NO: 24364 - DNA, 15 bp, Homo sapiens
ctgaatggaaggggg

SEQ ID NO: 24365 - DNA, 15 bp, Homo sapiens
tctgaatggaagggg

SEQ ID NO: 24366 - DNA, 15 bp, Homo sapiens
ttctgaatggaaggg

SEQ ID NO: 24367 - DNA, 15 bp, Homo sapiens
gttctgaatggaagg

SEQ ID NO: 24368 - DNA, 15 bp, Homo sapiens
ggttctgaatggaag

SEQ ID NO: 24369 - DNA, 15 bp, Homo sapiens
aggttctgaatggaa

SEQ ID NO: 24370 - DNA, 15 bp, Homo sapiens
caggttctgaatgga

SEQ ID NO: 24371 - DNA, 15 bp, Homo sapiens
tcaggttctgaatgg

SEQ ID NO: 24372 - DNA, 15 bp, Homo sapiens
atcaggttctgaatg

SEQ ID NO: 24373 - DNA, 15 bp, Homo sapiens
catcaggttctgaat

SEQ ID NO: 24374 - DNA, 15 bp, Homo sapiens
ccatcaggttctgaa

SEQ ID NO: 24375 - DNA, 15 bp, Homo sapiens
accatcaggttctga

SEQ ID NO: 24376 - DNA, 15 bp, Homo sapiens
caccatcaggttctg

SEQ ID NO: 24377 - DNA, 15 bp, Homo sapiens
ccaccatcaggttct

SEQ ID NO: 24378 - DNA, 15 bp, Homo sapiens
cccaccatcaggttc

SEQ ID NO: 24379 - DNA, 15 bp, Homo sapiens
ccccaccatcaggtt

SEQ ID NO: 24380 - DNA, 15 bp, Homo sapiens
gccccaccatcaggt

SEQ ID NO: 24381 - DNA, 15 bp, Homo sapiens
ggccccaccatcagg

SEQ ID NO: 24382 - DNA, 15 bp, Homo sapiens
tggccccaccatcag

SEQ ID NO: 24383 - DNA, 15 bp, Homo sapiens
ctggccccaccatca

SEQ ID NO: 24384 - DNA, 15 bp, Homo sapiens
gctggccccaccatc

SEQ ID NO: 24385 - DNA, 15 bp, Homo sapiens
tgctggccccaccat

SEQ ID NO: 24386 - DNA, 15 bp, Homo sapiens
atgctggccccacca

SEQ ID NO: 24387 - DNA, 15 bp, Homo sapiens
catgctggccccacc

SEQ ID NO: 24388 - DNA, 15 bp, Homo sapiens
tcatgctggccccac

SEQ ID NO: 24389 - DNA, 15 bp, Homo sapiens
gtcatgctggcccca

SEQ ID NO: 24390 - DNA, 15 bp, Homo sapiens
ggtcatgctggcccc

SEQ ID NO: 24391 - DNA, 15 bp, Homo sapiens
aggtcatgctggccc

SEQ ID NO: 24392 - DNA, 15 bp, Homo sapiens
gaggtcatgctggcc

SEQ ID NO: 24393 - DNA, 15 bp, Homo sapiens
tgaggtcatgctggc

SEQ ID NO: 24394 - DNA, 15 bp, Homo sapiens
gtgaggtcatgctgg

SEQ ID NO: 24395 - DNA, 15 bp, Homo sapiens
ggtgaggtcatgctg

SEQ ID NO: 24396 - DNA, 15 bp, Homo sapiens
tggtgaggtcatgct

SEQ ID NO: 24397 - DNA, 15 bp, Homo sapiens
ttggtgaggtcatgc

SEQ ID NO: 24398 - DNA, 15 bp, Homo sapiens
tttggtgaggtcatg

SEQ ID NO: 24399 - DNA, 15 bp, Homo sapiens
ctttggtgaggtcat

SEQ ID NO: 24400 - DNA, 15 bp, Homo sapiens
tctttggtgaggtca

SEQ ID NO: 24401 - DNA, 15 bp, Homo sapiens
ttctttggtgaggtc

SEQ ID NO: 24402 - DNA, 15 bp, Homo sapiens
tttctttggtgaggt

SEQ ID NO: 24403 - DNA, 15 bp, Homo sapiens
ctttctttggtgagg

SEQ ID NO: 24404 - DNA, 15 bp, Homo sapiens
gctttctttggtgag

SEQ ID NO: 24405 - DNA, 15 bp, Homo sapiens
agctttctttggtga

SEQ ID NO: 24406 - DNA, 15 bp, Homo sapiens
cagctttctttggtg

SEQ ID NO: 24407 - DNA, 15 bp, Homo sapiens
tcagctttctttggt

SEQ ID NO: 24408 - DNA, 15 bp, Homo sapiens
ctcagctttctttgg

SEQ ID NO: 24409 - DNA, 15 bp, Homo sapiens
tctcagctttctttg

SEQ ID NO: 24410 - DNA, 15 bp, Homo sapiens
ctctcagctttcttt

SEQ ID NO: 24411 - DNA, 15 bp, Homo sapiens
gctctcagctttctt

SEQ ID NO: 24412 - DNA, 15 bp, Homo sapiens
ggctctcagctttct

SEQ ID NO: 24413 - DNA, 15 bp, Homo sapiens
aggctctcagctttc

SEQ ID NO: 24414 - DNA, 15 bp, Homo sapiens
aaggctctcagcttt

SEQ ID NO: 24415 - DNA, 15 bp, Homo sapiens
aaaggctctcagctt

SEQ ID NO: 24416 - DNA, 15 bp, Homo sapiens
gaaaggctctcagct

SEQ ID NO: 24417 - DNA, 15 bp, Homo sapiens
tgaaaggctctcagc

SEQ ID NO: 24418 - DNA, 15 bp, Homo sapiens
gtgaaaggctctcag

SEQ ID NO: 24419 - DNA, 15 bp, Homo sapiens
tgtgaaaggctctca

SEQ ID NO: 24420 - DNA, 15 bp, Homo sapiens
atgtgaaaggctctc

SEQ ID NO: 24421 - DNA, 15 bp, Homo sapiens
tatgtgaaaggctct

SEQ ID NO: 24422 - DNA, 15 bp, Homo sapiens
atatgtgaaaggctc

SEQ ID NO: 24423 - DNA, 15 bp, Homo sapiens
gatatgtgaaaggct

SEQ ID NO: 24424 - DNA, 15 bp, Homo sapiens
ggatatgtgaaaggc

SEQ ID NO: 24425 - DNA, 15 bp, Homo sapiens
aggatatgtgaaagg

SEQ ID NO: 24426 - DNA, 15 bp, Homo sapiens
gaggatatgtgaaag

SEQ ID NO: 24427 - DNA, 15 bp, Homo sapiens
agaggatatgtgaaa

SEQ ID NO: 24428 - DNA, 15 bp, Homo sapiens
cagaggatatgtgaa

SEQ ID NO: 24429 - DNA, 15 bp, Homo sapiens
acagaggatatgtga

SEQ ID NO: 24430 - DNA, 15 bp, Homo sapiens
cacagaggatatgtg

SEQ ID NO: 24431 - DNA, 15 bp, Homo sapiens
tcacagaggatatgt

SEQ ID NO: 24432 - DNA, 15 bp, Homo sapiens
gtcacagaggatatg

SEQ ID NO: 24433 - DNA, 15 bp, Homo sapiens
agtcacagaggatat

SEQ ID NO: 24434 - DNA, 15 bp, Homo sapiens
cagtcacagaggata

SEQ ID NO: 24435 - DNA, 15 bp, Homo sapiens
tcagtcacagaggat

SEQ ID NO: 24436 - DNA, 15 bp, Homo sapiens
ctcagtcacagagga

SEQ ID NO: 24437 - DNA, 15 bp, Homo sapiens
gctcagtcacagagg

SEQ ID NO: 24438 - DNA, 15 bp, Homo sapiens
tgctcagtcacagag

SEQ ID NO: 24439 - DNA, 15 bp, Homo sapiens
atgctcagtcacaga

SEQ ID NO: 24440 - DNA, 15 bp, Homo sapiens
aatgctcagtcacag

SEQ ID NO: 24441 - DNA, 15 bp, Homo sapiens
caatgctcagtcaca

SEQ ID NO: 24442 - DNA, 15 bp, Homo sapiens
gcaatgctcagtcac

SEQ ID NO: 24443 - DNA, 15 bp, Homo sapiens
tgcaatgctcagtca

SEQ ID NO: 24444 - DNA, 15 bp, Homo sapiens
ctgcaatgctcagtc

SEQ ID NO: 24445 - DNA, 15 bp, Homo sapiens
actgcaatgctcagt

SEQ ID NO: 24446 - DNA, 15 bp, Homo sapiens
aactgcaatgctcag

SEQ ID NO: 24447 - DNA, 15 bp, Homo sapiens
taactgcaatgctca

SEQ ID NO: 24448 - DNA, 15 bp, Homo sapiens
ctaactgcaatgctc

SEQ ID NO: 24449 - DNA, 15 bp, Homo sapiens
actaactgcaatgct

SEQ ID NO: 24450 - DNA, 15 bp, Homo sapiens
aactaactgcaatgc

SEQ ID NO: 24451 - DNA, 15 bp, Homo sapiens
taactaactgcaatg

SEQ ID NO: 24452 - DNA, 15 bp, Homo sapiens
ttaactaactgcaat

SEQ ID NO: 24453 - DNA, 15 bp, Homo sapiens
gttaactaactgcaa

SEQ ID NO: 24454 - DNA, 15 bp, Homo sapiens
agttaactaactgca

SEQ ID NO: 24455 - DNA, 15 bp, Homo sapiens
aagttaactaactgc

SEQ ID NO: 24456 - DNA, 15 bp, Homo sapiens
taagttaactaactg

SEQ ID NO: 24457 - DNA, 15 bp, Homo sapiens
ttaagttaactaact

SEQ ID NO: 24458 - DNA, 15 bp, Homo sapiens
tttaagttaactaac

SEQ ID NO: 24459 - DNA, 15 bp, Homo sapiens
ctttaagttaactaa

SEQ ID NO: 24460 - DNA, 15 bp, Homo sapiens
actttaagttaacta

SEQ ID NO: 24461 - DNA, 15 bp, Homo sapiens
aactttaagttaact

SEQ ID NO: 24462 - DNA, 15 bp, Homo sapiens
caactttaagttaac

SEQ ID NO: 24463 - DNA, 15 bp, Homo sapiens
acaactttaagttaa

SEQ ID NO: 24464 - DNA, 15 bp, Homo sapiens
tacaactttaagtta

SEQ ID NO: 24465 - DNA, 15 bp, Homo sapiens
ctacaactttaagtt

SEQ ID NO: 24466 - DNA, 15 bp, Homo sapiens
actacaactttaagt

SEQ ID NO: 24467 - DNA, 15 bp, Homo sapiens
tactacaactttaag

SEQ ID NO: 24468 - DNA, 15 bp, Homo sapiens
atactacaactttaa

SEQ ID NO: 24469 - DNA, 15 bp, Homo sapiens
tatactacaacttta

SEQ ID NO: 24470 - DNA, 15 bp, Homo sapiens
atatactacaacttt

SEQ ID NO: 24471 - DNA, 15 bp, Homo sapiens
catatactacaactt

SEQ ID NO: 24472 - DNA, 15 bp, Homo sapiens
acatatactacaact

SEQ ID NO: 24473 - DNA, 15 bp, Homo sapiens
cacatatactacaac

SEQ ID NO: 24474 - DNA, 15 bp, Homo sapiens
tcacatatactacaa

SEQ ID NO: 24475 - DNA, 15 bp, Homo sapiens
atcacatatactaca

SEQ ID NO: 24476 - DNA, 15 bp, Homo sapiens
catcacatatactac

SEQ ID NO: 24477 - DNA, 15 bp, Homo sapiens
acatcacatatacta

SEQ ID NO: 24478 - DNA, 15 bp, Homo sapiens
aacatcacatatact

SEQ ID NO: 24479 - DNA, 15 bp, Homo sapiens
gaacatcacatatac

SEQ ID NO: 24480 - DNA, 15 bp, Homo sapiens
agaacatcacatata

SEQ ID NO: 24481 - DNA, 15 bp, Homo sapiens
aagaacatcacatat

SEQ ID NO: 24482 - DNA, 15 bp, Homo sapiens
aaagaacatcacata

SEQ ID NO: 24483 - DNA, 15 bp, Homo sapiens
gaaagaacatcacat

SEQ ID NO: 24484 - DNA, 15 bp, Homo sapiens
agaaagaacatcaca

SEQ ID NO: 24485 - DNA, 15 bp, Homo sapiens
cagaaagaacatcac

SEQ ID NO: 24486 - DNA, 15 bp, Homo sapiens
acagaaagaacatca

SEQ ID NO: 24487 - DNA, 15 bp, Homo sapiens
aacagaaagaacatc

SEQ ID NO: 24488 - DNA, 15 bp, Homo sapiens
caacagaaagaacat

SEQ ID NO: 24489 - DNA, 15 bp, Homo sapiens
tcaacagaaagaaca

SEQ ID NO: 24490 - DNA, 15 bp, Homo sapiens
atcaacagaaagaac

SEQ ID NO: 24491 - DNA, 15 bp, Homo sapiens
tatcaacagaaagaa

SEQ ID NO: 24492 - DNA, 15 bp, Homo sapiens
ctatcaacagaaaga

SEQ ID NO: 24493 - DNA, 15 bp, Homo sapiens
gctatcaacagaaag

SEQ ID NO: 24494 - DNA, 15 bp, Homo sapiens
tgctatcaacagaaa

SEQ ID NO: 24495 - DNA, 15 bp, Homo sapiens
atgctatcaacagaa

SEQ ID NO: 24496 - DNA, 15 bp, Homo sapiens
tatgctatcaacaga

SEQ ID NO: 24497 - DNA, 15 bp, Homo sapiens
gtatgctatcaacag

SEQ ID NO: 24498 - DNA, 15 bp, Homo sapiens
agtatgctatcaaca

SEQ ID NO: 24499 - DNA, 15 bp, Homo sapiens
aagtatgctatcaac

SEQ ID NO: 24500 - DNA, 15 bp, Homo sapiens
taagtatgctatcaa

SEQ ID NO: 24501 - DNA, 15 bp, Homo sapiens
gtaagtatgctatca

SEQ ID NO: 24502 - DNA, 15 bp, Homo sapiens
agtaagtatgctatc

SEQ ID NO: 24503 - DNA, 15 bp, Homo sapiens
tagtaagtatgctat

SEQ ID NO: 24504 - DNA, 15 bp, Homo sapiens
atagtaagtatgcta

SEQ ID NO: 24505 - DNA, 15 bp, Homo sapiens
tatagtaagtatgct

SEQ ID NO: 24506 - DNA, 15 bp, Homo sapiens
ttatagtaagtatgc

SEQ ID NO: 24507 - DNA, 15 bp, Homo sapiens
tttatagtaagtatg

SEQ ID NO: 24508 - DNA, 15 bp, Homo sapiens
atttatagtaagtat

SEQ ID NO: 24509 - DNA, 15 bp, Homo sapiens
catttatagtaagta

SEQ ID NO: 24510 - DNA, 15 bp, Homo sapiens
tcatttatagtaagt

SEQ ID NO: 24511 - DNA, 15 bp, Homo sapiens
ttcatttatagtaag

SEQ ID NO: 24512 - DNA, 15 bp, Homo sapiens
attcatttatagtaa

SEQ ID NO: 24513 - DNA, 15 bp, Homo sapiens
tattcatttatagta

SEQ ID NO: 24514 - DNA, 15 bp, Homo sapiens
ttattcatttatagt

SEQ ID NO: 24515 - DNA, 15 bp, Homo sapiens
tttattcatttatag

SEQ ID NO: 24516 - DNA, 15 bp, Homo sapiens
ttttattcatttata

SEQ ID NO: 24517 - DNA, 15 bp, Homo sapiens
gttttattcatttat

SEQ ID NO: 24518 - DNA, 15 bp, Homo sapiens
ggttttattcattta

SEQ ID NO: 24519 - DNA, 15 bp, Homo sapiens
gggttttattcattt

SEQ ID NO: 24520 - DNA, 15 bp, Homo sapiens
tgggttttattcatt

SEQ ID NO: 24521 - DNA, 15 bp, Homo sapiens
ctgggttttattcat

SEQ ID NO: 24522 - DNA, 15 bp, Homo sapiens
cctgggttttattca

SEQ ID NO: 24523 - DNA, 15 bp, Homo sapiens
tcctgggttttattc

SEQ ID NO: 24524 - DNA, 15 bp, Homo sapiens
atcctgggttttatt

SEQ ID NO: 24525 - DNA, 15 bp, Homo sapiens
tatcctgggttttat

SEQ ID NO: 24526 - DNA, 15 bp, Homo sapiens
ctatcctgggtttta

SEQ ID NO: 24527 - DNA, 15 bp, Homo sapiens
tctatcctgggtttt

SEQ ID NO: 24528 - DNA, 15 bp, Homo sapiens
ttctatcctgggttt

SEQ ID NO: 24529 - DNA, 15 bp, Homo sapiens
tttctatcctgggtt

SEQ ID NO: 24530 - DNA, 15 bp, Homo sapiens
ttttctatcctgggt

SEQ ID NO: 24531 - DNA, 15 bp, Homo sapiens
attttctatcctggg

SEQ ID NO: 24532 - DNA, 15 bp, Homo sapiens
cattttctatcctgg

SEQ ID NO: 24533 - DNA, 15 bp, Homo sapiens
gcattttctatcctg

SEQ ID NO: 24534 - DNA, 15 bp, Homo sapiens
agcattttctatcct

SEQ ID NO: 24535 - DNA, 15 bp, Homo sapiens
aagcattttctatcc

SEQ ID NO: 24536 - DNA, 15 bp, Homo sapiens
aaagcattttctatc

SEQ ID NO: 24537 - DNA, 15 bp, Homo sapiens
gaaagcattttctat

SEQ ID NO: 24538 - DNA, 15 bp, Homo sapiens
ggaaagcattttcta

SEQ ID NO: 24539 - DNA, 15 bp, Homo sapiens
aggaaagcattttct

SEQ ID NO: 24540 - DNA, 15 bp, Homo sapiens
caggaaagcattttc

SEQ ID NO: 24541 - DNA, 15 bp, Homo sapiens
tcaggaaagcatttt

SEQ ID NO: 24542 - DNA, 15 bp, Homo sapiens
ttcaggaaagcattt

SEQ ID NO: 24543 - DNA, 15 bp, Homo sapiens
tttcaggaaagcatt

SEQ ID NO: 24544 - DNA, 15 bp, Homo sapiens
ctttcaggaaagcat

SEQ ID NO: 24545 - DNA, 15 bp, Homo sapiens
gctttcaggaaagca

SEQ ID NO: 24546 - DNA, 15 bp, Homo sapiens
tgctttcaggaaagc

SEQ ID NO: 24547 - DNA, 15 bp, Homo sapiens
ttgctttcaggaaag

SEQ ID NO: 24548 - DNA, 15 bp, Homo sapiens
tttgctttcaggaaa

SEQ ID NO: 24549 - DNA, 15 bp, Homo sapiens
ctttgctttcaggaa

SEQ ID NO: 24550 - DNA, 15 bp, Homo sapiens
cctttgctttcagga

SEQ ID NO: 24551 - DNA, 15 bp, Homo sapiens
tcctttgctttcagg

SEQ ID NO: 24552 - DNA, 15 bp, Homo sapiens
atcctttgctttcag

SEQ ID NO: 24553 - DNA, 15 bp, Homo sapiens
tatcctttgctttca

SEQ ID NO: 24554 - DNA, 15 bp, Homo sapiens
atatcctttgctttc

SEQ ID NO: 24555 - DNA, 15 bp, Homo sapiens
tatatcctttgcttt

SEQ ID NO: 24556 - DNA, 15 bp, Homo sapiens
ctatatcctttgctt

SEQ ID NO: 24557 - DNA, 15 bp, Homo sapiens
actatatcctttgct

SEQ ID NO: 24558 - DNA, 15 bp, Homo sapiens
aactatatcctttgc

SEQ ID NO: 24559 - DNA, 15 bp, Homo sapiens
aaactatatcctttg

SEQ ID NO: 24560 - DNA, 15 bp, Homo sapiens
gaaactatatccttt

SEQ ID NO: 24561 - DNA, 15 bp, Homo sapiens
agaaactatatcctt

SEQ ID NO: 24562 - DNA, 15 bp, Homo sapiens
cagaaactatatcct

SEQ ID NO: 24563 - DNA, 15 bp, Homo sapiens
acagaaactatatcc

SEQ ID NO: 24564 - DNA, 15 bp, Homo sapiens
gacagaaactatatc

SEQ ID NO: 24565 - DNA, 15 bp, Homo sapiens
agacagaaactatat

SEQ ID NO: 24566 - DNA, 15 bp, Homo sapiens
gagacagaaactata

SEQ ID NO: 24567 - DNA, 15 bp, Homo sapiens
tgagacagaaactat

SEQ ID NO: 24568 - DNA, 15 bp, Homo sapiens
ttgagacagaaacta

SEQ ID NO: 24569 - DNA, 15 bp, Homo sapiens
tttgagacagaaact

SEQ ID NO: 24570 - DNA, 15 bp, Homo sapiens
ctttgagacagaaac

SEQ ID NO: 24571 - DNA, 15 bp, Homo sapiens
cctttgagacagaaa

SEQ ID NO: 24572 - DNA, 15 bp, Homo sapiens
acctttgagacagaa

SEQ ID NO: 24573 - DNA, 15 bp, Homo sapiens
tacctttgagacaga

SEQ ID NO: 24574 - DNA, 15 bp, Homo sapiens
ttacctttgagacag

SEQ ID NO: 24575 - DNA, 15 bp, Homo sapiens
cttacctttgagaca

SEQ ID NO: 24576 - DNA, 15 bp, Homo sapiens
gcttacctttgagac

SEQ ID NO: 24577 - DNA, 15 bp, Homo sapiens
agcttacctttgaga

SEQ ID NO: 24578 - DNA, 15 bp, Homo sapiens
tagcttacctttgag

SEQ ID NO: 24579 - DNA, 15 bp, Homo sapiens
ctagcttacctttga

SEQ ID NO: 24580 - DNA, 15 bp, Homo sapiens
actagcttacctttg

SEQ ID NO: 24581 - DNA, 15 bp, Homo sapiens
gactagcttaccttt

SEQ ID NO: 24582 - DNA, 15 bp, Homo sapiens
ggactagcttacctt

SEQ ID NO: 24583 - DNA, 15 bp, Homo sapiens
gggactagcttacct

SEQ ID NO: 24584 - DNA, 15 bp, Homo sapiens
agggactagcttacc

SEQ ID NO: 24585 - DNA, 15 bp, Homo sapiens
cagggactagcttac

SEQ ID NO: 24586 - DNA, 15 bp, Homo sapiens
acagggactagctta

SEQ ID NO: 24587 - DNA, 15 bp, Homo sapiens
gacagggactagctt

SEQ ID NO: 24588 - DNA, 15 bp, Homo sapiens
tgacagggactagct

SEQ ID NO: 24589 - DNA, 15 bp, Homo sapiens
ctgacagggactagc

SEQ ID NO: 24590 - DNA, 15 bp, Homo sapiens
tctgacagggactag

SEQ ID NO: 24591 - DNA, 15 bp, Homo sapiens
ctctgacagggacta

SEQ ID NO: 24592 - DNA, 15 bp, Homo sapiens
tctctgacagggact

SEQ ID NO: 24593 - DNA, 15 bp, Homo sapiens
gtctctgacagggac

SEQ ID NO: 24594 - DNA, 15 bp, Homo sapiens
tgtctctgacaggga

SEQ ID NO: 24595 - DNA, 15 bp, Homo sapiens
ctgtctctgacaggg

SEQ ID NO: 24596 - DNA, 15 bp, Homo sapiens
tctgtctctgacagg

SEQ ID NO: 24597 - DNA, 15 bp, Homo sapiens
ttctgtctctgacag

SEQ ID NO: 24598 - DNA, 15 bp, Homo sapiens
attctgtctctgaca

SEQ ID NO: 24599 - DNA, 15 bp, Homo sapiens
cattctgtctctgac

SEQ ID NO: 24600 - DNA, 15 bp, Homo sapiens
acattctgtctctga

SEQ ID NO: 24601 - DNA, 15 bp, Homo sapiens
cacattctgtctctg

SEQ ID NO: 24602 - DNA, 15 bp, Homo sapiens
tcacattctgtctct

SEQ ID NO: 24603 - DNA, 15 bp, Homo sapiens
ttcacattctgtctc

SEQ ID NO: 24604 - DNA, 15 bp, Homo sapiens
gttcacattctgtct

SEQ ID NO: 24605 - DNA, 15 bp, Homo sapiens
agttcacattctgtc

SEQ ID NO: 24606 - DNA, 15 bp, Homo sapiens
gagttcacattctgt

SEQ ID NO: 24607 - DNA, 15 bp, Homo sapiens
agagttcacattctg

SEQ ID NO: 24608 - DNA, 15 bp, Homo sapiens
aagagttcacattct

SEQ ID NO: 24609 - DNA, 15 bp, Homo sapiens
gaagagttcacattc

SEQ ID NO: 24610 - DNA, 15 bp, Homo sapiens
tgaagagttcacatt

SEQ ID NO: 24611 - DNA, 15 bp, Homo sapiens
ctgaagagttcacat

SEQ ID NO: 24612 - DNA, 15 bp, Homo sapiens
tctgaagagttcaca

SEQ ID NO: 24613 - DNA, 15 bp, Homo sapiens
ttctgaagagttcac

SEQ ID NO: 24614 - DNA, 15 bp, Homo sapiens
attctgaagagttca

SEQ ID NO: 24615 - DNA, 15 bp, Homo sapiens
cattctgaagagttc

SEQ ID NO: 24616 - DNA, 15 bp, Homo sapiens
tcattctgaagagtt

SEQ ID NO: 24617 - DNA, 15 bp, Homo sapiens
atcattctgaagagt

SEQ ID NO: 24618 - DNA, 15 bp, Homo sapiens
tatcattctgaagag

SEQ ID NO: 24619 - DNA, 15 bp, Homo sapiens
ttatcattctgaaga

SEQ ID NO: 24620 - DNA, 15 bp, Homo sapiens
cttatcattctgaag

SEQ ID NO: 24621 - DNA, 15 bp, Homo sapiens
gcttatcattctgaa

SEQ ID NO: 24622 - DNA, 15 bp, Homo sapiens
tgcttatcattctga

SEQ ID NO: 24623 - DNA, 15 bp, Homo sapiens
ctgcttatcattctg

SEQ ID NO: 24624 - DNA, 15 bp, Homo sapiens
actgcttatcattct

SEQ ID NO: 24625 - DNA, 15 bp, Homo sapiens
cactgcttatcattc

SEQ ID NO: 24626 - DNA, 15 bp, Homo sapiens
tcactgcttatcatt

SEQ ID NO: 24627 - DNA, 15 bp, Homo sapiens
gtcactgcttatcat

SEQ ID NO: 24628 - DNA, 15 bp, Homo sapiens
tgtcactgcttatca

SEQ ID NO: 24629 - DNA, 15 bp, Homo sapiens
atgtcactgcttatc

SEQ ID NO: 24630 - DNA, 15 bp, Homo sapiens
catgtcactgcttat

SEQ ID NO: 24631 - DNA, 15 bp, Homo sapiens
ccatgtcactgctta

SEQ ID NO: 24632 - DNA, 15 bp, Homo sapiens
tccatgtcactgctt

SEQ ID NO: 24633 - DNA, 15 bp, Homo sapiens
ttccatgtcactgct

SEQ ID NO: 24634 - DNA, 15 bp, Homo sapiens
attccatgtcactgc

SEQ ID NO: 24635 - DNA, 15 bp, Homo sapiens
aattccatgtcactg

SEQ ID NO: 24636 - DNA, 15 bp, Homo sapiens
taattccatgtcact

SEQ ID NO: 24637 - DNA, 15 bp, Homo sapiens
gtaattccatgtcac

SEQ ID NO: 24638 - DNA, 15 bp, Homo sapiens
tgtaattccatgtca

SEQ ID NO: 24639 - DNA, 15 bp, Homo sapiens
atgtaattccatgtc

SEQ ID NO: 24640 - DNA, 15 bp, Homo sapiens
aatgtaattccatgt

SEQ ID NO: 24641 - DNA, 15 bp, Homo sapiens
taatgtaattccatg

SEQ ID NO: 24642 - DNA, 15 bp, Homo sapiens
ataatgtaattccat

SEQ ID NO: 24643 - DNA, 15 bp, Homo sapiens
aataatgtaattcca

SEQ ID NO: 24644 - DNA, 15 bp, Homo sapiens
taataatgtaattcc

SEQ ID NO: 24645 - DNA, 15 bp, Homo sapiens
ataataatgtaattc

SEQ ID NO: 24646 - DNA, 15 bp, Homo sapiens
cataataatgtaatt

SEQ ID NO: 24647 - DNA, 15 bp, Homo sapiens
acataataatgtaat

SEQ ID NO: 24648 - DNA, 15 bp, Homo sapiens
cacataataatgtaa

SEQ ID NO: 24649 - DNA, 15 bp, Homo sapiens
tcacataataatgta

SEQ ID NO: 24650 - DNA, 15 bp, Homo sapiens
ttcacataataatgt

SEQ ID NO: 24651 - DNA, 15 bp, Homo sapiens
cttcacataataatg

SEQ ID NO: 24652 - DNA, 15 bp, Homo sapiens
ccttcacataataat

SEQ ID NO: 24653 - DNA, 15 bp, Homo sapiens
gccttcacataataa

SEQ ID NO: 24654 - DNA, 15 bp, Homo sapiens
tgccttcacataata

SEQ ID NO: 24655 - DNA, 15 bp, Homo sapiens
gtgccttcacataat

SEQ ID NO: 24656 - DNA, 15 bp, Homo sapiens
agtgccttcacataa

SEQ ID NO: 24657 - DNA, 15 bp, Homo sapiens
gagtgccttcacata

SEQ ID NO: 24658 - DNA, 15 bp, Homo sapiens
agagtgccttcacat

SEQ ID NO: 24659 - DNA, 15 bp, Homo sapiens
aagagtgccttcaca

SEQ ID NO: 24660 - DNA, 15 bp, Homo sapiens
aaagagtgccttcac

SEQ ID NO: 24661 - DNA, 15 bp, Homo sapiens
caaagagtgccttca

SEQ ID NO: 24662 - DNA, 15 bp, Homo sapiens
tcaaagagtgccttc

SEQ ID NO: 24663 - DNA, 15 bp, Homo sapiens
ttcaaagagtgcctt

SEQ ID NO: 24664 - DNA, 15 bp, Homo sapiens
attcaaagagtgcct

SEQ ID NO: 24665 - DNA, 15 bp, Homo sapiens
aattcaaagagtgcc

SEQ ID NO: 24666 - DNA, 15 bp, Homo sapiens
taattcaaagagtgc

SEQ ID NO: 24667 - DNA, 15 bp, Homo sapiens
ttaattcaaagagtg

SEQ ID NO: 24668 - DNA, 15 bp, Homo sapiens
attaattcaaagagt

SEQ ID NO: 24669 - DNA, 15 bp, Homo sapiens
tattaattcaaagag

SEQ ID NO: 24670 - DNA, 15 bp, Homo sapiens
ctattaattcaaaga

SEQ ID NO: 24671 - DNA, 15 bp, Homo sapiens
actattaattcaaag

SEQ ID NO: 24672 - DNA, 15 bp, Homo sapiens
cactattaattcaaa

SEQ ID NO: 24673 - DNA, 15 bp, Homo sapiens
acactattaattcaa

SEQ ID NO: 24674 - DNA, 15 bp, Homo sapiens
cacactattaattca

SEQ ID NO: 24675 - DNA, 15 bp, Homo sapiens
tcacactattaattc

SEQ ID NO: 24676 - DNA, 15 bp, Homo sapiens
atcacactattaatt

SEQ ID NO: 24677 - DNA, 15 bp, Homo sapiens
gatcacactattaat

SEQ ID NO: 24678 - DNA, 15 bp, Homo sapiens
tgatcacactattaa

SEQ ID NO: 24679 - DNA, 15 bp, Homo sapiens
ctgatcacactatta

SEQ ID NO: 24680 - DNA, 15 bp, Homo sapiens
actgatcacactatt

SEQ ID NO: 24681 - DNA, 15 bp, Homo sapiens
cactgatcacactat

SEQ ID NO: 24682 - DNA, 15 bp, Homo sapiens
ccactgatcacacta

SEQ ID NO: 24683 - DNA, 15 bp, Homo sapiens
gccactgatcacact

SEQ ID NO: 24684 - DNA, 15 bp, Homo sapiens
agccactgatcacac

SEQ ID NO: 24685 - DNA, 15 bp, Homo sapiens
aagccactgatcaca

SEQ ID NO: 24686 - DNA, 15 bp, Homo sapiens
gaagccactgatcac

SEQ ID NO: 24687 - DNA, 15 bp, Homo sapiens
agaagccactgatca

SEQ ID NO: 24688 - DNA, 15 bp, Homo sapiens
aagaagccactgatc

SEQ ID NO: 24689 - DNA, 15 bp, Homo sapiens
taagaagccactgat

SEQ ID NO: 24690 - DNA, 15 bp, Homo sapiens
ataagaagccactga

SEQ ID NO: 24691 - DNA, 15 bp, Homo sapiens
tataagaagccactg

SEQ ID NO: 24692 - DNA, 15 bp, Homo sapiens
atataagaagccact

SEQ ID NO: 24693 - DNA, 15 bp, Homo sapiens
aatataagaagccac

SEQ ID NO: 24694 - DNA, 15 bp, Homo sapiens
aaatataagaagcca

SEQ ID NO: 24695 - DNA, 15 bp, Homo sapiens
caaatataagaagcc

SEQ ID NO: 24696 - DNA, 15 bp, Homo sapiens
ccaaatataagaagc

SEQ ID NO: 24697 - DNA, 15 bp, Homo sapiens
cccaaatataagaag

SEQ ID NO: 24698 - DNA, 15 bp, Homo sapiens
acccaaatataagaa

SEQ ID NO: 24699 - DNA, 15 bp, Homo sapiens
cacccaaatataaga

SEQ ID NO: 24700 - DNA, 15 bp, Homo sapiens
tcacccaaatataag

SEQ ID NO: 24701 - DNA, 15 bp, Homo sapiens
ttcacccaaatataa

SEQ ID NO: 24702 - DNA, 15 bp, Homo sapiens
tttcacccaaatata

SEQ ID NO: 24703 - DNA, 15 bp, Homo sapiens
atttcacccaaatat

SEQ ID NO: 24704 - DNA, 15 bp, Homo sapiens
tatttcacccaaata

SEQ ID NO: 24705 - DNA, 15 bp, Homo sapiens
ttatttcacccaaat

SEQ ID NO: 24706 - DNA, 15 bp, Homo sapiens
attatttcacccaaa

SEQ ID NO: 24707 - DNA, 15 bp, Homo sapiens
tattatttcacccaa

SEQ ID NO: 24708 - DNA, 15 bp, Homo sapiens
ttattatttcaccca

SEQ ID NO: 24709 - DNA, 15 bp, Homo sapiens
tttattatttcaccc

SEQ ID NO: 24710 - DNA, 15 bp, Homo sapiens
atttattatttcacc

SEQ ID NO: 24711 - DNA, 15 bp, Homo sapiens
tatttattatttcac

SEQ ID NO: 24712 - DNA, 15 bp, Homo sapiens
gtatttattatttca

SEQ ID NO: 24713 - DNA, 15 bp, Homo sapiens
agtatttattatttc

SEQ ID NO: 24714 - DNA, 15 bp, Homo sapiens
cagtatttattattt

SEQ ID NO: 24715 - DNA, 15 bp, Homo sapiens
acagtatttattatt

SEQ ID NO: 24716 - DNA, 15 bp, Homo sapiens
cacagtatttattat

SEQ ID NO: 24717 - DNA, 15 bp, Homo sapiens
acacagtatttatta

SEQ ID NO: 24718 - DNA, 15 bp, Homo sapiens
aacacagtatttatt

SEQ ID NO: 24719 - DNA, 15 bp, Homo sapiens
aaacacagtatttat

SEQ ID NO: 24720 - DNA, 15 bp, Homo sapiens
caaacacagtattta

SEQ ID NO: 24721 - DNA, 15 bp, Homo sapiens
tcaaacacagtattt

SEQ ID NO: 24722 - DNA, 15 bp, Homo sapiens
atcaaacacagtatt

SEQ ID NO: 24723 - DNA, 15 bp, Homo sapiens
catcaaacacagtat

SEQ ID NO: 24724 - DNA, 15 bp, Homo sapiens
acatcaaacacagta

SEQ ID NO: 24725 - DNA, 15 bp, Homo sapiens
gacatcaaacacagt

SEQ ID NO: 24726 - DNA, 15 bp, Homo sapiens
tgacatcaaacacag

SEQ ID NO: 24727 - DNA, 15 bp, Homo sapiens
atgacatcaaacaca

SEQ ID NO: 24728 - DNA, 15 bp, Homo sapiens
gatgacatcaaacac

SEQ ID NO: 24729 - DNA, 15 bp, Homo sapiens
agatgacatcaaaca

SEQ ID NO: 24730 - DNA, 15 bp, Homo sapiens
aagatgacatcaaac

SEQ ID NO: 24731 - DNA, 15 bp, Homo sapiens
taagatgacatcaaa

SEQ ID NO: 24732 - DNA, 15 bp, Homo sapiens
ataagatgacatcaa

SEQ ID NO: 24733 - DNA, 15 bp, Homo sapiens
tataagatgacatca

SEQ ID NO: 24734 - DNA, 15 bp, Homo sapiens
atataagatgacatc

SEQ ID NO: 24735 - DNA, 15 bp, Homo sapiens
aatataagatgacat

SEQ ID NO: 24736 - DNA, 15 bp, Homo sapiens
aaatataagatgaca

SEQ ID NO: 24737 - DNA, 15 bp, Homo sapiens
taaatataagatgac

SEQ ID NO: 24738 - DNA, 15 bp, Homo sapiens
ttaaatataagatga

SEQ ID NO: 24739 - DNA, 15 bp, Homo sapiens
cttaaatataagatg

SEQ ID NO: 24740 - DNA, 15 bp, Homo sapiens
ccttaaatataagat

SEQ ID NO: 24741 - DNA, 15 bp, Homo sapiens
cccttaaatataaga

SEQ ID NO: 24742 - DNA, 15 bp, Homo sapiens
tcccttaaatataag

SEQ ID NO: 24743 - DNA, 15 bp, Homo sapiens
ttcccttaaatataa

SEQ ID NO: 24744 - DNA, 15 bp, Homo sapiens
tttcccttaaatata

SEQ ID NO: 24745 - DNA, 15 bp, Homo sapiens
atttcccttaaatat

SEQ ID NO: 24746 - DNA, 15 bp, Homo sapiens
catttcccttaaata

SEQ ID NO: 24747 - DNA, 15 bp, Homo sapiens
tcatttcccttaaat

SEQ ID NO: 24748 - DNA, 15 bp, Homo sapiens
ttcatttcccttaaa

SEQ ID NO: 24749 - DNA, 15 bp, Homo sapiens
tttcatttcccttaa

SEQ ID NO: 24750 - DNA, 15 bp, Homo sapiens
ttttcatttccctta

SEQ ID NO: 24751 - DNA, 15 bp, Homo sapiens
tttttcatttccctt

SEQ ID NO: 24752 - DNA, 15 bp, Homo sapiens
gtttttcatttccct

SEQ ID NO: 24753 - DNA, 15 bp, Homo sapiens
ggtttttcatttccc

SEQ ID NO: 24754 - DNA, 15 bp, Homo sapiens
aggtttttcatttcc

SEQ ID NO: 24755 - DNA, 15 bp, Homo sapiens
taggtttttcatttc

SEQ ID NO: 24756 - DNA, 15 bp, Homo sapiens
gtaggtttttcattt

SEQ ID NO: 24757 - DNA, 15 bp, Homo sapiens
agtaggtttttcatt

SEQ ID NO: 24758 - DNA, 15 bp, Homo sapiens
aagtaggtttttcat

SEQ ID NO: 24759 - DNA, 15 bp, Homo sapiens
taagtaggtttttca

SEQ ID NO: 24760 - DNA, 15 bp, Homo sapiens
ataagtaggtttttc

SEQ ID NO: 24761 - DNA, 15 bp, Homo sapiens
aataagtaggttttt

SEQ ID NO: 24762 - DNA, 15 bp, Homo sapiens
taataagtaggtttt

SEQ ID NO: 24763 - DNA, 15 bp, Homo sapiens
ctaataagtaggttt

SEQ ID NO: 24764 - DNA, 15 bp, Homo sapiens
tctaataagtaggtt

SEQ ID NO: 24765 - DNA, 15 bp, Homo sapiens
ttctaataagtaggt

SEQ ID NO: 24766 - DNA, 15 bp, Homo sapiens
attctaataagtagg

SEQ ID NO: 24767 - DNA, 15 bp, Homo sapiens
tattctaataagtag

SEQ ID NO: 24768 - DNA, 15 bp, Homo sapiens
ttattctaataagta

SEQ ID NO: 24769 - DNA, 15 bp, Homo sapiens
cttattctaataagt

SEQ ID NO: 24770 - DNA, 15 bp, Homo sapiens
tcttattctaataag

SEQ ID NO: 24771 - DNA, 15 bp, Homo sapiens
atcttattctaataa

SEQ ID NO: 24772 - DNA, 15 bp, Homo sapiens
gatcttattctaata

SEQ ID NO: 24773 - DNA, 15 bp, Homo sapiens
tgatcttattctaat

SEQ ID NO: 24774 - DNA, 15 bp, Homo sapiens
gtgatcttattctaa

SEQ ID NO: 24775 - DNA, 15 bp, Homo sapiens
tgtgatcttattcta

SEQ ID NO: 24776 - DNA, 15 bp, Homo sapiens
atgtgatcttattct

SEQ ID NO: 24777 - DNA, 15 bp, Homo sapiens
catgtgatcttattc

SEQ ID NO: 24778 - DNA, 15 bp, Homo sapiens
gcatgtgatcttatt

SEQ ID NO: 24779 - DNA, 15 bp, Homo sapiens
tgcatgtgatcttat

SEQ ID NO: 24780 - DNA, 15 bp, Homo sapiens
gtgcatgtgatctta

SEQ ID NO: 24781 - DNA, 15 bp, Homo sapiens
tgtgcatgtgatctt

SEQ ID NO: 24782 - DNA, 15 bp, Homo sapiens
gtgtgcatgtgatct

SEQ ID NO: 24783 - DNA, 15 bp, Homo sapiens
ggtgtgcatgtgatc

SEQ ID NO: 24784 - DNA, 15 bp, Homo sapiens
aggtgtgcatgtgat

SEQ ID NO: 24785 - DNA, 15 bp, Homo sapiens
caggtgtgcatgtga

SEQ ID NO: 24786 - DNA, 15 bp, Homo sapiens
acaggtgtgcatgtg

SEQ ID NO: 24787 - DNA, 15 bp, Homo sapiens
tacaggtgtgcatgt

SEQ ID NO: 24788 - DNA, 15 bp, Homo sapiens
gtacaggtgtgcatg

SEQ ID NO: 24789 - DNA, 15 bp, Homo sapiens
agtacaggtgtgcat

SEQ ID NO: 24790 - DNA, 15 bp, Homo sapiens
aagtacaggtgtgca

SEQ ID NO: 24791 - DNA, 15 bp, Homo sapiens
aaagtacaggtgtgc

SEQ ID NO: 24792 - DNA, 15 bp, Homo sapiens
caaagtacaggtgtg

SEQ ID NO: 24793 - DNA, 15 bp, Homo sapiens
tcaaagtacaggtgt

SEQ ID NO: 24794 - DNA, 15 bp, Homo sapiens
ctcaaagtacaggtg

SEQ ID NO: 24795 - DNA, 15 bp, Homo sapiens
actcaaagtacaggt

SEQ ID NO: 24796 - DNA, 15 bp, Homo sapiens
tactcaaagtacagg

SEQ ID NO: 24797 - DNA, 15 bp, Homo sapiens
atactcaaagtacag

SEQ ID NO: 24798 - DNA, 15 bp, Homo sapiens
catactcaaagtaca

SEQ ID NO: 24799 - DNA, 15 bp, Homo sapiens
acatactcaaagtac

SEQ ID NO: 24800 - DNA, 15 bp, Homo sapiens
aacatactcaaagta

SEQ ID NO: 24801 - DNA, 15 bp, Homo sapiens
aaacatactcaaagt

SEQ ID NO: 24802 - DNA, 15 bp, Homo sapiens
aaaacatactcaaag

SEQ ID NO: 24803 - DNA, 15 bp, Homo sapiens
aaaaacatactcaaa

SEQ ID NO: 24804 - DNA, 15 bp, Homo sapiens
taaaaacatactcaa

SEQ ID NO: 24805 - DNA, 15 bp, Homo sapiens
ttaaaaacatactca

SEQ ID NO: 24806 - DNA, 15 bp, Homo sapiens
attaaaaacatactc

SEQ ID NO: 24807 - DNA, 15 bp, Homo sapiens
aattaaaaacatact

SEQ ID NO: 24808 - DNA, 15 bp, Homo sapiens
taattaaaaacatac

SEQ ID NO: 24809 - DNA, 15 bp, Homo sapiens
ataattaaaaacata

SEQ ID NO: 24810 - DNA, 15 bp, Homo sapiens
gataattaaaaacat

SEQ ID NO: 24811 - DNA, 15 bp, Homo sapiens
agataattaaaaaca

SEQ ID NO: 24812 - DNA, 15 bp, Homo sapiens
cagataattaaaaac

SEQ ID NO: 24813 - DNA, 15 bp, Homo sapiens
ccagataattaaaaa

SEQ ID NO: 24814 - DNA, 15 bp, Homo sapiens
cccagataattaaaa

SEQ ID NO: 24815 - DNA, 15 bp, Homo sapiens
acccagataattaaa

SEQ ID NO: 24816 - DNA, 15 bp, Homo sapiens
gacccagataattaa

SEQ ID NO: 24817 - DNA, 15 bp, Homo sapiens
tgacccagataatta

SEQ ID NO: 24818 - DNA, 15 bp, Homo sapiens
gtgacccagataatt

SEQ ID NO: 24819 - DNA, 15 bp, Homo sapiens
ggtgacccagataat

SEQ ID NO: 24820 - DNA, 15 bp, Homo sapiens
aggtgacccagataa

SEQ ID NO: 24821 - DNA, 15 bp, Homo sapiens
caggtgacccagata

SEQ ID NO: 24822 - DNA, 15 bp, Homo sapiens
acaggtgacccagat

SEQ ID NO: 24823 - DNA, 15 bp, Homo sapiens
aacaggtgacccaga

SEQ ID NO: 24824 - DNA, 15 bp, Homo sapiens
aaacaggtgacccag

SEQ ID NO: 24825 - DNA, 15 bp, Homo sapiens
gaaacaggtgaccca

SEQ ID NO: 24826 - DNA, 15 bp, Homo sapiens
tgaaacaggtgaccc

SEQ ID NO: 24827 - DNA, 15 bp, Homo sapiens
ctgaaacaggtgacc

SEQ ID NO: 24828 - DNA, 15 bp, Homo sapiens
tctgaaacaggtgac

SEQ ID NO: 24829 - DNA, 15 bp, Homo sapiens
ctctgaaacaggtga

SEQ ID NO: 24830 - DNA, 15 bp, Homo sapiens
cctctgaaacaggtg

SEQ ID NO: 24831 - DNA, 15 bp, Homo sapiens
tcctctgaaacaggt

SEQ ID NO: 24832 - DNA, 15 bp, Homo sapiens
ctcctctgaaacagg

SEQ ID NO: 24833 - DNA, 15 bp, Homo sapiens
cctcctctgaaacag

SEQ ID NO: 24834 - DNA, 15 bp, Homo sapiens
tcctcctctgaaaca

SEQ ID NO: 24835 - DNA, 15 bp, Homo sapiens
atcctcctctgaaac

SEQ ID NO: 24836 - DNA, 15 bp, Homo sapiens
tatcctcctctgaaa

SEQ ID NO: 24837 - DNA, 15 bp, Homo sapiens
ttatcctcctctgaa

SEQ ID NO: 24838 - DNA, 15 bp, Homo sapiens
tttatcctcctctga

SEQ ID NO: 24839 - DNA, 15 bp, Homo sapiens
ttttatcctcctctg

SEQ ID NO: 24840 - DNA, 15 bp, Homo sapiens
tttttatcctcctct

SEQ ID NO: 24841 - DNA, 15 bp, Homo sapiens
atttttatcctcctc

SEQ ID NO: 24842 - DNA, 15 bp, Homo sapiens
catttttatcctcct

SEQ ID NO: 24843 - DNA, 15 bp, Homo sapiens
ccatttttatcctcc

SEQ ID NO: 24844 - DNA, 15 bp, Homo sapiens
gccatttttatcctc

SEQ ID NO: 24845 - DNA, 15 bp, Homo sapiens
ggccatttttatcct

SEQ ID NO: 24846 - DNA, 15 bp, Homo sapiens
aggccatttttatcc

SEQ ID NO: 24847 - DNA, 15 bp, Homo sapiens
aaggccatttttatc

SEQ ID NO: 24848 - DNA, 15 bp, Homo sapiens
taaggccatttttat

SEQ ID NO: 24849 - DNA, 15 bp, Homo sapiens
gtaaggccattttta

SEQ ID NO: 24850 - DNA, 15 bp, Homo sapiens
tgtaaggccattttt

SEQ ID NO: 24851 - DNA, 15 bp, Homo sapiens
ctgtaaggccatttt

SEQ ID NO: 24852 - DNA, 15 bp, Homo sapiens
actgtaaggccattt

SEQ ID NO: 24853 - DNA, 15 bp, Homo sapiens
cactgtaaggccatt

SEQ ID NO: 24854 - DNA, 15 bp, Homo sapiens
acactgtaaggccat

SEQ ID NO: 24855 - DNA, 15 bp, Homo sapiens
aacactgtaaggcca

SEQ ID NO: 24856 - DNA, 15 bp, Homo sapiens
caacactgtaaggcc

SEQ ID NO: 24857 - DNA, 15 bp, Homo sapiens
acaacactgtaaggc

SEQ ID NO: 24858 - DNA, 15 bp, Homo sapiens
tacaacactgtaagg

SEQ ID NO: 24859 - DNA, 15 bp, Homo sapiens
ttacaacactgtaag

SEQ ID NO: 24860 - DNA, 15 bp, Homo sapiens
attacaacactgtaa

SEQ ID NO: 24861 - DNA, 15 bp, Homo sapiens
tattacaacactgta

SEQ ID NO: 24862 - DNA, 15 bp, Homo sapiens
ctattacaacactgt

SEQ ID NO: 24863 - DNA, 15 bp, Homo sapiens
tctattacaacactg

SEQ ID NO: 24864 - DNA, 15 bp, Homo sapiens
ctctattacaacact

SEQ ID NO: 24865 - DNA, 15 bp, Homo sapiens
cctctattacaacac

SEQ ID NO: 24866 - DNA, 15 bp, Homo sapiens
tcctctattacaaca

SEQ ID NO: 24867 - DNA, 15 bp, Homo sapiens
gtcctctattacaac

SEQ ID NO: 24868 - DNA, 15 bp, Homo sapiens
tgtcctctattacaa

SEQ ID NO: 24869 - DNA, 15 bp, Homo sapiens
ctgtcctctattaca

SEQ ID NO: 24870 - DNA, 15 bp, Homo sapiens
tctgtcctctattac

SEQ ID NO: 24871 - DNA, 15 bp, Homo sapiens
atctgtcctctatta

SEQ ID NO: 24872 - DNA, 15 bp, Homo sapiens
aatctgtcctctatt

SEQ ID NO: 24873 - DNA, 15 bp, Homo sapiens
caatctgtcctctat

SEQ ID NO: 24874 - DNA, 15 bp, Homo sapiens
acaatctgtcctcta

SEQ ID NO: 24875 - DNA, 15 bp, Homo sapiens
cacaatctgtcctct

SEQ ID NO: 24876 - DNA, 15 bp, Homo sapiens
gcacaatctgtcctc

SEQ ID NO: 24877 - DNA, 15 bp, Homo sapiens
agcacaatctgtcct

SEQ ID NO: 24878 - DNA, 15 bp, Homo sapiens
aagcacaatctgtcc

SEQ ID NO: 24879 - DNA, 15 bp, Homo sapiens
aaagcacaatctgtc

SEQ ID NO: 24880 - DNA, 15 bp, Homo sapiens
aaaagcacaatctgt

SEQ ID NO: 24881 - DNA, 15 bp, Homo sapiens
caaaagcacaatctg

SEQ ID NO: 24882 - DNA, 15 bp, Homo sapiens
acaaaagcacaatct

SEQ ID NO: 24883 - DNA, 15 bp, Homo sapiens
cacaaaagcacaatc

SEQ ID NO: 24884 - DNA, 15 bp, Homo sapiens
ccacaaaagcacaat

SEQ ID NO: 24885 - DNA, 15 bp, Homo sapiens
tccacaaaagcacaa

SEQ ID NO: 24886 - DNA, 15 bp, Homo sapiens
ttccacaaaagcaca

SEQ ID NO: 24887 - DNA, 15 bp, Homo sapiens
tttccacaaaagcac

SEQ ID NO: 24888 - DNA, 15 bp, Homo sapiens
ttttccacaaaagca

SEQ ID NO: 24889 - DNA, 15 bp, Homo sapiens
tttttccacaaaagc

SEQ ID NO: 24890 - DNA, 15 bp, Homo sapiens
ttttttccacaaaag

SEQ ID NO: 24891 - DNA, 15 bp, Homo sapiens
tttttttccacaaaa

SEQ ID NO: 24892 - DNA, 15 bp, Homo sapiens
ttttttttccacaaa

SEQ ID NO: 24893 - DNA, 15 bp, Homo sapiens
attttttttccacaa

SEQ ID NO: 24894 - DNA, 15 bp, Homo sapiens
tattttttttccaca

SEQ ID NO: 24895 - DNA, 15 bp, Homo sapiens
atattttttttccac

SEQ ID NO: 24896 - DNA, 15 bp, Homo sapiens
aatattttttttcca

SEQ ID NO: 24897 - DNA, 15 bp, Homo sapiens
taatattttttttcc

SEQ ID NO: 24898 - DNA, 15 bp, Homo sapiens
ttaatattttttttc

SEQ ID NO: 24899 - DNA, 15 bp, Homo sapiens
tttaatatttttttt

SEQ ID NO: 24900 - DNA, 15 bp, Homo sapiens
ctttaatattttttt

SEQ ID NO: 24901 - DNA, 15 bp, Homo sapiens
tctttaatatttttt

SEQ ID NO: 24902 - DNA, 15 bp, Homo sapiens
atctttaatattttt

SEQ ID NO: 24903 - DNA, 15 bp, Homo sapiens
tatctttaatatttt

SEQ ID NO: 24904 - DNA, 15 bp, Homo sapiens
ttatctttaatattt

SEQ ID NO: 24905 - DNA, 15 bp, Homo sapiens
tttatctttaatatt

SEQ ID NO: 24906 - DNA, 15 bp, Homo sapiens
atttatctttaatat

SEQ ID NO: 24907 - DNA, 15 bp, Homo sapiens
aatttatctttaata

SEQ ID NO: 24908 - DNA, 15 bp, Homo sapiens
aaatttatctttaat

SEQ ID NO: 24909 - DNA, 15 bp, Homo sapiens
taaatttatctttaa

SEQ ID NO: 24910 - DNA, 15 bp, Homo sapiens
ataaatttatcttta

SEQ ID NO: 24911 - DNA, 15 bp, Homo sapiens
gataaatttatcttt

SEQ ID NO: 24912 - DNA, 15 bp, Homo sapiens
agataaatttatctt

SEQ ID NO: 24913 - DNA, 15 bp, Homo sapiens
cagataaatttatct

SEQ ID NO: 24914 - DNA, 15 bp, Homo sapiens
acagataaatttatc

SEQ ID NO: 24915 - DNA, 15 bp, Homo sapiens
cacagataaatttat

SEQ ID NO: 24916 - DNA, 15 bp, Homo sapiens
acacagataaattta

SEQ ID NO: 24917 - DNA, 15 bp, Homo sapiens
tacacagataaattt

SEQ ID NO: 24918 - DNA, 15 bp, Homo sapiens
gtacacagataaatt

SEQ ID NO: 24919 - DNA, 15 bp, Homo sapiens
agtacacagataaat

SEQ ID NO: 24920 - DNA, 15 bp, Homo sapiens
aagtacacagataaa

SEQ ID NO: 24921 - DNA, 15 bp, Homo sapiens
gaagtacacagataa

SEQ ID NO: 24922 - DNA, 15 bp, Homo sapiens
agaagtacacagata

SEQ ID NO: 24923 - DNA, 15 bp, Homo sapiens
gagaagtacacagat

SEQ ID NO: 24924 - DNA, 15 bp, Homo sapiens
ggagaagtacacaga

SEQ ID NO: 24925 - DNA, 15 bp, Homo sapiens
gggagaagtacacag

SEQ ID NO: 24926 - DNA, 15 bp, Homo sapiens
agggagaagtacaca

SEQ ID NO: 24927 - DNA, 15 bp, Homo sapiens
aagggagaagtacac

SEQ ID NO: 24928 - DNA, 15 bp, Homo sapiens
aaagggagaagtaca

SEQ ID NO: 24929 - DNA, 15 bp, Homo sapiens
aaaagggagaagtac

SEQ ID NO: 24930 - DNA, 15 bp, Homo sapiens
aaaaagggagaagta

SEQ ID NO: 24931 - DNA, 15 bp, Homo sapiens
aaaaaagggagaagt

SEQ ID NO: 24932 - DNA, 15 bp, Homo sapiens
gaaaaaagggagaag

SEQ ID NO: 24933 - DNA, 15 bp, Homo sapiens
agaaaaaagggagaa

SEQ ID NO: 24934 - DNA, 15 bp, Homo sapiens
tagaaaaaagggaga

SEQ ID NO: 24935 - DNA, 15 bp, Homo sapiens
gtagaaaaaagggag

SEQ ID NO: 24936 - DNA, 15 bp, Homo sapiens
agtagaaaaaaggga

SEQ ID NO: 24937 - DNA, 15 bp, Homo sapiens
aagtagaaaaaaggg

SEQ ID NO: 24938 - DNA, 15 bp, Homo sapiens
aaagtagaaaaaagg

SEQ ID NO: 24939 - DNA, 15 bp, Homo sapiens
gaaagtagaaaaaag

SEQ ID NO: 24940 - DNA, 15 bp, Homo sapiens
agaaagtagaaaaaa

SEQ ID NO: 24941 - DNA, 15 bp, Homo sapiens
cagaaagtagaaaaa

SEQ ID NO: 24942 - DNA, 15 bp, Homo sapiens
acagaaagtagaaaa

SEQ ID NO: 24943 - DNA, 15 bp, Homo sapiens
cacagaaagtagaaa

SEQ ID NO: 24944 - DNA, 15 bp, Homo sapiens
gcacagaaagtagaa

SEQ ID NO: 24945 - DNA, 15 bp, Homo sapiens
ggcacagaaagtaga

SEQ ID NO: 24946 - DNA, 15 bp, Homo sapiens
aggcacagaaagtag

SEQ ID NO: 24947 - DNA, 15 bp, Homo sapiens
aaggcacagaaagta

SEQ ID NO: 24948 - DNA, 15 bp, Homo sapiens
aaaggcacagaaagt

SEQ ID NO: 24949 - DNA, 15 bp, Homo sapiens
taaaggcacagaaag

SEQ ID NO: 24950 - DNA, 15 bp, Homo sapiens
ttaaaggcacagaaa

SEQ ID NO: 24951 - DNA, 15 bp, Homo sapiens
gttaaaggcacagaa

SEQ ID NO: 24952 - DNA, 15 bp, Homo sapiens
ggttaaaggcacaga

SEQ ID NO: 24953 - DNA, 15 bp, Homo sapiens
tggttaaaggcacag

SEQ ID NO: 24954 - DNA, 15 bp, Homo sapiens
ttggttaaaggcaca

SEQ ID NO: 24955 - DNA, 15 bp, Homo sapiens
attggttaaaggcac

SEQ ID NO: 24956 - DNA, 15 bp, Homo sapiens
tattggttaaaggca

SEQ ID NO: 24957 - DNA, 15 bp, Homo sapiens
gtattggttaaaggc

SEQ ID NO: 24958 - DNA, 15 bp, Homo sapiens
tgtattggttaaagg

SEQ ID NO: 24959 - DNA, 15 bp, Homo sapiens
ctgtattggttaaag

SEQ ID NO: 24960 - DNA, 15 bp, Homo sapiens
cctgtattggttaaa

SEQ ID NO: 24961 - DNA, 15 bp, Homo sapiens
gcctgtattggttaa

SEQ ID NO: 24962 - DNA, 15 bp, Homo sapiens
tgcctgtattggtta

SEQ ID NO: 24963 - DNA, 15 bp, Homo sapiens
ttgcctgtattggtt

SEQ ID NO: 24964 - DNA, 15 bp, Homo sapiens
tttgcctgtattggt

SEQ ID NO: 24965 - DNA, 15 bp, Homo sapiens
ctttgcctgtattgg

SEQ ID NO: 24966 - DNA, 15 bp, Homo sapiens
cctttgcctgtattg

SEQ ID NO: 24967 - DNA, 15 bp, Homo sapiens
ccctttgcctgtatt

SEQ ID NO: 24968 - DNA, 15 bp, Homo sapiens
accctttgcctgtat

SEQ ID NO: 24969 - DNA, 15 bp, Homo sapiens
caccctttgcctgta

SEQ ID NO: 24970 - DNA, 15 bp, Homo sapiens
acaccctttgcctgt

SEQ ID NO: 24971 - DNA, 15 bp, Homo sapiens
cacaccctttgcctg

SEQ ID NO: 24972 - DNA, 15 bp, Homo sapiens
acacaccctttgcct

SEQ ID NO: 24973 - DNA, 15 bp, Homo sapiens
tacacaccctttgcc

SEQ ID NO: 24974 - DNA, 15 bp, Homo sapiens
atacacaccctttgc

SEQ ID NO: 24975 - DNA, 15 bp, Homo sapiens
catacacaccctttg

SEQ ID NO: 24976 - DNA, 15 bp, Homo sapiens
tcatacacacccttt

SEQ ID NO: 24977 - DNA, 15 bp, Homo sapiens
ttcatacacaccctt

SEQ ID NO: 24978 - DNA, 15 bp, Homo sapiens
tttcatacacaccct

SEQ ID NO: 24979 - DNA, 15 bp, Homo sapiens
ttttcatacacaccc

SEQ ID NO: 24980 - DNA, 15 bp, Homo sapiens
tttttcatacacacc

SEQ ID NO: 24981 - DNA, 15 bp, Homo sapiens
ctttttcatacacac

SEQ ID NO: 24982 - DNA, 15 bp, Homo sapiens
actttttcatacaca

SEQ ID NO: 24983 - DNA, 15 bp, Homo sapiens
aactttttcatacac

SEQ ID NO: 24984 - DNA, 15 bp, Homo sapiens
caactttttcataca

SEQ ID NO: 24985 - DNA, 15 bp, Homo sapiens
ccaactttttcatac

SEQ ID NO: 24986 - DNA, 15 bp, Homo sapiens
tccaactttttcata

SEQ ID NO: 24987 - DNA, 15 bp, Homo sapiens
ctccaactttttcat

SEQ ID NO: 24988 - DNA, 15 bp, Homo sapiens
tctccaactttttca

SEQ ID NO: 24989 - DNA, 15 bp, Homo sapiens
ttctccaactttttc

SEQ ID NO: 24990 - DNA, 15 bp, Homo sapiens
cttctccaacttttt

SEQ ID NO: 24991 - DNA, 15 bp, Homo sapiens
gcttctccaactttt

SEQ ID NO: 24992 - DNA, 15 bp, Homo sapiens
agcttctccaacttt

SEQ ID NO: 24993 - DNA, 15 bp, Homo sapiens
tagcttctccaactt

SEQ ID NO: 24994 - DNA, 15 bp, Homo sapiens
gtagcttctccaact

SEQ ID NO: 24995 - DNA, 15 bp, Homo sapiens
tgtagcttctccaac

SEQ ID NO: 24996 - DNA, 15 bp, Homo sapiens
ctgtagcttctccaa

SEQ ID NO: 24997 - DNA, 15 bp, Homo sapiens
tctgtagcttctcca

SEQ ID NO: 24998 - DNA, 15 bp, Homo sapiens
ctctgtagcttctcc

SEQ ID NO: 24999 - DNA, 15 bp, Homo sapiens
tctctgtagcttctc

SEQ ID NO: 25000 - DNA, 15 bp, Homo sapiens
gtctctgtagcttct

SEQ ID NO: 25001 - DNA, 15 bp, Homo sapiens
agtctctgtagcttc

SEQ ID NO: 25002 - DNA, 15 bp, Homo sapiens
cagtctctgtagctt

SEQ ID NO: 25003 - DNA, 15 bp, Homo sapiens
gcagtctctgtagct

SEQ ID NO: 25004 - DNA, 15 bp, Homo sapiens
agcagtctctgtagc

SEQ ID NO: 25005 - DNA, 15 bp, Homo sapiens
gagcagtctctgtag

SEQ ID NO: 25006 - DNA, 15 bp, Homo sapiens
agagcagtctctgta

SEQ ID NO: 25007 - DNA, 15 bp, Homo sapiens
gagagcagtctctgt

SEQ ID NO: 25008 - DNA, 15 bp, Homo sapiens
tgagagcagtctctg

SEQ ID NO: 25009 - DNA, 15 bp, Homo sapiens
gtgagagcagtctct

SEQ ID NO: 25010 - DNA, 15 bp, Homo sapiens
agtgagagcagtctc

SEQ ID NO: 25011 - DNA, 15 bp, Homo sapiens
aagtgagagcagtct

SEQ ID NO: 25012 - DNA, 15 bp, Homo sapiens
caagtgagagcagtc

SEQ ID NO: 25013 - DNA, 15 bp, Homo sapiens
gcaagtgagagcagt

SEQ ID NO: 25014 - DNA, 15 bp, Homo sapiens
ggcaagtgagagcag

SEQ ID NO: 25015 - DNA, 15 bp, Homo sapiens
aggcaagtgagagca

SEQ ID NO: 25016 - DNA, 15 bp, Homo sapiens
taggcaagtgagagc

SEQ ID NO: 25017 - DNA, 15 bp, Homo sapiens
ctaggcaagtgagag

SEQ ID NO: 25018 - DNA, 15 bp, Homo sapiens
actaggcaagtgaga

SEQ ID NO: 25019 - DNA, 15 bp, Homo sapiens
tactaggcaagtgag

SEQ ID NO: 25020 - DNA, 15 bp, Homo sapiens
ctactaggcaagtga

SEQ ID NO: 25021 - DNA, 15 bp, Homo sapiens
tctactaggcaagtg

SEQ ID NO: 25022 - DNA, 15 bp, Homo sapiens
ctctactaggcaagt

SEQ ID NO: 25023 - DNA, 15 bp, Homo sapiens
tctctactaggcaag

SEQ ID NO: 25024 - DNA, 15 bp, Homo sapiens
ttctctactaggcaa

SEQ ID NO: 25025 - DNA, 15 bp, Homo sapiens
cttctctactaggca

SEQ ID NO: 25026 - DNA, 15 bp, Homo sapiens
tcttctctactaggc

SEQ ID NO: 25027 - DNA, 15 bp, Homo sapiens
atcttctctactagg

SEQ ID NO: 25028 - DNA, 15 bp, Homo sapiens
catcttctctactag

SEQ ID NO: 25029 - DNA, 15 bp, Homo sapiens
tcatcttctctacta

SEQ ID NO: 25030 - DNA, 15 bp, Homo sapiens
ttcatcttctctact

SEQ ID NO: 25031 - DNA, 15 bp, Homo sapiens
attcatcttctctac

SEQ ID NO: 25032 - DNA, 15 bp, Homo sapiens
cattcatcttctcta

SEQ ID NO: 25033 - DNA, 15 bp, Homo sapiens
acattcatcttctct

SEQ ID NO: 25034 - DNA, 15 bp, Homo sapiens
tacattcatcttctc

SEQ ID NO: 25035 - DNA, 15 bp, Homo sapiens
atacattcatcttct

SEQ ID NO: 25036 - DNA, 15 bp, Homo sapiens
aatacattcatcttc

SEQ ID NO: 25037 - DNA, 15 bp, Homo sapiens
aaatacattcatctt

SEQ ID NO: 25038 - DNA, 15 bp, Homo sapiens
caaatacattcatct

SEQ ID NO: 25039 - DNA, 15 bp, Homo sapiens
tcaaatacattcatc

SEQ ID NO: 25040 - DNA, 15 bp, Homo sapiens
atcaaatacattcat

SEQ ID NO: 25041 - DNA, 15 bp, Homo sapiens
tatcaaatacattca

SEQ ID NO: 25042 - DNA, 15 bp, Homo sapiens
gtatcaaatacattc

SEQ ID NO: 25043 - DNA, 15 bp, Homo sapiens
ggtatcaaatacatt

SEQ ID NO: 25044 - DNA, 15 bp, Homo sapiens
cggtatcaaatacat

SEQ ID NO: 25045 - DNA, 15 bp, Homo sapiens
tcggtatcaaataca

SEQ ID NO: 25046 - DNA, 15 bp, Homo sapiens
ttcggtatcaaatac

SEQ ID NO: 25047 - DNA, 15 bp, Homo sapiens
attcggtatcaaata

SEQ ID NO: 25048 - DNA, 15 bp, Homo sapiens
aattcggtatcaaat

SEQ ID NO: 25049 - DNA, 15 bp, Homo sapiens
caattcggtatcaaa

SEQ ID NO: 25050 - DNA, 15 bp, Homo sapiens
tcaattcggtatcaa

SEQ ID NO: 25051 - DNA, 15 bp, Homo sapiens
ttcaattcggtatca

SEQ ID NO: 25052 - DNA, 15 bp, Homo sapiens
cttcaattcggtatc

SEQ ID NO: 25053 - DNA, 15 bp, Homo sapiens
ccttcaattcggtat

SEQ ID NO: 25054 - DNA, 15 bp, Homo sapiens
cccttcaattcggta

SEQ ID NO: 25055 - DNA, 15 bp, Homo sapiens
acccttcaattcggt

SEQ ID NO: 25056 - DNA, 15 bp, Homo sapiens
gacccttcaattcgg

SEQ ID NO: 25057 - DNA, 15 bp, Homo sapiens
agacccttcaattcg

SEQ ID NO: 25058 - DNA, 15 bp, Homo sapiens
aagacccttcaattc

SEQ ID NO: 25059 - DNA, 15 bp, Homo sapiens
aaagacccttcaatt

SEQ ID NO: 25060 - DNA, 15 bp, Homo sapiens
gaaagacccttcaat

SEQ ID NO: 25061 - DNA, 15 bp, Homo sapiens
agaaagacccttcaa

SEQ ID NO: 25062 - DNA, 15 bp, Homo sapiens
tagaaagacccttca

SEQ ID NO: 25063 - DNA, 15 bp, Homo sapiens
ttagaaagacccttc

SEQ ID NO: 25064 - DNA, 15 bp, Homo sapiens
tttagaaagaccctt

SEQ ID NO: 25065 - DNA, 15 bp, Homo sapiens
ttttagaaagaccct

SEQ ID NO: 25066 - DNA, 15 bp, Homo sapiens
attttagaaagaccc

SEQ ID NO: 25067 - DNA, 15 bp, Homo sapiens
tattttagaaagacc

SEQ ID NO: 25068 - DNA, 15 bp, Homo sapiens
ctattttagaaagac

SEQ ID NO: 25069 - DNA, 15 bp, Homo sapiens
tctattttagaaaga

SEQ ID NO: 25070 - DNA, 15 bp, Homo sapiens
ttctattttagaaag

SEQ ID NO: 25071 - DNA, 15 bp, Homo sapiens
gttctattttagaaa

SEQ ID NO: 25072 - DNA, 15 bp, Homo sapiens
cgttctattttagaa

SEQ ID NO: 25073 - DNA, 15 bp, Homo sapiens
acgttctattttaga

SEQ ID NO: 25074 - DNA, 15 bp, Homo sapiens
cacgttctattttag

SEQ ID NO: 25075 - DNA, 15 bp, Homo sapiens
gcacgttctatttta

SEQ ID NO: 25076 - DNA, 15 bp, Homo sapiens
tgcacgttctatttt

SEQ ID NO: 25077 - DNA, 15 bp, Homo sapiens
ttgcacgttctattt

SEQ ID NO: 25078 - DNA, 15 bp, Homo sapiens
tttgcacgttctatt

SEQ ID NO: 25079 - DNA, 15 bp, Homo sapiens
atttgcacgttctat

SEQ ID NO: 25080 - DNA, 15 bp, Homo sapiens
catttgcacgttcta

SEQ ID NO: 25081 - DNA, 15 bp, Homo sapiens
gcatttgcacgttct

SEQ ID NO: 25082 - DNA, 15 bp, Homo sapiens
ggcatttgcacgttc

SEQ ID NO: 25083 - DNA, 15 bp, Homo sapiens
aggcatttgcacgtt

SEQ ID NO: 25084 - DNA, 15 bp, Homo sapiens
caggcatttgcacgt

SEQ ID NO: 25085 - DNA, 15 bp, Homo sapiens
gcaggcatttgcacg

SEQ ID NO: 25086 - DNA, 15 bp, Homo sapiens
tgcaggcatttgcac

SEQ ID NO: 25087 - DNA, 15 bp, Homo sapiens
ttgcaggcatttgca

SEQ ID NO: 25088 - DNA, 15 bp, Homo sapiens
gttgcaggcatttgc

SEQ ID NO: 25089 - DNA, 15 bp, Homo sapiens
agttgcaggcatttg

SEQ ID NO: 25090 - DNA, 15 bp, Homo sapiens
gagttgcaggcattt

SEQ ID NO: 25091 - DNA, 15 bp, Homo sapiens
tgagttgcaggcatt

SEQ ID NO: 25092 - DNA, 15 bp, Homo sapiens
ctgagttgcaggcat

SEQ ID NO: 25093 - DNA, 15 bp, Homo sapiens
actgagttgcaggca

SEQ ID NO: 25094 - DNA, 15 bp, Homo sapiens
cactgagttgcaggc

SEQ ID NO: 25095 - DNA, 15 bp, Homo sapiens
tcactgagttgcagg

SEQ ID NO: 25096 - DNA, 15 bp, Homo sapiens
ctcactgagttgcag

SEQ ID NO: 25097 - DNA, 15 bp, Homo sapiens
actcactgagttgca

SEQ ID NO: 25098 - DNA, 15 bp, Homo sapiens
tactcactgagttgc

SEQ ID NO: 25099 - DNA, 15 bp, Homo sapiens
atactcactgagttg

SEQ ID NO: 25100 - DNA, 15 bp, Homo sapiens
aatactcactgagtt

SEQ ID NO: 25101 - DNA, 15 bp, Homo sapiens
aaatactcactgagt

SEQ ID NO: 25102 - DNA, 15 bp, Homo sapiens
caaatactcactgag

SEQ ID NO: 25103 - DNA, 15 bp, Homo sapiens
tcaaatactcactga

SEQ ID NO: 25104 - DNA, 15 bp, Homo sapiens
ttcaaatactcactg

SEQ ID NO: 25105 - DNA, 15 bp, Homo sapiens
gttcaaatactcact

SEQ ID NO: 25106 - DNA, 15 bp, Homo sapiens
ggttcaaatactcac

SEQ ID NO: 25107 - DNA, 15 bp, Homo sapiens
aggttcaaatactca

SEQ ID NO: 25108 - DNA, 15 bp, Homo sapiens
caggttcaaatactc

SEQ ID NO: 25109 - DNA, 15 bp, Homo sapiens
ccaggttcaaatact

SEQ ID NO: 25110 - DNA, 15 bp, Homo sapiens
accaggttcaaatac

SEQ ID NO: 25111 - DNA, 15 bp, Homo sapiens
aaccaggttcaaata

SEQ ID NO: 25112 - DNA, 15 bp, Homo sapiens
aaaccaggttcaaat

SEQ ID NO: 25113 - DNA, 15 bp, Homo sapiens
taaaccaggttcaaa

SEQ ID NO: 25114 - DNA, 15 bp, Homo sapiens
ataaaccaggttcaa

SEQ ID NO: 25115 - DNA, 15 bp, Homo sapiens
aataaaccaggttca

SEQ ID NO: 25116 - DNA, 15 bp, Homo sapiens
caataaaccaggttc

SEQ ID NO: 25117 - DNA, 15 bp, Homo sapiens
acaataaaccaggtt

SEQ ID NO: 25118 - DNA, 15 bp, Homo sapiens
aacaataaaccaggt

SEQ ID NO: 25119 - DNA, 15 bp, Homo sapiens
gaacaataaaccagg

SEQ ID NO: 25120 - DNA, 15 bp, Homo sapiens
tgaacaataaaccag

SEQ ID NO: 25121 - DNA, 15 bp, Homo sapiens
atgaacaataaacca

SEQ ID NO: 25122 - DNA, 15 bp, Homo sapiens
catgaacaataaacc

SEQ ID NO: 25123 - DNA, 15 bp, Homo sapiens
gcatgaacaataaac

SEQ ID NO: 25124 - DNA, 15 bp, Homo sapiens
agcatgaacaataaa

SEQ ID NO: 25125 - DNA, 15 bp, Homo sapiens
cagcatgaacaataa

SEQ ID NO: 25126 - DNA, 15 bp, Homo sapiens
gcagcatgaacaata

SEQ ID NO: 25127 - DNA, 15 bp, Homo sapiens
agcagcatgaacaat

SEQ ID NO: 25128 - DNA, 15 bp, Homo sapiens
aagcagcatgaacaa

SEQ ID NO: 25129 - DNA, 15 bp, Homo sapiens
taagcagcatgaaca

SEQ ID NO: 25130 - DNA, 15 bp, Homo sapiens
ataagcagcatgaac

SEQ ID NO: 25131 - DNA, 15 bp, Homo sapiens
gataagcagcatgaa

SEQ ID NO: 25132 - DNA, 15 bp, Homo sapiens
tgataagcagcatga

SEQ ID NO: 25133 - DNA, 15 bp, Homo sapiens
ctgataagcagcatg

SEQ ID NO: 25134 - DNA, 15 bp, Homo sapiens
actgataagcagcat

SEQ ID NO: 25135 - DNA, 15 bp, Homo sapiens
gactgataagcagca

SEQ ID NO: 25136 - DNA, 15 bp, Homo sapiens
cgactgataagcagc

SEQ ID NO: 25137 - DNA, 15 bp, Homo sapiens
acgactgataagcag

SEQ ID NO: 25138 - DNA, 15 bp, Homo sapiens
tacgactgataagca

SEQ ID NO: 25139 - DNA, 15 bp, Homo sapiens
gtacgactgataagc

SEQ ID NO: 25140 - DNA, 15 bp, Homo sapiens
agtacgactgataag

SEQ ID NO: 25141 - DNA, 15 bp, Homo sapiens
tagtacgactgataa

SEQ ID NO: 25142 - DNA, 15 bp, Homo sapiens
atagtacgactgata

SEQ ID NO: 25143 - DNA, 15 bp, Homo sapiens
tatagtacgactgat

SEQ ID NO: 25144 - DNA, 15 bp, Homo sapiens
atatagtacgactga

SEQ ID NO: 25145 - DNA, 15 bp, Homo sapiens
tatatagtacgactg

SEQ ID NO: 25146 - DNA, 15 bp, Homo sapiens
atatatagtacgact

SEQ ID NO: 25147 - DNA, 15 bp, Homo sapiens
tatatatagtacgac

SEQ ID NO: 25148 - DNA, 15 bp, Homo sapiens
gtatatatagtacga

SEQ ID NO: 25149 - DNA, 15 bp, Homo sapiens
agtatatatagtacg

SEQ ID NO: 25150 - DNA, 15 bp, Homo sapiens
aagtatatatagtac

SEQ ID NO: 25151 - DNA, 15 bp, Homo sapiens
taagtatatatagta

SEQ ID NO: 25152 - DNA, 15 bp, Homo sapiens
ctaagtatatatagt

SEQ ID NO: 25153 - DNA, 15 bp, Homo sapiens
actaagtatatatag

SEQ ID NO: 25154 - DNA, 15 bp, Homo sapiens
cactaagtatatata

SEQ ID NO: 25155 - DNA, 15 bp, Homo sapiens
acactaagtatatat

SEQ ID NO: 25156 - DNA, 15 bp, Homo sapiens
gacactaagtatata

SEQ ID NO: 25157 - DNA, 15 bp, Homo sapiens
agacactaagtatat

SEQ ID NO: 25158 - DNA, 15 bp, Homo sapiens
cagacactaagtata

SEQ ID NO: 25159 - DNA, 15 bp, Homo sapiens
gcagacactaagtat

SEQ ID NO: 25160 - DNA, 15 bp, Homo sapiens
tgcagacactaagta

SEQ ID NO: 25161 - DNA, 15 bp, Homo sapiens
gtgcagacactaagt

SEQ ID NO: 25162 - DNA, 15 bp, Homo sapiens
agtgcagacactaag

SEQ ID NO: 25163 - DNA, 15 bp, Homo sapiens
cagtgcagacactaa

SEQ ID NO: 25164 - DNA, 15 bp, Homo sapiens
acagtgcagacacta

SEQ ID NO: 25165 - DNA, 15 bp, Homo sapiens
gacagtgcagacact

SEQ ID NO: 25166 - DNA, 15 bp, Homo sapiens
ggacagtgcagacac

SEQ ID NO: 25167 - DNA, 15 bp, Homo sapiens
aggacagtgcagaca

SEQ ID NO: 25168 - DNA, 15 bp, Homo sapiens
taggacagtgcagac

SEQ ID NO: 25169 - DNA, 15 bp, Homo sapiens
gtaggacagtgcaga

SEQ ID NO: 25170 - DNA, 15 bp, Homo sapiens
agtaggacagtgcag

SEQ ID NO: 25171 - DNA, 15 bp, Homo sapiens
gagtaggacagtgca

SEQ ID NO: 25172 - DNA, 15 bp, Homo sapiens
agagtaggacagtgc

SEQ ID NO: 25173 - DNA, 15 bp, Homo sapiens
gagagtaggacagtg

SEQ ID NO: 25174 - DNA, 15 bp, Homo sapiens
agagagtaggacagt

SEQ ID NO: 25175 - DNA, 15 bp, Homo sapiens
aagagagtaggacag

SEQ ID NO: 25176 - DNA, 15 bp, Homo sapiens
taagagagtaggaca

SEQ ID NO: 25177 - DNA, 15 bp, Homo sapiens
ctaagagagtaggac

SEQ ID NO: 25178 - DNA, 15 bp, Homo sapiens
tctaagagagtagga

SEQ ID NO: 25179 - DNA, 15 bp, Homo sapiens
ttctaagagagtagg

SEQ ID NO: 25180 - DNA, 15 bp, Homo sapiens
tttctaagagagtag

SEQ ID NO: 25181 - DNA, 15 bp, Homo sapiens
ttttctaagagagta

SEQ ID NO: 25182 - DNA, 15 bp, Homo sapiens
gttttctaagagagt

SEQ ID NO: 25183 - DNA, 15 bp, Homo sapiens
agttttctaagagag

SEQ ID NO: 25184 - DNA, 15 bp, Homo sapiens
tagttttctaagaga

SEQ ID NO: 25185 - DNA, 15 bp, Homo sapiens
ttagttttctaagag

SEQ ID NO: 25186 - DNA, 15 bp, Homo sapiens
attagttttctaaga

SEQ ID NO: 25187 - DNA, 15 bp, Homo sapiens
aattagttttctaag

SEQ ID NO: 25188 - DNA, 15 bp, Homo sapiens
taattagttttctaa

SEQ ID NO: 25189 - DNA, 15 bp, Homo sapiens
ataattagttttcta

SEQ ID NO: 25190 - DNA, 15 bp, Homo sapiens
tataattagttttct

SEQ ID NO: 25191 - DNA, 15 bp, Homo sapiens
gtataattagttttc

SEQ ID NO: 25192 - DNA, 15 bp, Homo sapiens
ggtataattagtttt

SEQ ID NO: 25193 - DNA, 15 bp, Homo sapiens
aggtataattagttt

SEQ ID NO: 25194 - DNA, 15 bp, Homo sapiens
aaggtataattagtt

SEQ ID NO: 25195 - DNA, 15 bp, Homo sapiens
taaggtataattagt

SEQ ID NO: 25196 - DNA, 15 bp, Homo sapiens
ataaggtataattag

SEQ ID NO: 25197 - DNA, 15 bp, Homo sapiens
gataaggtataatta

SEQ ID NO: 25198 - DNA, 15 bp, Homo sapiens
agataaggtataatt

SEQ ID NO: 25199 - DNA, 15 bp, Homo sapiens
gagataaggtataat

SEQ ID NO: 25200 - DNA, 15 bp, Homo sapiens
ggagataaggtataa

SEQ ID NO: 25201 - DNA, 15 bp, Homo sapiens
aggagataaggtata

SEQ ID NO: 25202 - DNA, 15 bp, Homo sapiens
gaggagataaggtat

SEQ ID NO: 25203 - DNA, 15 bp, Homo sapiens
tgaggagataaggta

SEQ ID NO: 25204 - DNA, 15 bp, Homo sapiens
ttgaggagataaggt

SEQ ID NO: 25205 - DNA, 15 bp, Homo sapiens
tttgaggagataagg

SEQ ID NO: 25206 - DNA, 15 bp, Homo sapiens
gtttgaggagataag

SEQ ID NO: 25207 - DNA, 15 bp, Homo sapiens
agtttgaggagataa

SEQ ID NO: 25208 - DNA, 15 bp, Homo sapiens
aagtttgaggagata

SEQ ID NO: 25209 - DNA, 15 bp, Homo sapiens
taagtttgaggagat

SEQ ID NO: 25210 - DNA, 15 bp, Homo sapiens
gtaagtttgaggaga

SEQ ID NO: 25211 - DNA, 15 bp, Homo sapiens
tgtaagtttgaggag

SEQ ID NO: 25212 - DNA, 15 bp, Homo sapiens
ctgtaagtttgagga

SEQ ID NO: 25213 - DNA, 15 bp, Homo sapiens
actgtaagtttgagg

SEQ ID NO: 25214 - DNA, 15 bp, Homo sapiens
tactgtaagtttgag

SEQ ID NO: 25215 - DNA, 15 bp, Homo sapiens
atactgtaagtttga

SEQ ID NO: 25216 - DNA, 15 bp, Homo sapiens
aatactgtaagtttg

SEQ ID NO: 25217 - DNA, 15 bp, Homo sapiens
aaatactgtaagttt

SEQ ID NO: 25218 - DNA, 15 bp, Homo sapiens
gaaatactgtaagtt

SEQ ID NO: 25219 - DNA, 15 bp, Homo sapiens
ggaaatactgtaagt

SEQ ID NO: 25220 - DNA, 15 bp, Homo sapiens
aggaaatactgtaag

SEQ ID NO: 25221 - DNA, 15 bp, Homo sapiens
aaggaaatactgtaa

SEQ ID NO: 25222 - DNA, 15 bp, Homo sapiens
gaaggaaatactgta

SEQ ID NO: 25223 - DNA, 15 bp, Homo sapiens
ggaaggaaatactgt

SEQ ID NO: 25224 - DNA, 15 bp, Homo sapiens
gggaaggaaatactg

SEQ ID NO: 25225 - DNA, 15 bp, Homo sapiens
ggggaaggaaatact

SEQ ID NO: 25226 - DNA, 15 bp, Homo sapiens
tggggaaggaaatac

SEQ ID NO: 25227 - DNA, 15 bp, Homo sapiens
atggggaaggaaata

SEQ ID NO: 25228 - DNA, 15 bp, Homo sapiens
tatggggaaggaaat

SEQ ID NO: 25229 - DNA, 15 bp, Homo sapiens
atatggggaaggaaa

SEQ ID NO: 25230 - DNA, 15 bp, Homo sapiens
aatatggggaaggaa

SEQ ID NO: 25231 - DNA, 15 bp, Homo sapiens
gaatatggggaagga

SEQ ID NO: 25232 - DNA, 15 bp, Homo sapiens
tgaatatggggaagg

SEQ ID NO: 25233 - DNA, 15 bp, Homo sapiens
gtgaatatggggaag

SEQ ID NO: 25234 - DNA, 15 bp, Homo sapiens
agtgaatatggggaa

SEQ ID NO: 25235 - DNA, 15 bp, Homo sapiens
gagtgaatatgggga

SEQ ID NO: 25236 - DNA, 15 bp, Homo sapiens
agagtgaatatgggg

SEQ ID NO: 25237 - DNA, 15 bp, Homo sapiens
gagagtgaatatggg

SEQ ID NO: 25238 - DNA, 15 bp, Homo sapiens
tgagagtgaatatgg

SEQ ID NO: 25239 - DNA, 15 bp, Homo sapiens
ctgagagtgaatatg

SEQ ID NO: 25240 - DNA, 15 bp, Homo sapiens
cctgagagtgaatat

SEQ ID NO: 25241 - DNA, 15 bp, Homo sapiens
acctgagagtgaata

SEQ ID NO: 25242 - DNA, 15 bp, Homo sapiens
tacctgagagtgaat

SEQ ID NO: 25243 - DNA, 15 bp, Homo sapiens
ttacctgagagtgaa

SEQ ID NO: 25244 - DNA, 15 bp, Homo sapiens
cttacctgagagtga

SEQ ID NO: 25245 - DNA, 15 bp, Homo sapiens
tcttacctgagagtg

SEQ ID NO: 25246 - DNA, 15 bp, Homo sapiens
atcttacctgagagt

SEQ ID NO: 25247 - DNA, 15 bp, Homo sapiens
catcttacctgagag

SEQ ID NO: 25248 - DNA, 15 bp, Homo sapiens
gcatcttacctgaga

SEQ ID NO: 25249 - DNA, 15 bp, Homo sapiens
agcatcttacctgag

SEQ ID NO: 25250 - DNA, 15 bp, Homo sapiens
gagcatcttacctga

SEQ ID NO: 25251 - DNA, 15 bp, Homo sapiens
agagcatcttacctg

SEQ ID NO: 25252 - DNA, 15 bp, Homo sapiens
aagagcatcttacct

SEQ ID NO: 25253 - DNA, 15 bp, Homo sapiens
gaagagcatcttacc

SEQ ID NO: 25254 - DNA, 15 bp, Homo sapiens
ggaagagcatcttac

SEQ ID NO: 25255 - DNA, 15 bp, Homo sapiens
aggaagagcatctta

SEQ ID NO: 25256 - DNA, 15 bp, Homo sapiens
caggaagagcatctt

SEQ ID NO: 25257 - DNA, 15 bp, Homo sapiens
acaggaagagcatct

SEQ ID NO: 25258 - DNA, 15 bp, Homo sapiens
cacaggaagagcatc

SEQ ID NO: 25259 - DNA, 15 bp, Homo sapiens
acacaggaagagcat

SEQ ID NO: 25260 - DNA, 15 bp, Homo sapiens
tacacaggaagagca

SEQ ID NO: 25261 - DNA, 15 bp, Homo sapiens
atacacaggaagagc

SEQ ID NO: 25262 - DNA, 15 bp, Homo sapiens
aatacacaggaagag

SEQ ID NO: 25263 - DNA, 15 bp, Homo sapiens
aaatacacaggaaga

SEQ ID NO: 25264 - DNA, 15 bp, Homo sapiens
caaatacacaggaag

SEQ ID NO: 25265 - DNA, 15 bp, Homo sapiens
tcaaatacacaggaa

SEQ ID NO: 25266 - DNA, 15 bp, Homo sapiens
gtcaaatacacagga

SEQ ID NO: 25267 - DNA, 15 bp, Homo sapiens
ggtcaaatacacagg

SEQ ID NO: 25268 - DNA, 15 bp, Homo sapiens
tggtcaaatacacag

SEQ ID NO: 25269 - DNA, 15 bp, Homo sapiens
ctggtcaaatacaca

SEQ ID NO: 25270 - DNA, 15 bp, Homo sapiens
cctggtcaaatacac

SEQ ID NO: 25271 - DNA, 15 bp, Homo sapiens
tcctggtcaaataca

SEQ ID NO: 25272 - DNA, 15 bp, Homo sapiens
ttcctggtcaaatac

SEQ ID NO: 25273 - DNA, 15 bp, Homo sapiens
tttcctggtcaaata

SEQ ID NO: 25274 - DNA, 15 bp, Homo sapiens
ttttcctggtcaaat

SEQ ID NO: 25275 - DNA, 15 bp, Homo sapiens
attttcctggtcaaa

SEQ ID NO: 25276 - DNA, 15 bp, Homo sapiens
tattttcctggtcaa

SEQ ID NO: 25277 - DNA, 15 bp, Homo sapiens
ttattttcctggtca

SEQ ID NO: 25278 - DNA, 15 bp, Homo sapiens
tttattttcctggtc

SEQ ID NO: 25279 - DNA, 15 bp, Homo sapiens
ttttattttcctggt

SEQ ID NO: 25280 - DNA, 15 bp, Homo sapiens
cttttattttcctgg

SEQ ID NO: 25281 - DNA, 15 bp, Homo sapiens
gcttttattttcctg

SEQ ID NO: 25282 - DNA, 15 bp, Homo sapiens
tgcttttattttcct

SEQ ID NO: 25283 - DNA, 15 bp, Homo sapiens
ttgcttttattttcc

SEQ ID NO: 25284 - DNA, 15 bp, Homo sapiens
attgcttttattttc

SEQ ID NO: 25285 - DNA, 15 bp, Homo sapiens
gattgcttttatttt

SEQ ID NO: 25286 - DNA, 15 bp, Homo sapiens
tgattgcttttattt

SEQ ID NO: 25287 - DNA, 15 bp, Homo sapiens
ttgattgcttttatt

SEQ ID NO: 25288 - DNA, 15 bp, Homo sapiens
attgattgcttttat

SEQ ID NO: 25289 - DNA, 15 bp, Homo sapiens
tattgattgctttta

SEQ ID NO: 25290 - DNA, 15 bp, Homo sapiens
ctattgattgctttt

SEQ ID NO: 25291 - DNA, 15 bp, Homo sapiens
gctattgattgcttt

SEQ ID NO: 25292 - DNA, 15 bp, Homo sapiens
agctattgattgctt

SEQ ID NO: 25293 - DNA, 15 bp, Homo sapiens
tagctattgattgct

SEQ ID NO: 25294 - DNA, 15 bp, Homo sapiens
ttagctattgattgc

SEQ ID NO: 25295 - DNA, 15 bp, Homo sapiens
attagctattgattg

SEQ ID NO: 25296 - DNA, 15 bp, Homo sapiens
aattagctattgatt

SEQ ID NO: 25297 - DNA, 15 bp, Homo sapiens
aaattagctattgat

SEQ ID NO: 25298 - DNA, 15 bp, Homo sapiens
gaaattagctattga

SEQ ID NO: 25299 - DNA, 15 bp, Homo sapiens
ggaaattagctattg

SEQ ID NO: 25300 - DNA, 15 bp, Homo sapiens
aggaaattagctatt

SEQ ID NO: 25301 - DNA, 15 bp, Homo sapiens
aaggaaattagctat

SEQ ID NO: 25302 - DNA, 15 bp, Homo sapiens
caaggaaattagcta

SEQ ID NO: 25303 - DNA, 15 bp, Homo sapiens
tcaaggaaattagct

SEQ ID NO: 25304 - DNA, 15 bp, Homo sapiens
ctcaaggaaattagc

SEQ ID NO: 25305 - DNA, 15 bp, Homo sapiens
gctcaaggaaattag

SEQ ID NO: 25306 - DNA, 15 bp, Homo sapiens
cgctcaaggaaatta

SEQ ID NO: 25307 - DNA, 15 bp, Homo sapiens
tcgctcaaggaaatt

SEQ ID NO: 25308 - DNA, 15 bp, Homo sapiens
gtcgctcaaggaaat

SEQ ID NO: 25309 - DNA, 15 bp, Homo sapiens
ggtcgctcaaggaaa

SEQ ID NO: 25310 - DNA, 15 bp, Homo sapiens
gggtcgctcaaggaa

SEQ ID NO: 25311 - DNA, 15 bp, Homo sapiens
agggtcgctcaagga

SEQ ID NO: 25312 - DNA, 15 bp, Homo sapiens
gagggtcgctcaagg

SEQ ID NO: 25313 - DNA, 15 bp, Homo sapiens
agagggtcgctcaag

SEQ ID NO: 25314 - DNA, 15 bp, Homo sapiens
cagagggtcgctcaa

SEQ ID NO: 25315 - DNA, 15 bp, Homo sapiens
ccagagggtcgctca

SEQ ID NO: 25316 - DNA, 15 bp, Homo sapiens
cccagagggtcgctc

SEQ ID NO: 25317 - DNA, 15 bp, Homo sapiens
gcccagagggtcgct

SEQ ID NO: 25318 - DNA, 15 bp, Homo sapiens
ggcccagagggtcgc

SEQ ID NO: 25319 - DNA, 15 bp, Homo sapiens
gggcccagagggtcg

SEQ ID NO: 25320 - DNA, 15 bp, Homo sapiens
tgggcccagagggtc

SEQ ID NO: 25321 - DNA, 15 bp, Homo sapiens
gtgggcccagagggt

SEQ ID NO: 25322 - DNA, 15 bp, Homo sapiens
tgtgggcccagaggg

SEQ ID NO: 25323 - DNA, 15 bp, Homo sapiens
ctgtgggcccagagg

SEQ ID NO: 25324 - DNA, 15 bp, Homo sapiens
cctgtgggcccagag

SEQ ID NO: 25325 - DNA, 15 bp, Homo sapiens
ccctgtgggcccaga

SEQ ID NO: 25326 - DNA, 15 bp, Homo sapiens
cccctgtgggcccag

SEQ ID NO: 25327 - DNA, 15 bp, Homo sapiens
gcccctgtgggccca

SEQ ID NO: 25328 - DNA, 15 bp, Homo sapiens
agcccctgtgggccc

SEQ ID NO: 25329 - DNA, 15 bp, Homo sapiens
cagcccctgtgggcc

SEQ ID NO: 25330 - DNA, 15 bp, Homo sapiens
gcagcccctgtgggc

SEQ ID NO: 25331 - DNA, 15 bp, Homo sapiens
ggcagcccctgtggg

SEQ ID NO: 25332 - DNA, 15 bp, Homo sapiens
aggcagcccctgtgg

SEQ ID NO: 25333 - DNA, 15 bp, Homo sapiens
aaggcagcccctgtg

SEQ ID NO: 25334 - DNA, 15 bp, Homo sapiens
gaaggcagcccctgt

SEQ ID NO: 25335 - DNA, 15 bp, Homo sapiens
agaaggcagcccctg

SEQ ID NO: 25336 - DNA, 15 bp, Homo sapiens
gagaaggcagcccct

SEQ ID NO: 25337 - DNA, 15 bp, Homo sapiens
ggagaaggcagcccc

SEQ ID NO: 25338 - DNA, 15 bp, Homo sapiens
gggagaaggcagccc

SEQ ID NO: 25339 - DNA, 15 bp, Homo sapiens
tgggagaaggcagcc

SEQ ID NO: 25340 - DNA, 15 bp, Homo sapiens
atgggagaaggcagc

SEQ ID NO: 25341 - DNA, 15 bp, Homo sapiens
tatgggagaaggcag

SEQ ID NO: 25342 - DNA, 15 bp, Homo sapiens
ctatgggagaaggca

SEQ ID NO: 25343 - DNA, 15 bp, Homo sapiens
actatgggagaaggc

SEQ ID NO: 25344 - DNA, 15 bp, Homo sapiens
cactatgggagaagg

SEQ ID NO: 25345 - DNA, 15 bp, Homo sapiens
gcactatgggagaag

SEQ ID NO: 25346 - DNA, 15 bp, Homo sapiens
agcactatgggagaa

SEQ ID NO: 25347 - DNA, 15 bp, Homo sapiens
cagcactatgggaga

SEQ ID NO: 25348 - DNA, 15 bp, Homo sapiens
acagcactatgggag

SEQ ID NO: 25349 - DNA, 15 bp, Homo sapiens
cacagcactatggga

SEQ ID NO: 25350 - DNA, 15 bp, Homo sapiens
tcacagcactatggg

SEQ ID NO: 25351 - DNA, 15 bp, Homo sapiens
ttcacagcactatgg

SEQ ID NO: 25352 - DNA, 15 bp, Homo sapiens
gttcacagcactatg

SEQ ID NO: 25353 - DNA, 15 bp, Homo sapiens
tgttcacagcactat

SEQ ID NO: 25354 - DNA, 15 bp, Homo sapiens
ctgttcacagcacta

SEQ ID NO: 25355 - DNA, 15 bp, Homo sapiens
actgttcacagcact

SEQ ID NO: 25356 - DNA, 15 bp, Homo sapiens
cactgttcacagcac

SEQ ID NO: 25357 - DNA, 15 bp, Homo sapiens
acactgttcacagca

SEQ ID NO: 25358 - DNA, 15 bp, Homo sapiens
aacactgttcacagc

SEQ ID NO: 25359 - DNA, 15 bp, Homo sapiens
gaacactgttcacag

SEQ ID NO: 25360 - DNA, 15 bp, Homo sapiens
agaacactgttcaca

SEQ ID NO: 25361 - DNA, 15 bp, Homo sapiens
aagaacactgttcac

SEQ ID NO: 25362 - DNA, 15 bp, Homo sapiens
caagaacactgttca

SEQ ID NO: 25363 - DNA, 15 bp, Homo sapiens
gcaagaacactgttc

SEQ ID NO: 25364 - DNA, 15 bp, Homo sapiens
agcaagaacactgtt

SEQ ID NO: 25365 - DNA, 15 bp, Homo sapiens
gagcaagaacactgt

SEQ ID NO: 25366 - DNA, 15 bp, Homo sapiens
ggagcaagaacactg

SEQ ID NO: 25367 - DNA, 15 bp, Homo sapiens
aggagcaagaacact

SEQ ID NO: 25368 - DNA, 15 bp, Homo sapiens
taggagcaagaacac

SEQ ID NO: 25369 - DNA, 15 bp, Homo sapiens
ctaggagcaagaaca

SEQ ID NO: 25370 - DNA, 15 bp, Homo sapiens
gctaggagcaagaac

SEQ ID NO: 25371 - DNA, 15 bp, Homo sapiens
tgctaggagcaagaa

SEQ ID NO: 25372 - DNA, 15 bp, Homo sapiens
ctgctaggagcaaga

SEQ ID NO: 25373 - DNA, 15 bp, Homo sapiens
tctgctaggagcaag

SEQ ID NO: 25374 - DNA, 15 bp, Homo sapiens
ttctgctaggagcaa

SEQ ID NO: 25375 - DNA, 15 bp, Homo sapiens
cttctgctaggagca

SEQ ID NO: 25376 - DNA, 15 bp, Homo sapiens
gcttctgctaggagc

SEQ ID NO: 25377 - DNA, 15 bp, Homo sapiens
ggcttctgctaggag

SEQ ID NO: 25378 - DNA, 15 bp, Homo sapiens
tggcttctgctagga

SEQ ID NO: 25379 - DNA, 15 bp, Homo sapiens
gtggcttctgctagg

SEQ ID NO: 25380 - DNA, 15 bp, Homo sapiens
ggtggcttctgctag

SEQ ID NO: 25381 - DNA, 15 bp, Homo sapiens
aggtggcttctgcta

SEQ ID NO: 25382 - DNA, 15 bp, Homo sapiens
gaggtggcttctgct

SEQ ID NO: 25383 - DNA, 15 bp, Homo sapiens
ggaggtggcttctgc

SEQ ID NO: 25384 - DNA, 15 bp, Homo sapiens
aggaggtggcttctg

SEQ ID NO: 25385 - DNA, 15 bp, Homo sapiens
gaggaggtggcttct

SEQ ID NO: 25386 - DNA, 15 bp, Homo sapiens
ggaggaggtggcttc

SEQ ID NO: 25387 - DNA, 15 bp, Homo sapiens
gggaggaggtggctt

SEQ ID NO: 25388 - DNA, 15 bp, Homo sapiens
tgggaggaggtggct

SEQ ID NO: 25389 - DNA, 15 bp, Homo sapiens
ttgggaggaggtggc

SEQ ID NO: 25390 - DNA, 15 bp, Homo sapiens
gttgggaggaggtgg

SEQ ID NO: 25391 - DNA, 15 bp, Homo sapiens
tgttgggaggaggtg

SEQ ID NO: 25392 - DNA, 15 bp, Homo sapiens
atgttgggaggaggt

SEQ ID NO: 25393 - DNA, 15 bp, Homo sapiens
gatgttgggaggagg

SEQ ID NO: 25394 - DNA, 15 bp, Homo sapiens
agatgttgggaggag

SEQ ID NO: 25395 - DNA, 15 bp, Homo sapiens
aagatgttgggagga

SEQ ID NO: 25396 - DNA, 15 bp, Homo sapiens
aaagatgttgggagg

SEQ ID NO: 25397 - DNA, 15 bp, Homo sapiens
caaagatgttgggag

SEQ ID NO: 25398 - DNA, 15 bp, Homo sapiens
gcaaagatgttggga

SEQ ID NO: 25399 - DNA, 15 bp, Homo sapiens
agcaaagatgttggg

SEQ ID NO: 25400 - DNA, 15 bp, Homo sapiens
cagcaaagatgttgg

SEQ ID NO: 25401 - DNA, 15 bp, Homo sapiens
gcagcaaagatgttg

SEQ ID NO: 25402 - DNA, 15 bp, Homo sapiens
tgcagcaaagatgtt

SEQ ID NO: 25403 - DNA, 15 bp, Homo sapiens
atgcagcaaagatgt

SEQ ID NO: 25404 - DNA, 15 bp, Homo sapiens
aatgcagcaaagatg

SEQ ID NO: 25405 - DNA, 15 bp, Homo sapiens
taatgcagcaaagat

SEQ ID NO: 25406 - DNA, 15 bp, Homo sapiens
ataatgcagcaaaga

SEQ ID NO: 25407 - DNA, 15 bp, Homo sapiens
aataatgcagcaaag

SEQ ID NO: 25408 - DNA, 15 bp, Homo sapiens
caataatgcagcaaa

SEQ ID NO: 25409 - DNA, 15 bp, Homo sapiens
tcaataatgcagcaa

SEQ ID NO: 25410 - DNA, 15 bp, Homo sapiens
atcaataatgcagca

SEQ ID NO: 25411 - DNA, 15 bp, Homo sapiens
aatcaataatgcagc

SEQ ID NO: 25412 - DNA, 15 bp, Homo sapiens
aaatcaataatgcag

SEQ ID NO: 25413 - DNA, 15 bp, Homo sapiens
gaaatcaataatgca

SEQ ID NO: 25414 - DNA, 15 bp, Homo sapiens
ggaaatcaataatgc

SEQ ID NO: 25415 - DNA, 15 bp, Homo sapiens
tggaaatcaataatg

SEQ ID NO: 25416 - DNA, 15 bp, Homo sapiens
atggaaatcaataat

SEQ ID NO: 25417 - DNA, 15 bp, Homo sapiens
gatggaaatcaataa

SEQ ID NO: 25418 - DNA, 15 bp, Homo sapiens
agatggaaatcaata

SEQ ID NO: 25419 - DNA, 15 bp, Homo sapiens
gagatggaaatcaat

SEQ ID NO: 25420 - DNA, 15 bp, Homo sapiens
agagatggaaatcaa

SEQ ID NO: 25421 - DNA, 15 bp, Homo sapiens
tagagatggaaatca

SEQ ID NO: 25422 - DNA, 15 bp, Homo sapiens
gtagagatggaaatc

SEQ ID NO: 25423 - DNA, 15 bp, Homo sapiens
agtagagatggaaat

SEQ ID NO: 25424 - DNA, 15 bp, Homo sapiens
tagtagagatggaaa

SEQ ID NO: 25425 - DNA, 15 bp, Homo sapiens
ctagtagagatggaa

SEQ ID NO: 25426 - DNA, 15 bp, Homo sapiens
tctagtagagatgga

SEQ ID NO: 25427 - DNA, 15 bp, Homo sapiens
atctagtagagatgg

SEQ ID NO: 25428 - DNA, 15 bp, Homo sapiens
catctagtagagatg

SEQ ID NO: 25429 - DNA, 15 bp, Homo sapiens
acatctagtagagat

SEQ ID NO: 25430 - DNA, 15 bp, Homo sapiens
aacatctagtagaga

SEQ ID NO: 25431 - DNA, 15 bp, Homo sapiens
gaacatctagtagag

SEQ ID NO: 25432 - DNA, 15 bp, Homo sapiens
agaacatctagtaga

SEQ ID NO: 25433 - DNA, 15 bp, Homo sapiens
aagaacatctagtag

SEQ ID NO: 25434 - DNA, 15 bp, Homo sapiens
gaagaacatctagta

SEQ ID NO: 25435 - DNA, 15 bp, Homo sapiens
tgaagaacatctagt

SEQ ID NO: 25436 - DNA, 15 bp, Homo sapiens
ctgaagaacatctag

SEQ ID NO: 25437 - DNA, 15 bp, Homo sapiens
gctgaagaacatcta

SEQ ID NO: 25438 - DNA, 15 bp, Homo sapiens
tgctgaagaacatct

SEQ ID NO: 25439 - DNA, 15 bp, Homo sapiens
atgctgaagaacatc

SEQ ID NO: 25440 - DNA, 15 bp, Homo sapiens
tatgctgaagaacat

SEQ ID NO: 25441 - DNA, 15 bp, Homo sapiens
ctatgctgaagaaca

SEQ ID NO: 25442 - DNA, 15 bp, Homo sapiens
cctatgctgaagaac

SEQ ID NO: 25443 - DNA, 15 bp, Homo sapiens
ccctatgctgaagaa

SEQ ID NO: 25444 - DNA, 15 bp, Homo sapiens
cccctatgctgaaga

SEQ ID NO: 25445 - DNA, 15 bp, Homo sapiens
ccccctatgctgaag

SEQ ID NO: 25446 - DNA, 15 bp, Homo sapiens
tccccctatgctgaa

SEQ ID NO: 25447 - DNA, 15 bp, Homo sapiens
ttccccctatgctga

SEQ ID NO: 25448 - DNA, 15 bp, Homo sapiens
tttccccctatgctg

SEQ ID NO: 25449 - DNA, 15 bp, Homo sapiens
atttccccctatgct

SEQ ID NO: 25450 - DNA, 15 bp, Homo sapiens
tatttccccctatgc

SEQ ID NO: 25451 - DNA, 15 bp, Homo sapiens
ttatttccccctatg

SEQ ID NO: 25452 - DNA, 15 bp, Homo sapiens
attatttccccctat

SEQ ID NO: 25453 - DNA, 15 bp, Homo sapiens
tattatttcccccta

SEQ ID NO: 25454 - DNA, 15 bp, Homo sapiens
ctattatttccccct

SEQ ID NO: 25455 - DNA, 15 bp, Homo sapiens
actattatttccccc

SEQ ID NO: 25456 - DNA, 15 bp, Homo sapiens
cactattatttcccc

SEQ ID NO: 25457 - DNA, 15 bp, Homo sapiens
acactattatttccc

SEQ ID NO: 25458 - DNA, 15 bp, Homo sapiens
gacactattatttcc

SEQ ID NO: 25459 - DNA, 15 bp, Homo sapiens
agacactattatttc

SEQ ID NO: 25460 - DNA, 15 bp, Homo sapiens
aagacactattattt

SEQ ID NO: 25461 - DNA, 15 bp, Homo sapiens
aaagacactattatt

SEQ ID NO: 25462 - DNA, 15 bp, Homo sapiens
gaaagacactattat

SEQ ID NO: 25463 - DNA, 15 bp, Homo sapiens
agaaagacactatta

SEQ ID NO: 25464 - DNA, 15 bp, Homo sapiens
tagaaagacactatt

SEQ ID NO: 25465 - DNA, 15 bp, Homo sapiens
atagaaagacactat

SEQ ID NO: 25466 - DNA, 15 bp, Homo sapiens
gatagaaagacacta

SEQ ID NO: 25467 - DNA, 15 bp, Homo sapiens
agatagaaagacact

SEQ ID NO: 25468 - DNA, 15 bp, Homo sapiens
aagatagaaagacac

SEQ ID NO: 25469 - DNA, 15 bp, Homo sapiens
caagatagaaagaca

SEQ ID NO: 25470 - DNA, 15 bp, Homo sapiens
tcaagatagaaagac

SEQ ID NO: 25471 - DNA, 15 bp, Homo sapiens
ttcaagatagaaaga

SEQ ID NO: 25472 - DNA, 15 bp, Homo sapiens
tttcaagatagaaag

SEQ ID NO: 25473 - DNA, 15 bp, Homo sapiens
gtttcaagatagaaa

SEQ ID NO: 25474 - DNA, 15 bp, Homo sapiens
agtttcaagatagaa

SEQ ID NO: 25475 - DNA, 15 bp, Homo sapiens
aagtttcaagataga

SEQ ID NO: 25476 - DNA, 15 bp, Homo sapiens
aaagtttcaagatag

SEQ ID NO: 25477 - DNA, 15 bp, Homo sapiens
gaaagtttcaagata

SEQ ID NO: 25478 - DNA, 15 bp, Homo sapiens
ggaaagtttcaagat

SEQ ID NO: 25479 - DNA, 15 bp, Homo sapiens
aggaaagtttcaaga

SEQ ID NO: 25480 - DNA, 15 bp, Homo sapiens
aaggaaagtttcaag

SEQ ID NO: 25481 - DNA, 15 bp, Homo sapiens
aaaggaaagtttcaa

SEQ ID NO: 25482 - DNA, 15 bp, Homo sapiens
caaaggaaagtttca

SEQ ID NO: 25483 - DNA, 15 bp, Homo sapiens
tcaaaggaaagtttc

SEQ ID NO: 25484 - DNA, 15 bp, Homo sapiens
gtcaaaggaaagttt

SEQ ID NO: 25485 - DNA, 15 bp, Homo sapiens
ggtcaaaggaaagtt

SEQ ID NO: 25486 - DNA, 15 bp, Homo sapiens
aggtcaaaggaaagt

SEQ ID NO: 25487 - DNA, 15 bp, Homo sapiens
aaggtcaaaggaaag

SEQ ID NO: 25488 - DNA, 15 bp, Homo sapiens
taaggtcaaaggaaa

SEQ ID NO: 25489 - DNA, 15 bp, Homo sapiens
ataaggtcaaaggaa

SEQ ID NO: 25490 - DNA, 15 bp, Homo sapiens
aataaggtcaaagga

SEQ ID NO: 25491 - DNA, 15 bp, Homo sapiens
aaataaggtcaaagg

SEQ ID NO: 25492 - DNA, 15 bp, Homo sapiens
gaaataaggtcaaag

SEQ ID NO: 25493 - DNA, 15 bp, Homo sapiens
ggaaataaggtcaaa

SEQ ID NO: 25494 - DNA, 15 bp, Homo sapiens
gggaaataaggtcaa

SEQ ID NO: 25495 - DNA, 15 bp, Homo sapiens
ggggaaataaggtca

SEQ ID NO: 25496 - DNA, 15 bp, Homo sapiens
aggggaaataaggtc

SEQ ID NO: 25497 - DNA, 15 bp, Homo sapiens
caggggaaataaggt

SEQ ID NO: 25498 - DNA, 15 bp, Homo sapiens
acaggggaaataagg

SEQ ID NO: 25499 - DNA, 15 bp, Homo sapiens
gacaggggaaataag

SEQ ID NO: 25500 - DNA, 15 bp, Homo sapiens
tgacaggggaaataa

SEQ ID NO: 25501 - DNA, 15 bp, Homo sapiens
ctgacaggggaaata

SEQ ID NO: 25502 - DNA, 15 bp, Homo sapiens
gctgacaggggaaat

SEQ ID NO: 25503 - DNA, 15 bp, Homo sapiens
agctgacaggggaaa

SEQ ID NO: 25504 - DNA, 15 bp, Homo sapiens
tagctgacaggggaa

SEQ ID NO: 25505 - DNA, 15 bp, Homo sapiens
gtagctgacagggga

SEQ ID NO: 25506 - DNA, 15 bp, Homo sapiens
ggtagctgacagggg

SEQ ID NO: 25507 - DNA, 15 bp, Homo sapiens
tggtagctgacaggg

SEQ ID NO: 25508 - DNA, 15 bp, Homo sapiens
gtggtagctgacagg

SEQ ID NO: 25509 - DNA, 15 bp, Homo sapiens
tgtggtagctgacag

SEQ ID NO: 25510 - DNA, 15 bp, Homo sapiens
gtgtggtagctgaca

SEQ ID NO: 25511 - DNA, 15 bp, Homo sapiens
agtgtggtagctgac

SEQ ID NO: 25512 - DNA, 15 bp, Homo sapiens
aagtgtggtagctga

SEQ ID NO: 25513 - DNA, 15 bp, Homo sapiens
aaagtgtggtagctg

SEQ ID NO: 25514 - DNA, 15 bp, Homo sapiens
gaaagtgtggtagct

SEQ ID NO: 25515 - DNA, 15 bp, Homo sapiens
agaaagtgtggtagc

SEQ ID NO: 25516 - DNA, 15 bp, Homo sapiens
aagaaagtgtggtag

SEQ ID NO: 25517 - DNA, 15 bp, Homo sapiens
aaagaaagtgtggta

SEQ ID NO: 25518 - DNA, 15 bp, Homo sapiens
aaaagaaagtgtggt

SEQ ID NO: 25519 - DNA, 15 bp, Homo sapiens
gaaaagaaagtgtgg

SEQ ID NO: 25520 - DNA, 15 bp, Homo sapiens
ggaaaagaaagtgtg

SEQ ID NO: 25521 - DNA, 15 bp, Homo sapiens
aggaaaagaaagtgt

SEQ ID NO: 25522 - DNA, 15 bp, Homo sapiens
caggaaaagaaagtg

SEQ ID NO: 25523 - DNA, 15 bp, Homo sapiens
acaggaaaagaaagt

SEQ ID NO: 25524 - DNA, 15 bp, Homo sapiens
aacaggaaaagaaag

SEQ ID NO: 25525 - DNA, 15 bp, Homo sapiens
gaacaggaaaagaaa

SEQ ID NO: 25526 - DNA, 15 bp, Homo sapiens
tgaacaggaaaagaa

SEQ ID NO: 25527 - DNA, 15 bp, Homo sapiens
ttgaacaggaaaaga

SEQ ID NO: 25528 - DNA, 15 bp, Homo sapiens
attgaacaggaaaag

SEQ ID NO: 25529 - DNA, 15 bp, Homo sapiens
aattgaacaggaaaa

SEQ ID NO: 25530 - DNA, 15 bp, Homo sapiens
taattgaacaggaaa

SEQ ID NO: 25531 - DNA, 15 bp, Homo sapiens
ttaattgaacaggaa

SEQ ID NO: 25532 - DNA, 15 bp, Homo sapiens
tttaattgaacagga

SEQ ID NO: 25533 - DNA, 15 bp, Homo sapiens
gtttaattgaacagg

SEQ ID NO: 25534 - DNA, 15 bp, Homo sapiens
ggtttaattgaacag

SEQ ID NO: 25535 - DNA, 15 bp, Homo sapiens
aggtttaattgaaca

SEQ ID NO: 25536 - DNA, 15 bp, Homo sapiens
aaggtttaattgaac

SEQ ID NO: 25537 - DNA, 15 bp, Homo sapiens
aaaggtttaattgaa

SEQ ID NO: 25538 - DNA, 15 bp, Homo sapiens
aaaaggtttaattga

SEQ ID NO: 25539 - DNA, 15 bp, Homo sapiens
aaaaaggtttaattg

SEQ ID NO: 25540 - DNA, 15 bp, Homo sapiens
aaaaaaggtttaatt

SEQ ID NO: 25541 - DNA, 15 bp, Homo sapiens
aaaaaaaggtttaat

SEQ ID NO: 25542 - DNA, 15 bp, Homo sapiens
aaaaaaaaggtttaa

SEQ ID NO: 25543 - DNA, 15 bp, Homo sapiens
aaaaaaaaaggttta

SEQ ID NO: 25544 - DNA, 15 bp, Homo sapiens
aaaaaaaaaaggttt

SEQ ID NO: 25545 - DNA, 15 bp, Homo sapiens
aaaaaaaaaaaggtt

SEQ ID NO: 25546 - DNA, 15 bp, Homo sapiens
ctgtctcaaaaaaaa

SEQ ID NO: 25547 - DNA, 15 bp, Homo sapiens
aactctgtctcaaaa

SEQ ID NO: 25548 - DNA, 15 bp, Homo sapiens
aaactctgtctcaaa

SEQ ID NO: 25549 - DNA, 15 bp, Homo sapiens
gaaactctgtctcaa

SEQ ID NO: 25550 - DNA, 15 bp, Homo sapiens
agaaactctgtctca

SEQ ID NO: 25551 - DNA, 15 bp, Homo sapiens
gagaaactctgtctc

SEQ ID NO: 25552 - DNA, 15 bp, Homo sapiens
agagaaactctgtct

SEQ ID NO: 25553 - DNA, 15 bp, Homo sapiens
gagagaaactctgtc

SEQ ID NO: 25554 - DNA, 15 bp, Homo sapiens
agagagaaactctgt

SEQ ID NO: 25555 - DNA, 15 bp, Homo sapiens
cagagagaaactctg

SEQ ID NO: 25556 - DNA, 15 bp, Homo sapiens
acagagagaaactct

SEQ ID NO: 25557 - DNA, 15 bp, Homo sapiens
gacagagagaaactc

SEQ ID NO: 25558 - DNA, 15 bp, Homo sapiens
tgacagagagaaact

SEQ ID NO: 25559 - DNA, 15 bp, Homo sapiens
gtgacagagagaaac

SEQ ID NO: 25560 - DNA, 15 bp, Homo sapiens
ggtgacagagagaaa

SEQ ID NO: 25561 - DNA, 15 bp, Homo sapiens
tggtgacagagagaa

SEQ ID NO: 25562 - DNA, 15 bp, Homo sapiens
ctggtgacagagaga

SEQ ID NO: 25563 - DNA, 15 bp, Homo sapiens
tctggtgacagagag

SEQ ID NO: 25564 - DNA, 15 bp, Homo sapiens
atctggtgacagaga

SEQ ID NO: 25565 - DNA, 15 bp, Homo sapiens
aatctggtgacagag

SEQ ID NO: 25566 - DNA, 15 bp, Homo sapiens
ccaatctggtgacag

SEQ ID NO: 25567 - DNA, 15 bp, Homo sapiens
tccaatctggtgaca

SEQ ID NO: 25568 - DNA, 15 bp, Homo sapiens
ctccaatctggtgac

SEQ ID NO: 25569 - DNA, 15 bp, Homo sapiens
actccaatctggtga

SEQ ID NO: 25570 - DNA, 15 bp, Homo sapiens
cactccaatctggtg

SEQ ID NO: 25571 - DNA, 15 bp, Homo sapiens
gcactccaatctggt

SEQ ID NO: 25572 - DNA, 15 bp, Homo sapiens
ggcactccaatctgg

SEQ ID NO: 25573 - DNA, 15 bp, Homo sapiens
tggcactccaatctg

SEQ ID NO: 25574 - DNA, 15 bp, Homo sapiens
atggcactccaatct

SEQ ID NO: 25575 - DNA, 15 bp, Homo sapiens
catggcactccaatc

SEQ ID NO: 25576 - DNA, 15 bp, Homo sapiens
ccatggcactccaat

SEQ ID NO: 25577 - DNA, 15 bp, Homo sapiens
gccatggcactccaa

SEQ ID NO: 25578 - DNA, 15 bp, Homo sapiens
cgcgccatggcactc

SEQ ID NO: 25579 - DNA, 15 bp, Homo sapiens
tcgcgccatggcact

SEQ ID NO: 25580 - DNA, 15 bp, Homo sapiens
atcgcgccatggcac

SEQ ID NO: 25581 - DNA, 15 bp, Homo sapiens
gatcgcgccatggca

SEQ ID NO: 25582 - DNA, 15 bp, Homo sapiens
agatcgcgccatggc

SEQ ID NO: 25583 - DNA, 15 bp, Homo sapiens
aagatcgcgccatgg

SEQ ID NO: 25584 - DNA, 15 bp, Homo sapiens
caagatcgcgccatg

SEQ ID NO: 25585 - DNA, 15 bp, Homo sapiens
ccaagatcgcgccat

SEQ ID NO: 25586 - DNA, 15 bp, Homo sapiens
gccaagatcgcgcca

SEQ ID NO: 25587 - DNA, 15 bp, Homo sapiens
agccaagatcgcgcc

SEQ ID NO: 25588 - DNA, 15 bp, Homo sapiens
gagccaagatcgcgc

SEQ ID NO: 25589 - DNA, 15 bp, Homo sapiens
tgagccaagatcgcg

SEQ ID NO: 25590 - DNA, 15 bp, Homo sapiens
cctgggaggtggagg

SEQ ID NO: 25591 - DNA, 15 bp, Homo sapiens
acctgggaggtggag

SEQ ID NO: 25592 - DNA, 15 bp, Homo sapiens
aacctgggaggtgga

SEQ ID NO: 25593 - DNA, 15 bp, Homo sapiens
gaacctgggaggtgg

SEQ ID NO: 25594 - DNA, 15 bp, Homo sapiens
tgaacctgggaggtg

SEQ ID NO: 25595 - DNA, 15 bp, Homo sapiens
ttgaacctgggaggt

SEQ ID NO: 25596 - DNA, 15 bp, Homo sapiens
aaggcaggagaatcg

SEQ ID NO: 25597 - DNA, 15 bp, Homo sapiens
taaggcaggagaatc

SEQ ID NO: 25598 - DNA, 15 bp, Homo sapiens
ctaaggcaggagaat

SEQ ID NO: 25599 - DNA, 15 bp, Homo sapiens
gctaaggcaggagaa

SEQ ID NO: 25600 - DNA, 15 bp, Homo sapiens
ggctaaggcaggaga

SEQ ID NO: 25601 - DNA, 15 bp, Homo sapiens
gaggctaaggcagga

SEQ ID NO: 25602 - DNA, 15 bp, Homo sapiens
ggaggctaaggcagg

SEQ ID NO: 25603 - DNA, 15 bp, Homo sapiens
gggaggctaaggcag

SEQ ID NO: 25604 - DNA, 15 bp, Homo sapiens
agggaggctaaggca

SEQ ID NO: 25605 - DNA, 15 bp, Homo sapiens
tagggaggctaaggc

SEQ ID NO: 25606 - DNA, 15 bp, Homo sapiens
ctagggaggctaagg

SEQ ID NO: 25607 - DNA, 15 bp, Homo sapiens
actagggaggctaag

SEQ ID NO: 25608 - DNA, 15 bp, Homo sapiens
tactagggaggctaa

SEQ ID NO: 25609 - DNA, 15 bp, Homo sapiens
ctactagggaggcta

SEQ ID NO: 25610 - DNA, 15 bp, Homo sapiens
ccagctactagggag

SEQ ID NO: 25611 - DNA, 15 bp, Homo sapiens
cccagctactaggga

SEQ ID NO: 25612 - DNA, 15 bp, Homo sapiens
tcccagctactaggg

SEQ ID NO: 25613 - DNA, 15 bp, Homo sapiens
atcccagctactagg

SEQ ID NO: 25614 - DNA, 15 bp, Homo sapiens
aatcccagctactag

SEQ ID NO: 25615 - DNA, 15 bp, Homo sapiens
taatcccagctacta

SEQ ID NO: 25616 - DNA, 15 bp, Homo sapiens
tgtgcctgtaatccc

SEQ ID NO: 25617 - DNA, 15 bp, Homo sapiens
gtgtgcctgtaatcc

SEQ ID NO: 25618 - DNA, 15 bp, Homo sapiens
cgtgtgcctgtaatc

SEQ ID NO: 25619 - DNA, 15 bp, Homo sapiens
gcgtgtgcctgtaat

SEQ ID NO: 25620 - DNA, 15 bp, Homo sapiens
ggcgtgtgcctgtaa

SEQ ID NO: 25621 - DNA, 15 bp, Homo sapiens
tggcgtgtgcctgta

SEQ ID NO: 25622 - DNA, 15 bp, Homo sapiens
gtggcgtgtgcctgt

SEQ ID NO: 25623 - DNA, 15 bp, Homo sapiens
ggtggcgtgtgcctg

SEQ ID NO: 25624 - DNA, 15 bp, Homo sapiens
tggtggcgtgtgcct

SEQ ID NO: 25625 - DNA, 15 bp, Homo sapiens
gtggtggcgtgtgcc

SEQ ID NO: 25626 - DNA, 15 bp, Homo sapiens
cgtggtggcgtgtgc

SEQ ID NO: 25627 - DNA, 15 bp, Homo sapiens
gcgtggtggcgtgtg

SEQ ID NO: 25628 - DNA, 15 bp, Homo sapiens
ggcgtggtggcgtgt

SEQ ID NO: 25629 - DNA, 15 bp, Homo sapiens
aggcgtggtggcgtg

SEQ ID NO: 25630 - DNA, 15 bp, Homo sapiens
caggcgtggtggcgt

SEQ ID NO: 25631 - DNA, 15 bp, Homo sapiens
ccaggcgtggtggcg

SEQ ID NO: 25632 - DNA, 15 bp, Homo sapiens
agccaggcgtggtgg

SEQ ID NO: 25633 - DNA, 15 bp, Homo sapiens
tagccaggcgtggtg

SEQ ID NO: 25634 - DNA, 15 bp, Homo sapiens
ttagccaggcgtggt

SEQ ID NO: 25635 - DNA, 15 bp, Homo sapiens
aattagccaggcgtg

SEQ ID NO: 25636 - DNA, 15 bp, Homo sapiens
aaattagccaggcgt

SEQ ID NO: 25637 - DNA, 15 bp, Homo sapiens
aaaattagccaggcg

SEQ ID NO: 25638 - DNA, 15 bp, Homo sapiens
gaaaaatacaaaaaa

SEQ ID NO: 25639 - DNA, 15 bp, Homo sapiens
ctacgaaaaatacaa

SEQ ID NO: 25640 - DNA, 15 bp, Homo sapiens
tctacgaaaaataca

SEQ ID NO: 25641 - DNA, 15 bp, Homo sapiens
ttctacgaaaaatac

SEQ ID NO: 25642 - DNA, 15 bp, Homo sapiens
tttctacgaaaaata

SEQ ID NO: 25643 - DNA, 15 bp, Homo sapiens
ctttctacgaaaaat

SEQ ID NO: 25644 - DNA, 15 bp, Homo sapiens
cctttctacgaaaaa

SEQ ID NO: 25645 - DNA, 15 bp, Homo sapiens
ccctttctacgaaaa

SEQ ID NO: 25646 - DNA, 15 bp, Homo sapiens
cccctttctacgaaa

SEQ ID NO: 25647 - DNA, 15 bp, Homo sapiens
acccctttctacgaa

SEQ ID NO: 25648 - DNA, 15 bp, Homo sapiens
aacccctttctacga

SEQ ID NO: 25649 - DNA, 15 bp, Homo sapiens
aaacccctttctacg

SEQ ID NO: 25650 - DNA, 15 bp, Homo sapiens
gaaacccctttctac

SEQ ID NO: 25651 - DNA, 15 bp, Homo sapiens
tgaaacccctttcta

SEQ ID NO: 25652 - DNA, 15 bp, Homo sapiens
gtgaaacccctttct

SEQ ID NO: 25653 - DNA, 15 bp, Homo sapiens
ggtgaaacccctttc

SEQ ID NO: 25654 - DNA, 15 bp, Homo sapiens
tggtgaaaccccttt

SEQ ID NO: 25655 - DNA, 15 bp, Homo sapiens
atggtgaaacccctt

SEQ ID NO: 25656 - DNA, 15 bp, Homo sapiens
catggtgaaacccct

SEQ ID NO: 25657 - DNA, 15 bp, Homo sapiens
gcatggtgaaacccc

SEQ ID NO: 25658 - DNA, 15 bp, Homo sapiens
agcatggtgaaaccc

SEQ ID NO: 25659 - DNA, 15 bp, Homo sapiens
tagcatggtgaaacc

SEQ ID NO: 25660 - DNA, 15 bp, Homo sapiens
ctagcatggtgaaac

SEQ ID NO: 25661 - DNA, 15 bp, Homo sapiens
gctagcatggtgaaa

SEQ ID NO: 25662 - DNA, 15 bp, Homo sapiens
ggctagcatggtgaa

SEQ ID NO: 25663 - DNA, 15 bp, Homo sapiens
tggctagcatggtga

SEQ ID NO: 25664 - DNA, 15 bp, Homo sapiens
ctggctagcatggtg

SEQ ID NO: 25665 - DNA, 15 bp, Homo sapiens
cctggctagcatggt

SEQ ID NO: 25666 - DNA, 15 bp, Homo sapiens
gcctggctagcatgg

SEQ ID NO: 25667 - DNA, 15 bp, Homo sapiens
agcctggctagcatg

SEQ ID NO: 25668 - DNA, 15 bp, Homo sapiens
cagcctggctagcat

SEQ ID NO: 25669 - DNA, 15 bp, Homo sapiens
ccagcctggctagca

SEQ ID NO: 25670 - DNA, 15 bp, Homo sapiens
accagcctggctagc

SEQ ID NO: 25671 - DNA, 15 bp, Homo sapiens
gaccagcctggctag

SEQ ID NO: 25672 - DNA, 15 bp, Homo sapiens
tgggcggatcacctg

SEQ ID NO: 25673 - DNA, 15 bp, Homo sapiens
gtgggcggatcacct

SEQ ID NO: 25674 - DNA, 15 bp, Homo sapiens
ggtgggcggatcacc

SEQ ID NO: 25675 - DNA, 15 bp, Homo sapiens
aggtgggcggatcac

SEQ ID NO: 25676 - DNA, 15 bp, Homo sapiens
gaggtgggcggatca

SEQ ID NO: 25677 - DNA, 15 bp, Homo sapiens
cgaggtgggcggatc

SEQ ID NO: 25678 - DNA, 15 bp, Homo sapiens
ccgaggtgggcggat

SEQ ID NO: 25679 - DNA, 15 bp, Homo sapiens
gccgaggtgggcgga

SEQ ID NO: 25680 - DNA, 15 bp, Homo sapiens
ggccgaggtgggcgg

SEQ ID NO: 25681 - DNA, 15 bp, Homo sapiens
aggccgaggtgggcg

SEQ ID NO: 25682 - DNA, 15 bp, Homo sapiens
gaggccgaggtgggc

SEQ ID NO: 25683 - DNA, 15 bp, Homo sapiens
aggcgcggtggctca

SEQ ID NO: 25684 - DNA, 15 bp, Homo sapiens
caggcgcggtggctc

SEQ ID NO: 25685 - DNA, 15 bp, Homo sapiens
ccaggcgcggtggct

SEQ ID NO: 25686 - DNA, 15 bp, Homo sapiens
cccaggcgcggtggc

SEQ ID NO: 25687 - DNA, 15 bp, Homo sapiens
gcccaggcgcggtgg

SEQ ID NO: 25688 - DNA, 15 bp, Homo sapiens
tgcccaggcgcggtg

SEQ ID NO: 25689 - DNA, 15 bp, Homo sapiens
atgcccaggcgcggt

SEQ ID NO: 25690 - DNA, 15 bp, Homo sapiens
gatgcccaggcgcgg

SEQ ID NO: 25691 - DNA, 15 bp, Homo sapiens
tgatgcccaggcgcg

SEQ ID NO: 25692 - DNA, 15 bp, Homo sapiens
ttgatgcccaggcgc

SEQ ID NO: 25693 - DNA, 15 bp, Homo sapiens
tttgatgcccaggcg

SEQ ID NO: 25694 - DNA, 15 bp, Homo sapiens
gtttgatgcccaggc

SEQ ID NO: 25695 - DNA, 15 bp, Homo sapiens
tgtttgatgcccagg

SEQ ID NO: 25696 - DNA, 15 bp, Homo sapiens
atgtttgatgcccag

SEQ ID NO: 25697 - DNA, 15 bp, Homo sapiens
aatgtttgatgccca

SEQ ID NO: 25698 - DNA, 15 bp, Homo sapiens
aaatgtttgatgccc

SEQ ID NO: 25699 - DNA, 15 bp, Homo sapiens
gaaatgtttgatgcc

SEQ ID NO: 25700 - DNA, 15 bp, Homo sapiens
agaaatgtttgatgc

SEQ ID NO: 25701 - DNA, 15 bp, Homo sapiens
aagaaatgtttgatg

SEQ ID NO: 25702 - DNA, 15 bp, Homo sapiens
taagaaatgtttgat

SEQ ID NO: 25703 - DNA, 15 bp, Homo sapiens
ttaagaaatgtttga

SEQ ID NO: 25704 - DNA, 15 bp, Homo sapiens
gttaagaaatgtttg

SEQ ID NO: 25705 - DNA, 15 bp, Homo sapiens
agttaagaaatgttt

SEQ ID NO: 25706 - DNA, 15 bp, Homo sapiens
gagttaagaaatgtt

SEQ ID NO: 25707 - DNA, 15 bp, Homo sapiens
tgagttaagaaatgt

SEQ ID NO: 25708 - DNA, 15 bp, Homo sapiens
atgagttaagaaatg

SEQ ID NO: 25709 - DNA, 15 bp, Homo sapiens
aatgagttaagaaat

SEQ ID NO: 25710 - DNA, 15 bp, Homo sapiens
aaatgagttaagaaa

SEQ ID NO: 25711 - DNA, 15 bp, Homo sapiens
caaatgagttaagaa

SEQ ID NO: 25712 - DNA, 15 bp, Homo sapiens
tcaaatgagttaaga

SEQ ID NO: 25713 - DNA, 15 bp, Homo sapiens
atcaaatgagttaag

SEQ ID NO: 25714 - DNA, 15 bp, Homo sapiens
catcaaatgagttaa

SEQ ID NO: 25715 - DNA, 15 bp, Homo sapiens
tcatcaaatgagtta

SEQ ID NO: 25716 - DNA, 15 bp, Homo sapiens
ctcatcaaatgagtt

SEQ ID NO: 25717 - DNA, 15 bp, Homo sapiens
tctcatcaaatgagt

SEQ ID NO: 25718 - DNA, 15 bp, Homo sapiens
gtctcatcaaatgag

SEQ ID NO: 25719 - DNA, 15 bp, Homo sapiens
ggtctcatcaaatga

SEQ ID NO: 25720 - DNA, 15 bp, Homo sapiens
tggtctcatcaaatg

SEQ ID NO: 25721 - DNA, 15 bp, Homo sapiens
ctggtctcatcaaat

SEQ ID NO: 25722 - DNA, 15 bp, Homo sapiens
gctggtctcatcaaa

SEQ ID NO: 25723 - DNA, 15 bp, Homo sapiens
tgctggtctcatcaa

SEQ ID NO: 25724 - DNA, 15 bp, Homo sapiens
atgctggtctcatca

SEQ ID NO: 25725 - DNA, 15 bp, Homo sapiens
tatgctggtctcatc

SEQ ID NO: 25726 - DNA, 15 bp, Homo sapiens
ttatgctggtctcat

SEQ ID NO: 25727 - DNA, 15 bp, Homo sapiens
gttatgctggtctca

SEQ ID NO: 25728 - DNA, 15 bp, Homo sapiens
ggttatgctggtctc

SEQ ID NO: 25729 - DNA, 15 bp, Homo sapiens
tggttatgctggtct

SEQ ID NO: 25730 - DNA, 15 bp, Homo sapiens
ttggttatgctggtc

SEQ ID NO: 25731 - DNA, 15 bp, Homo sapiens
tttggttatgctggt

SEQ ID NO: 25732 - DNA, 15 bp, Homo sapiens
atttggttatgctgg

SEQ ID NO: 25733 - DNA, 15 bp, Homo sapiens
tatttggttatgctg

SEQ ID NO: 25734 - DNA, 15 bp, Homo sapiens
gtatttggttatgct

SEQ ID NO: 25735 - DNA, 15 bp, Homo sapiens
ggtatttggttatgc

SEQ ID NO: 25736 - DNA, 15 bp, Homo sapiens
tggtatttggttatg

SEQ ID NO: 25737 - DNA, 15 bp, Homo sapiens
ttggtatttggttat

SEQ ID NO: 25738 - DNA, 15 bp, Homo sapiens
tttggtatttggtta

SEQ ID NO: 25739 - DNA, 15 bp, Homo sapiens
ctttggtatttggtt

SEQ ID NO: 25740 - DNA, 15 bp, Homo sapiens
cctttggtatttggt

SEQ ID NO: 25741 - DNA, 15 bp, Homo sapiens
acctttggtatttgg

SEQ ID NO: 25742 - DNA, 15 bp, Homo sapiens
gacctttggtatttg

SEQ ID NO: 25743 - DNA, 15 bp, Homo sapiens
tgacctttggtattt

SEQ ID NO: 25744 - DNA, 15 bp, Homo sapiens
ttgacctttggtatt

SEQ ID NO: 25745 - DNA, 15 bp, Homo sapiens
attgacctttggtat

SEQ ID NO: 25746 - DNA, 15 bp, Homo sapiens
cattgacctttggta

SEQ ID NO: 25747 - DNA, 15 bp, Homo sapiens
acattgacctttggt

SEQ ID NO: 25748 - DNA, 15 bp, Homo sapiens
cacattgacctttgg

SEQ ID NO: 25749 - DNA, 15 bp, Homo sapiens
ccacattgacctttg

SEQ ID NO: 25750 - DNA, 15 bp, Homo sapiens
accacattgaccttt

SEQ ID NO: 25751 - DNA, 15 bp, Homo sapiens
caccacattgacctt

SEQ ID NO: 25752 - DNA, 15 bp, Homo sapiens
tcaccacattgacct

SEQ ID NO: 25753 - DNA, 15 bp, Homo sapiens
atcaccacattgacc

SEQ ID NO: 25754 - DNA, 15 bp, Homo sapiens
catcaccacattgac

SEQ ID NO: 25755 - DNA, 15 bp, Homo sapiens
ccatcaccacattga

SEQ ID NO: 25756 - DNA, 15 bp, Homo sapiens
accatcaccacattg

SEQ ID NO: 25757 - DNA, 15 bp, Homo sapiens
caccatcaccacatt

SEQ ID NO: 25758 - DNA, 15 bp, Homo sapiens
ccaccatcaccacat

SEQ ID NO: 25759 - DNA, 15 bp, Homo sapiens
accaccatcaccaca

SEQ ID NO: 25760 - DNA, 15 bp, Homo sapiens
caccaccatcaccac

SEQ ID NO: 25761 - DNA, 15 bp, Homo sapiens
ccaccaccatcacca

SEQ ID NO: 25762 - DNA, 15 bp, Homo sapiens
gccaccaccatcacc

SEQ ID NO: 25763 - DNA, 15 bp, Homo sapiens
tgccaccaccatcac

SEQ ID NO: 25764 - DNA, 15 bp, Homo sapiens
ctgccaccaccatca

SEQ ID NO: 25765 - DNA, 15 bp, Homo sapiens
actgccaccaccatc

SEQ ID NO: 25766 - DNA, 15 bp, Homo sapiens
cactgccaccaccat

SEQ ID NO: 25767 - DNA, 15 bp, Homo sapiens
ccactgccaccacca

SEQ ID NO: 25768 - DNA, 15 bp, Homo sapiens
gccactgccaccacc

SEQ ID NO: 25769 - DNA, 15 bp, Homo sapiens
tgccactgccaccac

SEQ ID NO: 25770 - DNA, 15 bp, Homo sapiens
ctgccactgccacca

SEQ ID NO: 25771 - DNA, 15 bp, Homo sapiens
actgccactgccacc

SEQ ID NO: 25772 - DNA, 15 bp, Homo sapiens
cactgccactgccac

SEQ ID NO: 25773 - DNA, 15 bp, Homo sapiens
ccactgccactgcca

SEQ ID NO: 25774 - DNA, 15 bp, Homo sapiens
gccactgccactgcc

SEQ ID NO: 25775 - DNA, 15 bp, Homo sapiens
tgccactgccactgc

SEQ ID NO: 25776 - DNA, 15 bp, Homo sapiens
ctgccactgccactg

SEQ ID NO: 25777 - DNA, 15 bp, Homo sapiens
actgccactgccact

SEQ ID NO: 25778 - DNA, 15 bp, Homo sapiens
tctgccactgccact

SEQ ID NO: 25779 - DNA, 15 bp, Homo sapiens
ctctgccactgccac

SEQ ID NO: 25780 - DNA, 15 bp, Homo sapiens
cctctgccactgcca

SEQ ID NO: 25781 - DNA, 15 bp, Homo sapiens
ccctctgccactgcc

SEQ ID NO: 25782 - DNA, 15 bp, Homo sapiens
gccctctgccactgc

SEQ ID NO: 25783 - DNA, 15 bp, Homo sapiens
tgccctctgccactg

SEQ ID NO: 25784 - DNA, 15 bp, Homo sapiens
gtgccctctgccact

SEQ ID NO: 25785 - DNA, 15 bp, Homo sapiens
ggtgccctctgccac

SEQ ID NO: 25786 - DNA, 15 bp, Homo sapiens
gggtgccctctgcca

SEQ ID NO: 25787 - DNA, 15 bp, Homo sapiens
tgggtgccctctgcc

SEQ ID NO: 25788 - DNA, 15 bp, Homo sapiens
gtgggtgccctctgc

SEQ ID NO: 25789 - DNA, 15 bp, Homo sapiens
tgtgggtgccctctg

SEQ ID NO: 25790 - DNA, 15 bp, Homo sapiens
atgtgggtgccctct

SEQ ID NO: 25791 - DNA, 15 bp, Homo sapiens
aatgtgggtgccctc

SEQ ID NO: 25792 - DNA, 15 bp, Homo sapiens
caatgtgggtgccct

SEQ ID NO: 25793 - DNA, 15 bp, Homo sapiens
acaatgtgggtgccc

SEQ ID NO: 25794 - DNA, 15 bp, Homo sapiens
aacaatgtgggtgcc

SEQ ID NO: 25795 - DNA, 15 bp, Homo sapiens
gaacaatgtgggtgc

SEQ ID NO: 25796 - DNA, 15 bp, Homo sapiens
tgaacaatgtgggtg

SEQ ID NO: 25797 - DNA, 15 bp, Homo sapiens
atgaacaatgtgggt

SEQ ID NO: 25798 - DNA, 15 bp, Homo sapiens
catgaacaatgtggg

SEQ ID NO: 25799 - DNA, 15 bp, Homo sapiens
acatgaacaatgtgg

SEQ ID NO: 25800 - DNA, 15 bp, Homo sapiens
tacatgaacaatgtg

SEQ ID NO: 25801 - DNA, 15 bp, Homo sapiens
atacatgaacaatgt

SEQ ID NO: 25802 - DNA, 15 bp, Homo sapiens
tatacatgaacaatg

SEQ ID NO: 25803 - DNA, 15 bp, Homo sapiens
gtatacatgaacaat

SEQ ID NO: 25804 - DNA, 15 bp, Homo sapiens
tgtatacatgaacaa

SEQ ID NO: 25805 - DNA, 15 bp, Homo sapiens
gtgtatacatgaaca

SEQ ID NO: 25806 - DNA, 15 bp, Homo sapiens
agtgtatacatgaac

SEQ ID NO: 25807 - DNA, 15 bp, Homo sapiens
cagtgtatacatgaa

SEQ ID NO: 25808 - DNA, 15 bp, Homo sapiens
tcagtgtatacatga

SEQ ID NO: 25809 - DNA, 15 bp, Homo sapiens
ttcagtgtatacatg

SEQ ID NO: 25810 - DNA, 15 bp, Homo sapiens
gttcagtgtatacat

SEQ ID NO: 25811 - DNA, 15 bp, Homo sapiens
tgttcagtgtataca

SEQ ID NO: 25812 - DNA, 15 bp, Homo sapiens
ttgttcagtgtatac

SEQ ID NO: 25813 - DNA, 15 bp, Homo sapiens
tttgttcagtgtata

SEQ ID NO: 25814 - DNA, 15 bp, Homo sapiens
atttgttcagtgtat

SEQ ID NO: 25815 - DNA, 15 bp, Homo sapiens
tatttgttcagtgta

SEQ ID NO: 25816 - DNA, 15 bp, Homo sapiens
ttatttgttcagtgt

SEQ ID NO: 25817 - DNA, 15 bp, Homo sapiens
cttatttgttcagtg

SEQ ID NO: 25818 - DNA, 15 bp, Homo sapiens
acttatttgttcagt

SEQ ID NO: 25819 - DNA, 15 bp, Homo sapiens
cacttatttgttcag

SEQ ID NO: 25820 - DNA, 15 bp, Homo sapiens
ccacttatttgttca

SEQ ID NO: 25821 - DNA, 15 bp, Homo sapiens
gccacttatttgttc

SEQ ID NO: 25822 - DNA, 15 bp, Homo sapiens
ggccacttatttgtt

SEQ ID NO: 25823 - DNA, 15 bp, Homo sapiens
aggccacttatttgt

SEQ ID NO: 25824 - DNA, 15 bp, Homo sapiens
gaggccacttatttg

SEQ ID NO: 25825 - DNA, 15 bp, Homo sapiens
agaggccacttattt

SEQ ID NO: 25826 - DNA, 15 bp, Homo sapiens
cagaggccacttatt

SEQ ID NO: 25827 - DNA, 15 bp, Homo sapiens
tcagaggccacttat

SEQ ID NO: 25828 - DNA, 15 bp, Homo sapiens
ctcagaggccactta

SEQ ID NO: 25829 - DNA, 15 bp, Homo sapiens
gctcagaggccactt

SEQ ID NO: 25830 - DNA, 15 bp, Homo sapiens
ggctcagaggccact

SEQ ID NO: 25831 - DNA, 15 bp, Homo sapiens
aggctcagaggccac

SEQ ID NO: 25832 - DNA, 15 bp, Homo sapiens
aaggctcagaggcca

SEQ ID NO: 25833 - DNA, 15 bp, Homo sapiens
aaaggctcagaggcc

SEQ ID NO: 25834 - DNA, 15 bp, Homo sapiens
aaaaggctcagaggc

SEQ ID NO: 25835 - DNA, 15 bp, Homo sapiens
aaaaaggctcagagg

SEQ ID NO: 25836 - DNA, 15 bp, Homo sapiens
gaaaaaggctcagag

SEQ ID NO: 25837 - DNA, 15 bp, Homo sapiens
agaaaaaggctcaga

SEQ ID NO: 25838 - DNA, 15 bp, Homo sapiens
cagaaaaaggctcag

SEQ ID NO: 25839 - DNA, 15 bp, Homo sapiens
gcagaaaaaggctca

SEQ ID NO: 25840 - DNA, 15 bp, Homo sapiens
ggcagaaaaaggctc

SEQ ID NO: 25841 - DNA, 15 bp, Homo sapiens
aggcagaaaaaggct

SEQ ID NO: 25842 - DNA, 15 bp, Homo sapiens
caggcagaaaaaggc

SEQ ID NO: 25843 - DNA, 15 bp, Homo sapiens
acaggcagaaaaagg

SEQ ID NO: 25844 - DNA, 15 bp, Homo sapiens
gacaggcagaaaaag

SEQ ID NO: 25845 - DNA, 15 bp, Homo sapiens
tgacaggcagaaaaa

SEQ ID NO: 25846 - DNA, 15 bp, Homo sapiens
ctgacaggcagaaaa

SEQ ID NO: 25847 - DNA, 15 bp, Homo sapiens
tctgacaggcagaaa

SEQ ID NO: 25848 - DNA, 15 bp, Homo sapiens
ctctgacaggcagaa

SEQ ID NO: 25849 - DNA, 15 bp, Homo sapiens
actctgacaggcaga

SEQ ID NO: 25850 - DNA, 15 bp, Homo sapiens
gactctgacaggcag

SEQ ID NO: 25851 - DNA, 15 bp, Homo sapiens
agactctgacaggca

SEQ ID NO: 25852 - DNA, 15 bp, Homo sapiens
aagactctgacaggc

SEQ ID NO: 25853 - DNA, 15 bp, Homo sapiens
aaagactctgacagg

SEQ ID NO: 25854 - DNA, 15 bp, Homo sapiens
caaagactctgacag

SEQ ID NO: 25855 - DNA, 15 bp, Homo sapiens
tcaaagactctgaca

SEQ ID NO: 25856 - DNA, 15 bp, Homo sapiens
ctcaaagactctgac

SEQ ID NO: 25857 - DNA, 15 bp, Homo sapiens
tctcaaagactctga

SEQ ID NO: 25858 - DNA, 15 bp, Homo sapiens
gtctcaaagactctg

SEQ ID NO: 25859 - DNA, 15 bp, Homo sapiens
tgtctcaaagactct

SEQ ID NO: 25860 - DNA, 15 bp, Homo sapiens
ctgtctcaaagactc

SEQ ID NO: 25861 - DNA, 15 bp, Homo sapiens
cctgtctcaaagact

SEQ ID NO: 25862 - DNA, 15 bp, Homo sapiens
ccctgtctcaaagac

SEQ ID NO: 25863 - DNA, 15 bp, Homo sapiens
gccctgtctcaaaga

SEQ ID NO: 25864 - DNA, 15 bp, Homo sapiens
agccctgtctcaaag

SEQ ID NO: 25865 - DNA, 15 bp, Homo sapiens
gagccctgtctcaaa

SEQ ID NO: 25866 - DNA, 15 bp, Homo sapiens
tgagccctgtctcaa

SEQ ID NO: 25867 - DNA, 15 bp, Homo sapiens
atgagccctgtctca

SEQ ID NO: 25868 - DNA, 15 bp, Homo sapiens
aatgagccctgtctc

SEQ ID NO: 25869 - DNA, 15 bp, Homo sapiens
gaatgagccctgtct

SEQ ID NO: 25870 - DNA, 15 bp, Homo sapiens
cgaatgagccctgtc

SEQ ID NO: 25871 - DNA, 15 bp, Homo sapiens
tcgaatgagccctgt

SEQ ID NO: 25872 - DNA, 15 bp, Homo sapiens
gtcgaatgagccctg

SEQ ID NO: 25873 - DNA, 15 bp, Homo sapiens
ggtcgaatgagccct

SEQ ID NO: 25874 - DNA, 15 bp, Homo sapiens
tggtcgaatgagccc

SEQ ID NO: 25875 - DNA, 15 bp, Homo sapiens
ctggtcgaatgagcc

SEQ ID NO: 25876 - DNA, 15 bp, Homo sapiens
gctggtcgaatgagc

SEQ ID NO: 25877 - DNA, 15 bp, Homo sapiens
tgctggtcgaatgag

SEQ ID NO: 25878 - DNA, 15 bp, Homo sapiens
atgctggtcgaatga

SEQ ID NO: 25879 - DNA, 15 bp, Homo sapiens
gatgctggtcgaatg

SEQ ID NO: 25880 - DNA, 15 bp, Homo sapiens
tgatgctggtcgaat

SEQ ID NO: 25881 - DNA, 15 bp, Homo sapiens
gtgatgctggtcgaa

SEQ ID NO: 25882 - DNA, 15 bp, Homo sapiens
agtgatgctggtcga

SEQ ID NO: 25883 - DNA, 15 bp, Homo sapiens
tagtgatgctggtcg

SEQ ID NO: 25884 - DNA, 15 bp, Homo sapiens
atagtgatgctggtc

SEQ ID NO: 25885 - DNA, 15 bp, Homo sapiens
catagtgatgctggt

SEQ ID NO: 25886 - DNA, 15 bp, Homo sapiens
tcatagtgatgctgg

SEQ ID NO: 25887 - DNA, 15 bp, Homo sapiens
gtcatagtgatgctg

SEQ ID NO: 25888 - DNA, 15 bp, Homo sapiens
tgtcatagtgatgct

SEQ ID NO: 25889 - DNA, 15 bp, Homo sapiens
ttgtcatagtgatgc

SEQ ID NO: 25890 - DNA, 15 bp, Homo sapiens
cttgtcatagtgatg

SEQ ID NO: 25891 - DNA, 15 bp, Homo sapiens
ccttgtcatagtgat

SEQ ID NO: 25892 - DNA, 15 bp, Homo sapiens
cccttgtcatagtga

SEQ ID NO: 25893 - DNA, 15 bp, Homo sapiens
gcccttgtcatagtg

SEQ ID NO: 25894 - DNA, 15 bp, Homo sapiens
ggcccttgtcatagt

SEQ ID NO: 25895 - DNA, 15 bp, Homo sapiens
tggcccttgtcatag

SEQ ID NO: 25896 - DNA, 15 bp, Homo sapiens
ctggcccttgtcata

SEQ ID NO: 25897 - DNA, 15 bp, Homo sapiens
actggcccttgtcat

SEQ ID NO: 25898 - DNA, 15 bp, Homo sapiens
tactggcccttgtca

SEQ ID NO: 25899 - DNA, 15 bp, Homo sapiens
ctactggcccttgtc

SEQ ID NO: 25900 - DNA, 15 bp, Homo sapiens
gctactggcccttgt

SEQ ID NO: 25901 - DNA, 15 bp, Homo sapiens
tgctactggcccttg

SEQ ID NO: 25902 - DNA, 15 bp, Homo sapiens
ttgctactggccctt

SEQ ID NO: 25903 - DNA, 15 bp, Homo sapiens
cttgctactggccct

SEQ ID NO: 25904 - DNA, 15 bp, Homo sapiens
ccttgctactggccc

SEQ ID NO: 25905 - DNA, 15 bp, Homo sapiens
tccttgctactggcc

SEQ ID NO: 25906 - DNA, 15 bp, Homo sapiens
atccttgctactggc

SEQ ID NO: 25907 - DNA, 15 bp, Homo sapiens
catccttgctactgg

SEQ ID NO: 25908 - DNA, 15 bp, Homo sapiens
ccatccttgctactg

SEQ ID NO: 25909 - DNA, 15 bp, Homo sapiens
cccatccttgctact

SEQ ID NO: 25910 - DNA, 15 bp, Homo sapiens
ccccatccttgctac

SEQ ID NO: 25911 - DNA, 15 bp, Homo sapiens
tccccatccttgcta

SEQ ID NO: 25912 - DNA, 15 bp, Homo sapiens
ctccccatccttgct

SEQ ID NO: 25913 - DNA, 15 bp, Homo sapiens
actccccatccttgc

SEQ ID NO: 25914 - DNA, 15 bp, Homo sapiens
gactccccatccttg

SEQ ID NO: 25915 - DNA, 15 bp, Homo sapiens
agactccccatcctt

SEQ ID NO: 25916 - DNA, 15 bp, Homo sapiens
gagactccccatcct

SEQ ID NO: 25917 - DNA, 15 bp, Homo sapiens
ggagactccccatcc

SEQ ID NO: 25918 - DNA, 15 bp, Homo sapiens
tggagactccccatc

SEQ ID NO: 25919 - DNA, 15 bp, Homo sapiens
gtggagactccccat

SEQ ID NO: 25920 - DNA, 15 bp, Homo sapiens
tgtggagactcccca

SEQ ID NO: 25921 - DNA, 15 bp, Homo sapiens
ctgtggagactcccc

SEQ ID NO: 25922 - DNA, 15 bp, Homo sapiens
actgtggagactccc

SEQ ID NO: 25923 - DNA, 15 bp, Homo sapiens
cactgtggagactcc

SEQ ID NO: 25924 - DNA, 15 bp, Homo sapiens
tcactgtggagactc

SEQ ID NO: 25925 - DNA, 15 bp, Homo sapiens
ctcactgtggagact

SEQ ID NO: 25926 - DNA, 15 bp, Homo sapiens
actcactgtggagac

SEQ ID NO: 25927 - DNA, 15 bp, Homo sapiens
aactcactgtggaga

SEQ ID NO: 25928 - DNA, 15 bp, Homo sapiens
caactcactgtggag

SEQ ID NO: 25929 - DNA, 15 bp, Homo sapiens
ccaactcactgtgga

SEQ ID NO: 25930 - DNA, 15 bp, Homo sapiens
tccaactcactgtgg

SEQ ID NO: 25931 - DNA, 15 bp, Homo sapiens
gtccaactcactgtg

SEQ ID NO: 25932 - DNA, 15 bp, Homo sapiens
ggtccaactcactgt

SEQ ID NO: 25933 - DNA, 15 bp, Homo sapiens
aggtccaactcactg

SEQ ID NO: 25934 - DNA, 15 bp, Homo sapiens
caggtccaactcact

SEQ ID NO: 25935 - DNA, 15 bp, Homo sapiens
tcaggtccaactcac

SEQ ID NO: 25936 - DNA, 15 bp, Homo sapiens
ctcaggtccaactca

SEQ ID NO: 25937 - DNA, 15 bp, Homo sapiens
actcaggtccaactc

SEQ ID NO: 25938 - DNA, 15 bp, Homo sapiens
cactcaggtccaact

SEQ ID NO: 25939 - DNA, 15 bp, Homo sapiens
tcactcaggtccaac

SEQ ID NO: 25940 - DNA, 15 bp, Homo sapiens
ctcactcaggtccaa

SEQ ID NO: 25941 - DNA, 15 bp, Homo sapiens
cctcactcaggtcca

SEQ ID NO: 25942 - DNA, 15 bp, Homo sapiens
acctcactcaggtcc

SEQ ID NO: 25943 - DNA, 15 bp, Homo sapiens
aacctcactcaggtc

SEQ ID NO: 25944 - DNA, 15 bp, Homo sapiens
gaacctcactcaggt

SEQ ID NO: 25945 - DNA, 15 bp, Homo sapiens
ggaacctcactcagg

SEQ ID NO: 25946 - DNA, 15 bp, Homo sapiens
aggaacctcactcag

SEQ ID NO: 25947 - DNA, 15 bp, Homo sapiens
gaggaacctcactca

SEQ ID NO: 25948 - DNA, 15 bp, Homo sapiens
agaggaacctcactc

SEQ ID NO: 25949 - DNA, 15 bp, Homo sapiens
gagaggaacctcact

SEQ ID NO: 25950 - DNA, 15 bp, Homo sapiens
tgagaggaacctcac

SEQ ID NO: 25951 - DNA, 15 bp, Homo sapiens
ttgagaggaacctca

SEQ ID NO: 25952 - DNA, 15 bp, Homo sapiens
tttgagaggaacctc

SEQ ID NO: 25953 - DNA, 15 bp, Homo sapiens
ctttgagaggaacct

SEQ ID NO: 25954 - DNA, 15 bp, Homo sapiens
tctttgagaggaacc

SEQ ID NO: 25955 - DNA, 15 bp, Homo sapiens
ctctttgagaggaac

SEQ ID NO: 25956 - DNA, 15 bp, Homo sapiens
gctctttgagaggaa

SEQ ID NO: 25957 - DNA, 15 bp, Homo sapiens
agctctttgagagga

SEQ ID NO: 25958 - DNA, 15 bp, Homo sapiens
cagctctttgagagg

SEQ ID NO: 25959 - DNA, 15 bp, Homo sapiens
gcagctctttgagag

SEQ ID NO: 25960 - DNA, 15 bp, Homo sapiens
agcagctctttgaga

SEQ ID NO: 25961 - DNA, 15 bp, Homo sapiens
cagcagctctttgag

SEQ ID NO: 25962 - DNA, 15 bp, Homo sapiens
gcagcagctctttga

SEQ ID NO: 25963 - DNA, 15 bp, Homo sapiens
agcagcagctctttg

SEQ ID NO: 25964 - DNA, 15 bp, Homo sapiens
gagcagcagctcttt

SEQ ID NO: 25965 - DNA, 15 bp, Homo sapiens
ggagcagcagctctt

SEQ ID NO: 25966 - DNA, 15 bp, Homo sapiens
gggagcagcagctct

SEQ ID NO: 25967 - DNA, 15 bp, Homo sapiens
agggagcagcagctc

SEQ ID NO: 25968 - DNA, 15 bp, Homo sapiens
gagggagcagcagct

SEQ ID NO: 25969 - DNA, 15 bp, Homo sapiens
ggagggagcagcagc

SEQ ID NO: 25970 - DNA, 15 bp, Homo sapiens
aggagggagcagcag

SEQ ID NO: 25971 - DNA, 15 bp, Homo sapiens
caggagggagcagca

SEQ ID NO: 25972 - DNA, 15 bp, Homo sapiens
gcaggagggagcagc

SEQ ID NO: 25973 - DNA, 15 bp, Homo sapiens
ggcaggagggagcag

SEQ ID NO: 25974 - DNA, 15 bp, Homo sapiens
tggcaggagggagca

SEQ ID NO: 25975 - DNA, 15 bp, Homo sapiens
ttggcaggagggagc

SEQ ID NO: 25976 - DNA, 15 bp, Homo sapiens
cttggcaggagggag

SEQ ID NO: 25977 - DNA, 15 bp, Homo sapiens
tcttggcaggaggga

SEQ ID NO: 25978 - DNA, 15 bp, Homo sapiens
gtcttggcaggaggg

SEQ ID NO: 25979 - DNA, 15 bp, Homo sapiens
ggtcttggcaggagg

SEQ ID NO: 25980 - DNA, 15 bp, Homo sapiens
tggtcttggcaggag

SEQ ID NO: 25981 - DNA, 15 bp, Homo sapiens
gtggtcttggcagga

SEQ ID NO: 25982 - DNA, 15 bp, Homo sapiens
ggtggtcttggcagg

SEQ ID NO: 25983 - DNA, 15 bp, Homo sapiens
tggtggtcttggcag

SEQ ID NO: 25984 - DNA, 15 bp, Homo sapiens
atggtggtcttggca

SEQ ID NO: 25985 - DNA, 15 bp, Homo sapiens
tatggtggtcttggc

SEQ ID NO: 25986 - DNA, 15 bp, Homo sapiens
gtatggtggtcttgg

SEQ ID NO: 25987 - DNA, 15 bp, Homo sapiens
agtatggtggtcttg

SEQ ID NO: 25988 - DNA, 15 bp, Homo sapiens
cagtatggtggtctt

SEQ ID NO: 25989 - DNA, 15 bp, Homo sapiens
ccagtatggtggtct

SEQ ID NO: 25990 - DNA, 15 bp, Homo sapiens
tccagtatggtggtc

SEQ ID NO: 25991 - DNA, 15 bp, Homo sapiens
gtccagtatggtggt

SEQ ID NO: 25992 - DNA, 15 bp, Homo sapiens
ggtccagtatggtgg

SEQ ID NO: 25993 - DNA, 15 bp, Homo sapiens
aggtccagtatggtg

SEQ ID NO: 25994 - DNA, 15 bp, Homo sapiens
caggtccagtatggt

SEQ ID NO: 25995 - DNA, 15 bp, Homo sapiens
acaggtccagtatgg

SEQ ID NO: 25996 - DNA, 15 bp, Homo sapiens
gacaggtccagtatg

SEQ ID NO: 25997 - DNA, 15 bp, Homo sapiens
ggacaggtccagtat

SEQ ID NO: 25998 - DNA, 15 bp, Homo sapiens
aggacaggtccagta

SEQ ID NO: 25999 - DNA, 15 bp, Homo sapiens
caggacaggtccagt

SEQ ID NO: 26000 - DNA, 15 bp, Homo sapiens
gcaggacaggtccag

SEQ ID NO: 26001 - DNA, 15 bp, Homo sapiens
tgcaggacaggtcca

SEQ ID NO: 26002 - DNA, 15 bp, Homo sapiens
ctgcaggacaggtcc

SEQ ID NO: 26003 - DNA, 15 bp, Homo sapiens
actgcaggacaggtc

SEQ ID NO: 26004 - DNA, 15 bp, Homo sapiens
tactgcaggacaggt

SEQ ID NO: 26005 - DNA, 15 bp, Homo sapiens
gtactgcaggacagg

SEQ ID NO: 26006 - DNA, 15 bp, Homo sapiens
agtactgcaggacag

SEQ ID NO: 26007 - DNA, 15 bp, Homo sapiens
cagtactgcaggaca

SEQ ID NO: 26008 - DNA, 15 bp, Homo sapiens
gcagtactgcaggac

SEQ ID NO: 26009 - DNA, 15 bp, Homo sapiens
ggcagtactgcagga

SEQ ID NO: 26010 - DNA, 15 bp, Homo sapiens
gggcagtactgcagg

SEQ ID NO: 26011 - DNA, 15 bp, Homo sapiens
agggcagtactgcag

SEQ ID NO: 26012 - DNA, 15 bp, Homo sapiens
aagggcagtactgca

SEQ ID NO: 26013 - DNA, 15 bp, Homo sapiens
taagggcagtactgc

SEQ ID NO: 26014 - DNA, 15 bp, Homo sapiens
ctaagggcagtactg

SEQ ID NO: 26015 - DNA, 15 bp, Homo sapiens
tctaagggcagtact

SEQ ID NO: 26016 - DNA, 15 bp, Homo sapiens
atctaagggcagtac

SEQ ID NO: 26017 - DNA, 15 bp, Homo sapiens
aatctaagggcagta

SEQ ID NO: 26018 - DNA, 15 bp, Homo sapiens
aaatctaagggcagt

SEQ ID NO: 26019 - DNA, 15 bp, Homo sapiens
gaaatctaagggcag

SEQ ID NO: 26020 - DNA, 15 bp, Homo sapiens
agaaatctaagggca

SEQ ID NO: 26021 - DNA, 15 bp, Homo sapiens
cagaaatctaagggc

SEQ ID NO: 26022 - DNA, 15 bp, Homo sapiens
acagaaatctaaggg

SEQ ID NO: 26023 - DNA, 15 bp, Homo sapiens
cacagaaatctaagg

SEQ ID NO: 26024 - DNA, 15 bp, Homo sapiens
ccacagaaatctaag

SEQ ID NO: 26025 - DNA, 15 bp, Homo sapiens
gccacagaaatctaa

SEQ ID NO: 26026 - DNA, 15 bp, Homo sapiens
ggccacagaaatcta

SEQ ID NO: 26027 - DNA, 15 bp, Homo sapiens
aggccacagaaatct

SEQ ID NO: 26028 - DNA, 15 bp, Homo sapiens
gaggccacagaaatc

SEQ ID NO: 26029 - DNA, 15 bp, Homo sapiens
tgaggccacagaaat

SEQ ID NO: 26030 - DNA, 15 bp, Homo sapiens
gtgaggccacagaaa

SEQ ID NO: 26031 - DNA, 15 bp, Homo sapiens
tgtgaggccacagaa

SEQ ID NO: 26032 - DNA, 15 bp, Homo sapiens
ttgtgaggccacaga

SEQ ID NO: 26033 - DNA, 15 bp, Homo sapiens
cttgtgaggccacag

SEQ ID NO: 26034 - DNA, 15 bp, Homo sapiens
gcttgtgaggccaca

SEQ ID NO: 26035 - DNA, 15 bp, Homo sapiens
ggcttgtgaggccac

SEQ ID NO: 26036 - DNA, 15 bp, Homo sapiens
gggcttgtgaggcca

SEQ ID NO: 26037 - DNA, 15 bp, Homo sapiens
cgggcttgtgaggcc

SEQ ID NO: 26038 - DNA, 15 bp, Homo sapiens
ccgggcttgtgaggc

SEQ ID NO: 26039 - DNA, 15 bp, Homo sapiens
cccgggcttgtgagg

SEQ ID NO: 26040 - DNA, 15 bp, Homo sapiens
ccccgggcttgtgag

SEQ ID NO: 26041 - DNA, 15 bp, Homo sapiens
tccccgggcttgtga

SEQ ID NO: 26042 - DNA, 15 bp, Homo sapiens
ctccccgggcttgtg

SEQ ID NO: 26043 - DNA, 15 bp, Homo sapiens
gctccccgggcttgt

SEQ ID NO: 26044 - DNA, 15 bp, Homo sapiens
ggctccccgggcttg

SEQ ID NO: 26045 - DNA, 15 bp, Homo sapiens
aggctccccgggctt

SEQ ID NO: 26046 - DNA, 15 bp, Homo sapiens
taggctccccgggct

SEQ ID NO: 26047 - DNA, 15 bp, Homo sapiens
ctaggctccccgggc

SEQ ID NO: 26048 - DNA, 15 bp, Homo sapiens
tctaggctccccggg

SEQ ID NO: 26049 - DNA, 15 bp, Homo sapiens
gtctaggctccccgg

SEQ ID NO: 26050 - DNA, 15 bp, Homo sapiens
ggtctaggctccccg

SEQ ID NO: 26051 - DNA, 15 bp, Homo sapiens
aggtctaggctcccc

SEQ ID NO: 26052 - DNA, 15 bp, Homo sapiens
gaggtctaggctccc

SEQ ID NO: 26053 - DNA, 15 bp, Homo sapiens
tgaggtctaggctcc

SEQ ID NO: 26054 - DNA, 15 bp, Homo sapiens
ctgaggtctaggctc

SEQ ID NO: 26055 - DNA, 15 bp, Homo sapiens
actgaggtctaggct

SEQ ID NO: 26056 - DNA, 15 bp, Homo sapiens
tactgaggtctaggc

SEQ ID NO: 26057 - DNA, 15 bp, Homo sapiens
ctactgaggtctagg

SEQ ID NO: 26058 - DNA, 15 bp, Homo sapiens
tctactgaggtctag

SEQ ID NO: 26059 - DNA, 15 bp, Homo sapiens
ttctactgaggtcta

SEQ ID NO: 26060 - DNA, 15 bp, Homo sapiens
tttctactgaggtct

SEQ ID NO: 26061 - DNA, 15 bp, Homo sapiens
gtttctactgaggtc

SEQ ID NO: 26062 - DNA, 15 bp, Homo sapiens
tgtttctactgaggt

SEQ ID NO: 26063 - DNA, 15 bp, Homo sapiens
gtgtttctactgagg

SEQ ID NO: 26064 - DNA, 15 bp, Homo sapiens
agtgtttctactgag

SEQ ID NO: 26065 - DNA, 15 bp, Homo sapiens
aagtgtttctactga

SEQ ID NO: 26066 - DNA, 15 bp, Homo sapiens
aaagtgtttctactg

SEQ ID NO: 26067 - DNA, 15 bp, Homo sapiens
caaagtgtttctact

SEQ ID NO: 26068 - DNA, 15 bp, Homo sapiens
gcaaagtgtttctac

SEQ ID NO: 26069 - DNA, 15 bp, Homo sapiens
tgcaaagtgtttcta

SEQ ID NO: 26070 - DNA, 15 bp, Homo sapiens
ttgcaaagtgtttct

SEQ ID NO: 26071 - DNA, 15 bp, Homo sapiens
gttgcaaagtgtttc

SEQ ID NO: 26072 - DNA, 15 bp, Homo sapiens
cgttgcaaagtgttt

SEQ ID NO: 26073 - DNA, 15 bp, Homo sapiens
ccgttgcaaagtgtt

SEQ ID NO: 26074 - DNA, 15 bp, Homo sapiens
gccgttgcaaagtgt

SEQ ID NO: 26075 - DNA, 15 bp, Homo sapiens
agccgttgcaaagtg

SEQ ID NO: 26076 - DNA, 15 bp, Homo sapiens
cagccgttgcaaagt

SEQ ID NO: 26077 - DNA, 15 bp, Homo sapiens
gcagccgttgcaaag

SEQ ID NO: 26078 - DNA, 15 bp, Homo sapiens
agcagccgttgcaaa

SEQ ID NO: 26079 - DNA, 15 bp, Homo sapiens
cagcagccgttgcaa

SEQ ID NO: 26080 - DNA, 15 bp, Homo sapiens
ccagcagccgttgca

SEQ ID NO: 26081 - DNA, 15 bp, Homo sapiens
accagcagccgttgc

SEQ ID NO: 26082 - DNA, 15 bp, Homo sapiens
caccagcagccgttg

SEQ ID NO: 26083 - DNA, 15 bp, Homo sapiens
tcaccagcagccgtt

SEQ ID NO: 26084 - DNA, 15 bp, Homo sapiens
ttcaccagcagccgt

SEQ ID NO: 26085 - DNA, 15 bp, Homo sapiens
cttcaccagcagccg

SEQ ID NO: 26086 - DNA, 15 bp, Homo sapiens
tcttcaccagcagcc

SEQ ID NO: 26087 - DNA, 15 bp, Homo sapiens
ttcttcaccagcagc

SEQ ID NO: 26088 - DNA, 15 bp, Homo sapiens
attcttcaccagcag

SEQ ID NO: 26089 - DNA, 15 bp, Homo sapiens
cattcttcaccagca

SEQ ID NO: 26090 - DNA, 15 bp, Homo sapiens
ccattcttcaccagc

SEQ ID NO: 26091 - DNA, 15 bp, Homo sapiens
gccattcttcaccag

SEQ ID NO: 26092 - DNA, 15 bp, Homo sapiens
ggccattcttcacca

SEQ ID NO: 26093 - DNA, 15 bp, Homo sapiens
tggccattcttcacc

SEQ ID NO: 26094 - DNA, 15 bp, Homo sapiens
atggccattcttcac

SEQ ID NO: 26095 - DNA, 15 bp, Homo sapiens
gatggccattcttca

SEQ ID NO: 26096 - DNA, 15 bp, Homo sapiens
ggatggccattcttc

SEQ ID NO: 26097 - DNA, 15 bp, Homo sapiens
tggatggccattctt

SEQ ID NO: 26098 - DNA, 15 bp, Homo sapiens
atggatggccattct

SEQ ID NO: 26099 - DNA, 15 bp, Homo sapiens
aatggatggccattc

SEQ ID NO: 26100 - DNA, 15 bp, Homo sapiens
caatggatggccatt

SEQ ID NO: 26101 - DNA, 15 bp, Homo sapiens
tcaatggatggccat

SEQ ID NO: 26102 - DNA, 15 bp, Homo sapiens
ctcaatggatggcca

SEQ ID NO: 26103 - DNA, 15 bp, Homo sapiens
actcaatggatggcc

SEQ ID NO: 26104 - DNA, 15 bp, Homo sapiens
gactcaatggatggc

SEQ ID NO: 26105 - DNA, 15 bp, Homo sapiens
agactcaatggatgg

SEQ ID NO: 26106 - DNA, 15 bp, Homo sapiens
gagactcaatggatg

SEQ ID NO: 26107 - DNA, 15 bp, Homo sapiens
agagactcaatggat

SEQ ID NO: 26108 - DNA, 15 bp, Homo sapiens
tagagactcaatgga

SEQ ID NO: 26109 - DNA, 15 bp, Homo sapiens
ctagagactcaatgg

SEQ ID NO: 26110 - DNA, 15 bp, Homo sapiens
gctagagactcaatg

SEQ ID NO: 26111 - DNA, 15 bp, Homo sapiens
tgctagagactcaat

SEQ ID NO: 26112 - DNA, 15 bp, Homo sapiens
gtgctagagactcaa

SEQ ID NO: 26113 - DNA, 15 bp, Homo sapiens
ggtgctagagactca

SEQ ID NO: 26114 - DNA, 15 bp, Homo sapiens
aggtgctagagactc

SEQ ID NO: 26115 - DNA, 15 bp, Homo sapiens
caggtgctagagact

SEQ ID NO: 26116 - DNA, 15 bp, Homo sapiens
ccaggtgctagagac

SEQ ID NO: 26117 - DNA, 15 bp, Homo sapiens
cccaggtgctagaga

SEQ ID NO: 26118 - DNA, 15 bp, Homo sapiens
acccaggtgctagag

SEQ ID NO: 26119 - DNA, 15 bp, Homo sapiens
gacccaggtgctaga

SEQ ID NO: 26120 - DNA, 15 bp, Homo sapiens
agacccaggtgctag

SEQ ID NO: 26121 - DNA, 15 bp, Homo sapiens
gagacccaggtgcta

SEQ ID NO: 26122 - DNA, 15 bp, Homo sapiens
ggagacccaggtgct

SEQ ID NO: 26123 - DNA, 15 bp, Homo sapiens
aggagacccaggtgc

SEQ ID NO: 26124 - DNA, 15 bp, Homo sapiens
gaggagacccaggtg

SEQ ID NO: 26125 - DNA, 15 bp, Homo sapiens
tgaggagacccaggt

SEQ ID NO: 26126 - DNA, 15 bp, Homo sapiens
ttgaggagacccagg

SEQ ID NO: 26127 - DNA, 15 bp, Homo sapiens
tttgaggagacccag

SEQ ID NO: 26128 - DNA, 15 bp, Homo sapiens
ttttgaggagaccca

SEQ ID NO: 26129 - DNA, 15 bp, Homo sapiens
cttttgaggagaccc

SEQ ID NO: 26130 - DNA, 15 bp, Homo sapiens
tcttttgaggagacc

SEQ ID NO: 26131 - DNA, 15 bp, Homo sapiens
gtcttttgaggagac

SEQ ID NO: 26132 - DNA, 15 bp, Homo sapiens
agtcttttgaggaga

SEQ ID NO: 26133 - DNA, 15 bp, Homo sapiens
cagtcttttgaggag

SEQ ID NO: 26134 - DNA, 15 bp, Homo sapiens
ccagtcttttgagga

SEQ ID NO: 26135 - DNA, 15 bp, Homo sapiens
accagtcttttgagg

SEQ ID NO: 26136 - DNA, 15 bp, Homo sapiens
gaccagtcttttgag

SEQ ID NO: 26137 - DNA, 15 bp, Homo sapiens
ggaccagtcttttga

SEQ ID NO: 26138 - DNA, 15 bp, Homo sapiens
gggaccagtcttttg

SEQ ID NO: 26139 - DNA, 15 bp, Homo sapiens
ggggaccagtctttt

SEQ ID NO: 26140 - DNA, 15 bp, Homo sapiens
gggggaccagtcttt

SEQ ID NO: 26141 - DNA, 15 bp, Homo sapiens
agggggaccagtctt

SEQ ID NO: 26142 - DNA, 15 bp, Homo sapiens
cagggggaccagtct

SEQ ID NO: 26143 - DNA, 15 bp, Homo sapiens
gcagggggaccagtc

SEQ ID NO: 26144 - DNA, 15 bp, Homo sapiens
ggcagggggaccagt

SEQ ID NO: 26145 - DNA, 15 bp, Homo sapiens
aggcagggggaccag

SEQ ID NO: 26146 - DNA, 15 bp, Homo sapiens
caggcagggggacca

SEQ ID NO: 26147 - DNA, 15 bp, Homo sapiens
acaggcagggggacc

SEQ ID NO: 26148 - DNA, 15 bp, Homo sapiens
gacaggcagggggac

SEQ ID NO: 26149 - DNA, 15 bp, Homo sapiens
tgacaggcaggggga

SEQ ID NO: 26150 - DNA, 15 bp, Homo sapiens
gtgacaggcaggggg

SEQ ID NO: 26151 - DNA, 15 bp, Homo sapiens
agtgacaggcagggg

SEQ ID NO: 26152 - DNA, 15 bp, Homo sapiens
aagtgacaggcaggg

SEQ ID NO: 26153 - DNA, 15 bp, Homo sapiens
caagtgacaggcagg

SEQ ID NO: 26154 - DNA, 15 bp, Homo sapiens
ccaagtgacaggcag

SEQ ID NO: 26155 - DNA, 15 bp, Homo sapiens
gccaagtgacaggca

SEQ ID NO: 26156 - DNA, 15 bp, Homo sapiens
agccaagtgacaggc

SEQ ID NO: 26157 - DNA, 15 bp, Homo sapiens
gagccaagtgacagg

SEQ ID NO: 26158 - DNA, 15 bp, Homo sapiens
tgagccaagtgacag

SEQ ID NO: 26159 - DNA, 15 bp, Homo sapiens
ctgagccaagtgaca

SEQ ID NO: 26160 - DNA, 15 bp, Homo sapiens
gctgagccaagtgac

SEQ ID NO: 26161 - DNA, 15 bp, Homo sapiens
agctgagccaagtga

SEQ ID NO: 26162 - DNA, 15 bp, Homo sapiens
aagctgagccaagtg

SEQ ID NO: 26163 - DNA, 15 bp, Homo sapiens
taagctgagccaagt

SEQ ID NO: 26164 - DNA, 15 bp, Homo sapiens
ttaagctgagccaag

SEQ ID NO: 26165 - DNA, 15 bp, Homo sapiens
cttaagctgagccaa

SEQ ID NO: 26166 - DNA, 15 bp, Homo sapiens
tcttaagctgagcca

SEQ ID NO: 26167 - DNA, 15 bp, Homo sapiens
ttcttaagctgagcc

SEQ ID NO: 26168 - DNA, 15 bp, Homo sapiens
gttcttaagctgagc

SEQ ID NO: 26169 - DNA, 15 bp, Homo sapiens
agttcttaagctgag

SEQ ID NO: 26170 - DNA, 15 bp, Homo sapiens
aagttcttaagctga

SEQ ID NO: 26171 - DNA, 15 bp, Homo sapiens
caagttcttaagctg

SEQ ID NO: 26172 - DNA, 15 bp, Homo sapiens
tcaagttcttaagct

SEQ ID NO: 26173 - DNA, 15 bp, Homo sapiens
ttcaagttcttaagc

SEQ ID NO: 26174 - DNA, 15 bp, Homo sapiens
cttcaagttcttaag

SEQ ID NO: 26175 - DNA, 15 bp, Homo sapiens
acttcaagttcttaa

SEQ ID NO: 26176 - DNA, 15 bp, Homo sapiens
cacttcaagttctta

SEQ ID NO: 26177 - DNA, 15 bp, Homo sapiens
ccacttcaagttctt

SEQ ID NO: 26178 - DNA, 15 bp, Homo sapiens
tccacttcaagttct

SEQ ID NO: 26179 - DNA, 15 bp, Homo sapiens
gtccacttcaagttc

SEQ ID NO: 26180 - DNA, 15 bp, Homo sapiens
ggtccacttcaagtt

SEQ ID NO: 26181 - DNA, 15 bp, Homo sapiens
tggtccacttcaagt

SEQ ID NO: 26182 - DNA, 15 bp, Homo sapiens
ctggtccacttcaag

SEQ ID NO: 26183 - DNA, 15 bp, Homo sapiens
cctggtccacttcaa

SEQ ID NO: 26184 - DNA, 15 bp, Homo sapiens
gcctggtccacttca

SEQ ID NO: 26185 - DNA, 15 bp, Homo sapiens
cgcctggtccacttc

SEQ ID NO: 26186 - DNA, 15 bp, Homo sapiens
gcgcctggtccactt

SEQ ID NO: 26187 - DNA, 15 bp, Homo sapiens
tgcgcctggtccact

SEQ ID NO: 26188 - DNA, 15 bp, Homo sapiens
ctgcgcctggtccac

SEQ ID NO: 26189 - DNA, 15 bp, Homo sapiens
actgcgcctggtcca

SEQ ID NO: 26190 - DNA, 15 bp, Homo sapiens
cactgcgcctggtcc

SEQ ID NO: 26191 - DNA, 15 bp, Homo sapiens
ccactgcgcctggtc

SEQ ID NO: 26192 - DNA, 15 bp, Homo sapiens
gccactgcgcctggt

SEQ ID NO: 26193 - DNA, 15 bp, Homo sapiens
tgtgagccactgcgc

SEQ ID NO: 26194 - DNA, 15 bp, Homo sapiens
gtgtgagccactgcg

SEQ ID NO: 26195 - DNA, 15 bp, Homo sapiens
ggtgtgagccactgc

SEQ ID NO: 26196 - DNA, 15 bp, Homo sapiens
aggtgtgagccactg

SEQ ID NO: 26197 - DNA, 15 bp, Homo sapiens
caggtgtgagccact

SEQ ID NO: 26198 - DNA, 15 bp, Homo sapiens
ttgggattacaggtg

SEQ ID NO: 26199 - DNA, 15 bp, Homo sapiens
gttgggattacaggt

SEQ ID NO: 26200 - DNA, 15 bp, Homo sapiens
tgttgggattacagg

SEQ ID NO: 26201 - DNA, 15 bp, Homo sapiens
gtgttgggattacag

SEQ ID NO: 26202 - DNA, 15 bp, Homo sapiens
agtgttgggattaca

SEQ ID NO: 26203 - DNA, 15 bp, Homo sapiens
aagtgttgggattac

SEQ ID NO: 26204 - DNA, 15 bp, Homo sapiens
aaagtgttgggatta

SEQ ID NO: 26205 - DNA, 15 bp, Homo sapiens
caaagtgttgggatt

SEQ ID NO: 26206 - DNA, 15 bp, Homo sapiens
ccaaagtgttgggat

SEQ ID NO: 26207 - DNA, 15 bp, Homo sapiens
cccaaagtgttggga

SEQ ID NO: 26208 - DNA, 15 bp, Homo sapiens
tcccaaagtgttggg

SEQ ID NO: 26209 - DNA, 15 bp, Homo sapiens
ttcccaaagtgttgg

SEQ ID NO: 26210 - DNA, 15 bp, Homo sapiens
cttcccaaagtgttg

SEQ ID NO: 26211 - DNA, 15 bp, Homo sapiens
gcttcccaaagtgtt

SEQ ID NO: 26212 - DNA, 15 bp, Homo sapiens
agcttcccaaagtgt

SEQ ID NO: 26213 - DNA, 15 bp, Homo sapiens
cagcttcccaaagtg

SEQ ID NO: 26214 - DNA, 15 bp, Homo sapiens
tcagcttcccaaagt

SEQ ID NO: 26215 - DNA, 15 bp, Homo sapiens
ctcagcttcccaaag

SEQ ID NO: 26216 - DNA, 15 bp, Homo sapiens
tcccgcctcagcttc

SEQ ID NO: 26217 - DNA, 15 bp, Homo sapiens
ctcccgcctcagctt

SEQ ID NO: 26218 - DNA, 15 bp, Homo sapiens
tctcccgcctcagct

SEQ ID NO: 26219 - DNA, 15 bp, Homo sapiens
ctctcccgcctcagc

SEQ ID NO: 26220 - DNA, 15 bp, Homo sapiens
actctcccgcctcag

SEQ ID NO: 26221 - DNA, 15 bp, Homo sapiens
gactctcccgcctca

SEQ ID NO: 26222 - DNA, 15 bp, Homo sapiens
tgactctcccgcctc

SEQ ID NO: 26223 - DNA, 15 bp, Homo sapiens
gtgactctcccgcct

SEQ ID NO: 26224 - DNA, 15 bp, Homo sapiens
agtgactctcccgcc

SEQ ID NO: 26225 - DNA, 15 bp, Homo sapiens
aagtgactctcccgc

SEQ ID NO: 26226 - DNA, 15 bp, Homo sapiens
caagtgactctcccg

SEQ ID NO: 26227 - DNA, 15 bp, Homo sapiens
tcaagtgactctccc

SEQ ID NO: 26228 - DNA, 15 bp, Homo sapiens
ctcaagtgactctcc

SEQ ID NO: 26229 - DNA, 15 bp, Homo sapiens
cctcaagtgactctc

SEQ ID NO: 26230 - DNA, 15 bp, Homo sapiens
gcctcaagtgactct

SEQ ID NO: 26231 - DNA, 15 bp, Homo sapiens
ggcctcaagtgactc

SEQ ID NO: 26232 - DNA, 15 bp, Homo sapiens
aggcctcaagtgact

SEQ ID NO: 26233 - DNA, 15 bp, Homo sapiens
taggcctcaagtgac

SEQ ID NO: 26234 - DNA, 15 bp, Homo sapiens
ctaggcctcaagtga

SEQ ID NO: 26235 - DNA, 15 bp, Homo sapiens
tctaggcctcaagtg

SEQ ID NO: 26236 - DNA, 15 bp, Homo sapiens
ctctaggcctcaagt

SEQ ID NO: 26237 - DNA, 15 bp, Homo sapiens
actctaggcctcaag

SEQ ID NO: 26238 - DNA, 15 bp, Homo sapiens
aactctaggcctcaa

SEQ ID NO: 26239 - DNA, 15 bp, Homo sapiens
aaactctaggcctca

SEQ ID NO: 26240 - DNA, 15 bp, Homo sapiens
taaactctaggcctc

SEQ ID NO: 26241 - DNA, 15 bp, Homo sapiens
ctaaactctaggcct

SEQ ID NO: 26242 - DNA, 15 bp, Homo sapiens
cctaaactctaggcc

SEQ ID NO: 26243 - DNA, 15 bp, Homo sapiens
acctaaactctaggc

SEQ ID NO: 26244 - DNA, 15 bp, Homo sapiens
aacctaaactctagg

SEQ ID NO: 26245 - DNA, 15 bp, Homo sapiens
caacctaaactctag

SEQ ID NO: 26246 - DNA, 15 bp, Homo sapiens
gcaacctaaactcta

SEQ ID NO: 26247 - DNA, 15 bp, Homo sapiens
tgcaacctaaactct

SEQ ID NO: 26248 - DNA, 15 bp, Homo sapiens
ctgcaacctaaactc

SEQ ID NO: 26249 - DNA, 15 bp, Homo sapiens
gctgcaacctaaact

SEQ ID NO: 26250 - DNA, 15 bp, Homo sapiens
tgctgcaacctaaac

SEQ ID NO: 26251 - DNA, 15 bp, Homo sapiens
atgctgcaacctaaa

SEQ ID NO: 26252 - DNA, 15 bp, Homo sapiens
gatgctgcaacctaa

SEQ ID NO: 26253 - DNA, 15 bp, Homo sapiens
tgatgctgcaaccta

SEQ ID NO: 26254 - DNA, 15 bp, Homo sapiens
gtgatgctgcaacct

SEQ ID NO: 26255 - DNA, 15 bp, Homo sapiens
agtgatgctgcaacc

SEQ ID NO: 26256 - DNA, 15 bp, Homo sapiens
cagtgatgctgcaac

SEQ ID NO: 26257 - DNA, 15 bp, Homo sapiens
gcagtgatgctgcaa

SEQ ID NO: 26258 - DNA, 15 bp, Homo sapiens
tgcagtgatgctgca

SEQ ID NO: 26259 - DNA, 15 bp, Homo sapiens
gtgcagtgatgctgc

SEQ ID NO: 26260 - DNA, 15 bp, Homo sapiens
agtgcagtgatgctg

SEQ ID NO: 26261 - DNA, 15 bp, Homo sapiens
aagtgcagtgatgct

SEQ ID NO: 26262 - DNA, 15 bp, Homo sapiens
caagtgcagtgatgc

SEQ ID NO: 26263 - DNA, 15 bp, Homo sapiens
tcaagtgcagtgatg

SEQ ID NO: 26264 - DNA, 15 bp, Homo sapiens
ctcaagtgcagtgat

SEQ ID NO: 26265 - DNA, 15 bp, Homo sapiens
gctcaagtgcagtga

SEQ ID NO: 26266 - DNA, 15 bp, Homo sapiens
ggctcaagtgcagtg

SEQ ID NO: 26267 - DNA, 15 bp, Homo sapiens
aggctcaagtgcagt

SEQ ID NO: 26268 - DNA, 15 bp, Homo sapiens
caggctcaagtgcag

SEQ ID NO: 26269 - DNA, 15 bp, Homo sapiens
ccaggctcaagtgca

SEQ ID NO: 26270 - DNA, 15 bp, Homo sapiens
cccaggctcaagtgc

SEQ ID NO: 26271 - DNA, 15 bp, Homo sapiens
gcccaggctcaagtg

SEQ ID NO: 26272 - DNA, 15 bp, Homo sapiens
tgcccaggctcaagt

SEQ ID NO: 26273 - DNA, 15 bp, Homo sapiens
ttgcccaggctcaag

SEQ ID NO: 26274 - DNA, 15 bp, Homo sapiens
gttgcccaggctcaa

SEQ ID NO: 26275 - DNA, 15 bp, Homo sapiens
tgttgcccaggctca

SEQ ID NO: 26276 - DNA, 15 bp, Homo sapiens
ctgttgcccaggctc

SEQ ID NO: 26277 - DNA, 15 bp, Homo sapiens
tctgttgcccaggct

SEQ ID NO: 26278 - DNA, 15 bp, Homo sapiens
ctctgttgcccaggc

SEQ ID NO: 26279 - DNA, 15 bp, Homo sapiens
actctgttgcccagg

SEQ ID NO: 26280 - DNA, 15 bp, Homo sapiens
gactctgttgcccag

SEQ ID NO: 26281 - DNA, 15 bp, Homo sapiens
tgactctgttgccca

SEQ ID NO: 26282 - DNA, 15 bp, Homo sapiens
ctgactctgttgccc

SEQ ID NO: 26283 - DNA, 15 bp, Homo sapiens
tctgactctgttgcc

SEQ ID NO: 26284 - DNA, 15 bp, Homo sapiens
gtctgactctgttgc

SEQ ID NO: 26285 - DNA, 15 bp, Homo sapiens
ggtctgactctgttg

SEQ ID NO: 26286 - DNA, 15 bp, Homo sapiens
gggtctgactctgtt

SEQ ID NO: 26287 - DNA, 15 bp, Homo sapiens
ggggtctgactctgt

SEQ ID NO: 26288 - DNA, 15 bp, Homo sapiens
tggggtctgactctg

SEQ ID NO: 26289 - DNA, 15 bp, Homo sapiens
atggggtctgactct

SEQ ID NO: 26290 - DNA, 15 bp, Homo sapiens
gatggggtctgactc

SEQ ID NO: 26291 - DNA, 15 bp, Homo sapiens
agatggggtctgact

SEQ ID NO: 26292 - DNA, 15 bp, Homo sapiens
gagatggggtctgac

SEQ ID NO: 26293 - DNA, 15 bp, Homo sapiens
tgagatggggtctga

SEQ ID NO: 26294 - DNA, 15 bp, Homo sapiens
ttgagatggggtctg

SEQ ID NO: 26295 - DNA, 15 bp, Homo sapiens
tttgagatggggtct

SEQ ID NO: 26296 - DNA, 15 bp, Homo sapiens
ttttgagatggggtc

SEQ ID NO: 26297 - DNA, 15 bp, Homo sapiens
tttttgagatggggt

SEQ ID NO: 26298 - DNA, 15 bp, Homo sapiens
ttttttgagatgggg

SEQ ID NO: 26299 - DNA, 15 bp, Homo sapiens
tttttttgagatggg

SEQ ID NO: 26300 - DNA, 15 bp, Homo sapiens
atttttttttgagat

SEQ ID NO: 26301 - DNA, 15 bp, Homo sapiens
taatttttttttgag

SEQ ID NO: 26302 - DNA, 15 bp, Homo sapiens
ttaatttttttttga

SEQ ID NO: 26303 - DNA, 15 bp, Homo sapiens
cttaatttttttttg

SEQ ID NO: 26304 - DNA, 15 bp, Homo sapiens
ccttaattttttttt

SEQ ID NO: 26305 - DNA, 15 bp, Homo sapiens
gccttaatttttttt

SEQ ID NO: 26306 - DNA, 15 bp, Homo sapiens
ggccttaattttttt

SEQ ID NO: 26307 - DNA, 15 bp, Homo sapiens
aggccttaatttttt

SEQ ID NO: 26308 - DNA, 15 bp, Homo sapiens
caggccttaattttt

SEQ ID NO: 26309 - DNA, 15 bp, Homo sapiens
tcaggccttaatttt

SEQ ID NO: 26310 - DNA, 15 bp, Homo sapiens
ttcaggccttaattt

SEQ ID NO: 26311 - DNA, 15 bp, Homo sapiens
cttcaggccttaatt

SEQ ID NO: 26312 - DNA, 15 bp, Homo sapiens
acttcaggccttaat

SEQ ID NO: 26313 - DNA, 15 bp, Homo sapiens
cacttcaggccttaa

SEQ ID NO: 26314 - DNA, 15 bp, Homo sapiens
ccacttcaggcctta

SEQ ID NO: 26315 - DNA, 15 bp, Homo sapiens
gccacttcaggcctt

SEQ ID NO: 26316 - DNA, 15 bp, Homo sapiens
agccacttcaggcct

SEQ ID NO: 26317 - DNA, 15 bp, Homo sapiens
tagccacttcaggcc

SEQ ID NO: 26318 - DNA, 15 bp, Homo sapiens
ttagccacttcaggc

SEQ ID NO: 26319 - DNA, 15 bp, Homo sapiens
tttagccacttcagg

SEQ ID NO: 26320 - DNA, 15 bp, Homo sapiens
gtttagccacttcag

SEQ ID NO: 26321 - DNA, 15 bp, Homo sapiens
agtttagccacttca

SEQ ID NO: 26322 - DNA, 15 bp, Homo sapiens
aagtttagccacttc

SEQ ID NO: 26323 - DNA, 15 bp, Homo sapiens
caagtttagccactt

SEQ ID NO: 26324 - DNA, 15 bp, Homo sapiens
tcaagtttagccact

SEQ ID NO: 26325 - DNA, 15 bp, Homo sapiens
ttcaagtttagccac

SEQ ID NO: 26326 - DNA, 15 bp, Homo sapiens
cttcaagtttagcca

SEQ ID NO: 26327 - DNA, 15 bp, Homo sapiens
ccttcaagtttagcc

SEQ ID NO: 26328 - DNA, 15 bp, Homo sapiens
tccttcaagtttagc

SEQ ID NO: 26329 - DNA, 15 bp, Homo sapiens
atccttcaagtttag

SEQ ID NO: 26330 - DNA, 15 bp, Homo sapiens
tatccttcaagttta

SEQ ID NO: 26331 - DNA, 15 bp, Homo sapiens
ttatccttcaagttt

SEQ ID NO: 26332 - DNA, 15 bp, Homo sapiens
gttatccttcaagtt

SEQ ID NO: 26333 - DNA, 15 bp, Homo sapiens
agttatccttcaagt

SEQ ID NO: 26334 - DNA, 15 bp, Homo sapiens
gagttatccttcaag

SEQ ID NO: 26335 - DNA, 15 bp, Homo sapiens
ggagttatccttcaa

SEQ ID NO: 26336 - DNA, 15 bp, Homo sapiens
gggagttatccttca

SEQ ID NO: 26337 - DNA, 15 bp, Homo sapiens
agggagttatccttc

SEQ ID NO: 26338 - DNA, 15 bp, Homo sapiens
aagggagttatcctt

SEQ ID NO: 26339 - DNA, 15 bp, Homo sapiens
aaagggagttatcct

SEQ ID NO: 26340 - DNA, 15 bp, Homo sapiens
taaagggagttatcc

SEQ ID NO: 26341 - DNA, 15 bp, Homo sapiens
ataaagggagttatc

SEQ ID NO: 26342 - DNA, 15 bp, Homo sapiens
gataaagggagttat

SEQ ID NO: 26343 - DNA, 15 bp, Homo sapiens
agataaagggagtta

SEQ ID NO: 26344 - DNA, 15 bp, Homo sapiens
aagataaagggagtt

SEQ ID NO: 26345 - DNA, 15 bp, Homo sapiens
taagataaagggagt

SEQ ID NO: 26346 - DNA, 15 bp, Homo sapiens
ataagataaagggag

SEQ ID NO: 26347 - DNA, 15 bp, Homo sapiens
gataagataaaggga

SEQ ID NO: 26348 - DNA, 15 bp, Homo sapiens
ggataagataaaggg

SEQ ID NO: 26349 - DNA, 15 bp, Homo sapiens
aggataagataaagg

SEQ ID NO: 26350 - DNA, 15 bp, Homo sapiens
caggataagataaag

SEQ ID NO: 26351 - DNA, 15 bp, Homo sapiens
ccaggataagataaa

SEQ ID NO: 26352 - DNA, 15 bp, Homo sapiens
gccaggataagataa

SEQ ID NO: 26353 - DNA, 15 bp, Homo sapiens
ggccaggataagata

SEQ ID NO: 26354 - DNA, 15 bp, Homo sapiens
tggccaggataagat

SEQ ID NO: 26355 - DNA, 15 bp, Homo sapiens
ttggccaggataaga

SEQ ID NO: 26356 - DNA, 15 bp, Homo sapiens
tttggccaggataag

SEQ ID NO: 26357 - DNA, 15 bp, Homo sapiens
ctttggccaggataa

SEQ ID NO: 26358 - DNA, 15 bp, Homo sapiens
actttggccaggata

SEQ ID NO: 26359 - DNA, 15 bp, Homo sapiens
cactttggccaggat

SEQ ID NO: 26360 - DNA, 15 bp, Homo sapiens
ccactttggccagga

SEQ ID NO: 26361 - DNA, 15 bp, Homo sapiens
accactttggccagg

SEQ ID NO: 26362 - DNA, 15 bp, Homo sapiens
taccactttggccag

SEQ ID NO: 26363 - DNA, 15 bp, Homo sapiens
ctaccactttggcca

SEQ ID NO: 26364 - DNA, 15 bp, Homo sapiens
tctaccactttggcc

SEQ ID NO: 26365 - DNA, 15 bp, Homo sapiens
atctaccactttggc

SEQ ID NO: 26366 - DNA, 15 bp, Homo sapiens
catctaccactttgg

SEQ ID NO: 26367 - DNA, 15 bp, Homo sapiens
tcatctaccactttg

SEQ ID NO: 26368 - DNA, 15 bp, Homo sapiens
atcatctaccacttt

SEQ ID NO: 26369 - DNA, 15 bp, Homo sapiens
aatcatctaccactt

SEQ ID NO: 26370 - DNA, 15 bp, Homo sapiens
caatcatctaccact

SEQ ID NO: 26371 - DNA, 15 bp, Homo sapiens
gcaatcatctaccac

SEQ ID NO: 26372 - DNA, 15 bp, Homo sapiens
agcaatcatctacca

SEQ ID NO: 26373 - DNA, 15 bp, Homo sapiens
aagcaatcatctacc

SEQ ID NO: 26374 - DNA, 15 bp, Homo sapiens
caagcaatcatctac

SEQ ID NO: 26375 - DNA, 15 bp, Homo sapiens
ccaagcaatcatcta

SEQ ID NO: 26376 - DNA, 15 bp, Homo sapiens
tccaagcaatcatct

SEQ ID NO: 26377 - DNA, 15 bp, Homo sapiens
atccaagcaatcatc

SEQ ID NO: 26378 - DNA, 15 bp, Homo sapiens
catccaagcaatcat

SEQ ID NO: 26379 - DNA, 15 bp, Homo sapiens
tcatccaagcaatca

SEQ ID NO: 26380 - DNA, 15 bp, Homo sapiens
ctcatccaagcaatc

SEQ ID NO: 26381 - DNA, 15 bp, Homo sapiens
tctcatccaagcaat

SEQ ID NO: 26382 - DNA, 15 bp, Homo sapiens
ttctcatccaagcaa

SEQ ID NO: 26383 - DNA, 15 bp, Homo sapiens
cttctcatccaagca

SEQ ID NO: 26384 - DNA, 15 bp, Homo sapiens
acttctcatccaagc

SEQ ID NO: 26385 - DNA, 15 bp, Homo sapiens
cacttctcatccaag

SEQ ID NO: 26386 - DNA, 15 bp, Homo sapiens
tcacttctcatccaa

SEQ ID NO: 26387 - DNA, 15 bp, Homo sapiens
atcacttctcatcca

SEQ ID NO: 26388 - DNA, 15 bp, Homo sapiens
tatcacttctcatcc

SEQ ID NO: 26389 - DNA, 15 bp, Homo sapiens
atatcacttctcatc

SEQ ID NO: 26390 - DNA, 15 bp, Homo sapiens
catatcacttctcat

SEQ ID NO: 26391 - DNA, 15 bp, Homo sapiens
gcatatcacttctca

SEQ ID NO: 26392 - DNA, 15 bp, Homo sapiens
tgcatatcacttctc

SEQ ID NO: 26393 - DNA, 15 bp, Homo sapiens
ctgcatatcacttct

SEQ ID NO: 26394 - DNA, 15 bp, Homo sapiens
tctgcatatcacttc

SEQ ID NO: 26395 - DNA, 15 bp, Homo sapiens
atctgcatatcactt

SEQ ID NO: 26396 - DNA, 15 bp, Homo sapiens
tatctgcatatcact

SEQ ID NO: 26397 - DNA, 15 bp, Homo sapiens
ttatctgcatatcac

SEQ ID NO: 26398 - DNA, 15 bp, Homo sapiens
cttatctgcatatca

SEQ ID NO: 26399 - DNA, 15 bp, Homo sapiens
tcttatctgcatatc

SEQ ID NO: 26400 - DNA, 15 bp, Homo sapiens
atcttatctgcatat

SEQ ID NO: 26401 - DNA, 15 bp, Homo sapiens
catcttatctgcata

SEQ ID NO: 26402 - DNA, 15 bp, Homo sapiens
acatcttatctgcat

SEQ ID NO: 26403 - DNA, 15 bp, Homo sapiens
aacatcttatctgca

SEQ ID NO: 26404 - DNA, 15 bp, Homo sapiens
caacatcttatctgc

SEQ ID NO: 26405 - DNA, 15 bp, Homo sapiens
gcaacatcttatctg

SEQ ID NO: 26406 - DNA, 15 bp, Homo sapiens
tgcaacatcttatct

SEQ ID NO: 26407 - DNA, 15 bp, Homo sapiens
ttgcaacatcttatc

SEQ ID NO: 26408 - DNA, 15 bp, Homo sapiens
attgcaacatcttat

SEQ ID NO: 26409 - DNA, 15 bp, Homo sapiens
tattgcaacatctta

SEQ ID NO: 26410 - DNA, 15 bp, Homo sapiens
gtattgcaacatctt

SEQ ID NO: 26411 - DNA, 15 bp, Homo sapiens
tgtattgcaacatct

SEQ ID NO: 26412 - DNA, 15 bp, Homo sapiens
gtgtattgcaacatc

SEQ ID NO: 26413 - DNA, 15 bp, Homo sapiens
tgtgtattgcaacat

SEQ ID NO: 26414 - DNA, 15 bp, Homo sapiens
ttgtgtattgcaaca

SEQ ID NO: 26415 - DNA, 15 bp, Homo sapiens
tttgtgtattgcaac

SEQ ID NO: 26416 - DNA, 15 bp, Homo sapiens
ctttgtgtattgcaa

SEQ ID NO: 26417 - DNA, 15 bp, Homo sapiens
actttgtgtattgca

SEQ ID NO: 26418 - DNA, 15 bp, Homo sapiens
gactttgtgtattgc

SEQ ID NO: 26419 - DNA, 15 bp, Homo sapiens
agactttgtgtattg

SEQ ID NO: 26420 - DNA, 15 bp, Homo sapiens
cagactttgtgtatt

SEQ ID NO: 26421 - DNA, 15 bp, Homo sapiens
acagactttgtgtat

SEQ ID NO: 26422 - DNA, 15 bp, Homo sapiens
cacagactttgtgta

SEQ ID NO: 26423 - DNA, 15 bp, Homo sapiens
acacagactttgtgt

SEQ ID NO: 26424 - DNA, 15 bp, Homo sapiens
cacacagactttgtg

SEQ ID NO: 26425 - DNA, 15 bp, Homo sapiens
ccacacagactttgt

SEQ ID NO: 26426 - DNA, 15 bp, Homo sapiens
cccacacagactttg

SEQ ID NO: 26427 - DNA, 15 bp, Homo sapiens
acccacacagacttt

SEQ ID NO: 26428 - DNA, 15 bp, Homo sapiens
gacccacacagactt

SEQ ID NO: 26429 - DNA, 15 bp, Homo sapiens
tgacccacacagact

SEQ ID NO: 26430 - DNA, 15 bp, Homo sapiens
ctgacccacacagac

SEQ ID NO: 26431 - DNA, 15 bp, Homo sapiens
actgacccacacaga

SEQ ID NO: 26432 - DNA, 15 bp, Homo sapiens
gactgacccacacag

SEQ ID NO: 26433 - DNA, 15 bp, Homo sapiens
cgactgacccacaca

SEQ ID NO: 26434 - DNA, 15 bp, Homo sapiens
ccgactgacccacac

SEQ ID NO: 26435 - DNA, 15 bp, Homo sapiens
accgactgacccaca

SEQ ID NO: 26436 - DNA, 15 bp, Homo sapiens
gaccgactgacccac

SEQ ID NO: 26437 - DNA, 15 bp, Homo sapiens
tgaccgactgaccca

SEQ ID NO: 26438 - DNA, 15 bp, Homo sapiens
gtgaccgactgaccc

SEQ ID NO: 26439 - DNA, 15 bp, Homo sapiens
cgtgaccgactgacc

SEQ ID NO: 26440 - DNA, 15 bp, Homo sapiens
acgtgaccgactgac

SEQ ID NO: 26441 - DNA, 15 bp, Homo sapiens
cacgtgaccgactga

SEQ ID NO: 26442 - DNA, 15 bp, Homo sapiens
ccacgtgaccgactg

SEQ ID NO: 26443 - DNA, 15 bp, Homo sapiens
cccacgtgaccgact

SEQ ID NO: 26444 - DNA, 15 bp, Homo sapiens
acccacgtgaccgac

SEQ ID NO: 26445 - DNA, 15 bp, Homo sapiens
cacccacgtgaccga

SEQ ID NO: 26446 - DNA, 15 bp, Homo sapiens
gcacccacgtgaccg

SEQ ID NO: 26447 - DNA, 15 bp, Homo sapiens
ggcacccacgtgacc

SEQ ID NO: 26448 - DNA, 15 bp, Homo sapiens
tggcacccacgtgac

SEQ ID NO: 26449 - DNA, 15 bp, Homo sapiens
ttggcacccacgtga

SEQ ID NO: 26450 - DNA, 15 bp, Homo sapiens
cttggcacccacgtg

SEQ ID NO: 26451 - DNA, 15 bp, Homo sapiens
ccttggcacccacgt

SEQ ID NO: 26452 - DNA, 15 bp, Homo sapiens
tccttggcacccacg

SEQ ID NO: 26453 - DNA, 15 bp, Homo sapiens
gtccttggcacccac

SEQ ID NO: 26454 - DNA, 15 bp, Homo sapiens
tgtccttggcaccca

SEQ ID NO: 26455 - DNA, 15 bp, Homo sapiens
ctgtccttggcaccc

SEQ ID NO: 26456 - DNA, 15 bp, Homo sapiens
cctgtccttggcacc

SEQ ID NO: 26457 - DNA, 15 bp, Homo sapiens
acctgtccttggcac

SEQ ID NO: 26458 - DNA, 15 bp, Homo sapiens
cacctgtccttggca

SEQ ID NO: 26459 - DNA, 15 bp, Homo sapiens
ccacctgtccttggc

SEQ ID NO: 26460 - DNA, 15 bp, Homo sapiens
cccacctgtccttgg

SEQ ID NO: 26461 - DNA, 15 bp, Homo sapiens
tcccacctgtccttg

SEQ ID NO: 26462 - DNA, 15 bp, Homo sapiens
ctcccacctgtcctt

SEQ ID NO: 26463 - DNA, 15 bp, Homo sapiens
tctcccacctgtcct

SEQ ID NO: 26464 - DNA, 15 bp, Homo sapiens
ctctcccacctgtcc

SEQ ID NO: 26465 - DNA, 15 bp, Homo sapiens
tctctcccacctgtc

SEQ ID NO: 26466 - DNA, 15 bp, Homo sapiens
ttctctcccacctgt

SEQ ID NO: 26467 - DNA, 15 bp, Homo sapiens
cttctctcccacctg

SEQ ID NO: 26468 - DNA, 15 bp, Homo sapiens
tcttctctcccacct

SEQ ID NO: 26469 - DNA, 15 bp, Homo sapiens
ttcttctctcccacc

SEQ ID NO: 26470 - DNA, 15 bp, Homo sapiens
cttcttctctcccac

SEQ ID NO: 26471 - DNA, 15 bp, Homo sapiens
gcttcttctctccca

SEQ ID NO: 26472 - DNA, 15 bp, Homo sapiens
tgcttcttctctccc

SEQ ID NO: 26473 - DNA, 15 bp, Homo sapiens
ttgcttcttctctcc

SEQ ID NO: 26474 - DNA, 15 bp, Homo sapiens
cttgcttcttctctc

SEQ ID NO: 26475 - DNA, 15 bp, Homo sapiens
gcttgcttcttctct

SEQ ID NO: 26476 - DNA, 15 bp, Homo sapiens
agcttgcttcttctc

SEQ ID NO: 26477 - DNA, 15 bp, Homo sapiens
tagcttgcttcttct

SEQ ID NO: 26478 - DNA, 15 bp, Homo sapiens
gtagcttgcttcttc

SEQ ID NO: 26479 - DNA, 15 bp, Homo sapiens
tgtagcttgcttctt

SEQ ID NO: 26480 - DNA, 15 bp, Homo sapiens
ctgtagcttgcttct

SEQ ID NO: 26481 - DNA, 15 bp, Homo sapiens
tctgtagcttgcttc

SEQ ID NO: 26482 - DNA, 15 bp, Homo sapiens
ttctgtagcttgctt

SEQ ID NO: 26483 - DNA, 15 bp, Homo sapiens
cttctgtagcttgct

SEQ ID NO: 26484 - DNA, 15 bp, Homo sapiens
gcttctgtagcttgc

SEQ ID NO: 26485 - DNA, 15 bp, Homo sapiens
tgcttctgtagcttg

SEQ ID NO: 26486 - DNA, 15 bp, Homo sapiens
ctgcttctgtagctt

SEQ ID NO: 26487 - DNA, 15 bp, Homo sapiens
gctgcttctgtagct

SEQ ID NO: 26488 - DNA, 15 bp, Homo sapiens
agctgcttctgtagc

SEQ ID NO: 26489 - DNA, 15 bp, Homo sapiens
gagctgcttctgtag

SEQ ID NO: 26490 - DNA, 15 bp, Homo sapiens
tgagctgcttctgta

SEQ ID NO: 26491 - DNA, 15 bp, Homo sapiens
ttgagctgcttctgt

SEQ ID NO: 26492 - DNA, 15 bp, Homo sapiens
cttgagctgcttctg

SEQ ID NO: 26493 - DNA, 15 bp, Homo sapiens
tcttgagctgcttct

SEQ ID NO: 26494 - DNA, 15 bp, Homo sapiens
ttcttgagctgcttc

SEQ ID NO: 26495 - DNA, 15 bp, Homo sapiens
attcttgagctgctt

SEQ ID NO: 26496 - DNA, 15 bp, Homo sapiens
cattcttgagctgct

SEQ ID NO: 26497 - DNA, 15 bp, Homo sapiens
ccattcttgagctgc

SEQ ID NO: 26498 - DNA, 15 bp, Homo sapiens
cccattcttgagctg

SEQ ID NO: 26499 - DNA, 15 bp, Homo sapiens
tcccattcttgagct

SEQ ID NO: 26500 - DNA, 15 bp, Homo sapiens
ttcccattcttgagc

SEQ ID NO: 26501 - DNA, 15 bp, Homo sapiens
gttcccattcttgag

SEQ ID NO: 26502 - DNA, 15 bp, Homo sapiens
agttcccattcttga

SEQ ID NO: 26503 - DNA, 15 bp, Homo sapiens
cagttcccattcttg

SEQ ID NO: 26504 - DNA, 15 bp, Homo sapiens
gcagttcccattctt

SEQ ID NO: 26505 - DNA, 15 bp, Homo sapiens
cgcagttcccattct

SEQ ID NO: 26506 - DNA, 15 bp, Homo sapiens
ccgcagttcccattc

SEQ ID NO: 26507 - DNA, 15 bp, Homo sapiens
tccgcagttcccatt

SEQ ID NO: 26508 - DNA, 15 bp, Homo sapiens
ttccgcagttcccat

SEQ ID NO: 26509 - DNA, 15 bp, Homo sapiens
cttccgcagttccca

SEQ ID NO: 26510 - DNA, 15 bp, Homo sapiens
gcttccgcagttccc

SEQ ID NO: 26511 - DNA, 15 bp, Homo sapiens
agcttccgcagttcc

SEQ ID NO: 26512 - DNA, 15 bp, Homo sapiens
cagcttccgcagttc

SEQ ID NO: 26513 - DNA, 15 bp, Homo sapiens
tcagcttccgcagtt

SEQ ID NO: 26514 - DNA, 15 bp, Homo sapiens
atcagcttccgcagt

SEQ ID NO: 26515 - DNA, 15 bp, Homo sapiens
aatcagcttccgcag

SEQ ID NO: 26516 - DNA, 15 bp, Homo sapiens
caatcagcttccgca

SEQ ID NO: 26517 - DNA, 15 bp, Homo sapiens
acaatcagcttccgc

SEQ ID NO: 26518 - DNA, 15 bp, Homo sapiens
tacaatcagcttccg

SEQ ID NO: 26519 - DNA, 15 bp, Homo sapiens
atacaatcagcttcc

SEQ ID NO: 26520 - DNA, 15 bp, Homo sapiens
aatacaatcagcttc

SEQ ID NO: 26521 - DNA, 15 bp, Homo sapiens
caatacaatcagctt

SEQ ID NO: 26522 - DNA, 15 bp, Homo sapiens
ccaatacaatcagct

SEQ ID NO: 26523 - DNA, 15 bp, Homo sapiens
tccaatacaatcagc

SEQ ID NO: 26524 - DNA, 15 bp, Homo sapiens
ctccaatacaatcag

SEQ ID NO: 26525 - DNA, 15 bp, Homo sapiens
cctccaatacaatca

SEQ ID NO: 26526 - DNA, 15 bp, Homo sapiens
tcctccaatacaatc

SEQ ID NO: 26527 - DNA, 15 bp, Homo sapiens
ttcctccaatacaat

SEQ ID NO: 26528 - DNA, 15 bp, Homo sapiens
cttcctccaatacaa

SEQ ID NO: 26529 - DNA, 15 bp, Homo sapiens
ccttcctccaataca

SEQ ID NO: 26530 - DNA, 15 bp, Homo sapiens
tccttcctccaatac

SEQ ID NO: 26531 - DNA, 15 bp, Homo sapiens
ctccttcctccaata

SEQ ID NO: 26532 - DNA, 15 bp, Homo sapiens
actccttcctccaat

SEQ ID NO: 26533 - DNA, 15 bp, Homo sapiens
cactccttcctccaa

SEQ ID NO: 26534 - DNA, 15 bp, Homo sapiens
acactccttcctcca

SEQ ID NO: 26535 - DNA, 15 bp, Homo sapiens
cacactccttcctcc

SEQ ID NO: 26536 - DNA, 15 bp, Homo sapiens
tcacactccttcctc

SEQ ID NO: 26537 - DNA, 15 bp, Homo sapiens
atcacactccttcct

SEQ ID NO: 26538 - DNA, 15 bp, Homo sapiens
catcacactccttcc

SEQ ID NO: 26539 - DNA, 15 bp, Homo sapiens
gcatcacactccttc

SEQ ID NO: 26540 - DNA, 15 bp, Homo sapiens
agcatcacactcctt

SEQ ID NO: 26541 - DNA, 15 bp, Homo sapiens
gagcatcacactcct

SEQ ID NO: 26542 - DNA, 15 bp, Homo sapiens
agagcatcacactcc

SEQ ID NO: 26543 - DNA, 15 bp, Homo sapiens
gagagcatcacactc

SEQ ID NO: 26544 - DNA, 15 bp, Homo sapiens
tgagagcatcacact

SEQ ID NO: 26545 - DNA, 15 bp, Homo sapiens
ctgagagcatcacac

SEQ ID NO: 26546 - DNA, 15 bp, Homo sapiens
tctgagagcatcaca

SEQ ID NO: 26547 - DNA, 15 bp, Homo sapiens
ctctgagagcatcac

SEQ ID NO: 26548 - DNA, 15 bp, Homo sapiens
gctctgagagcatca

SEQ ID NO: 26549 - DNA, 15 bp, Homo sapiens
tgctctgagagcatc

SEQ ID NO: 26550 - DNA, 15 bp, Homo sapiens
ctgctctgagagcat

SEQ ID NO: 26551 - DNA, 15 bp, Homo sapiens
gctgctctgagagca

SEQ ID NO: 26552 - DNA, 15 bp, Homo sapiens
ggctgctctgagagc

SEQ ID NO: 26553 - DNA, 15 bp, Homo sapiens
tggctgctctgagag

SEQ ID NO: 26554 - DNA, 15 bp, Homo sapiens
ctggctgctctgaga

SEQ ID NO: 26555 - DNA, 15 bp, Homo sapiens
cctggctgctctgag

SEQ ID NO: 26556 - DNA, 15 bp, Homo sapiens
ccctggctgctctga

SEQ ID NO: 26557 - DNA, 15 bp, Homo sapiens
tccctggctgctctg

SEQ ID NO: 26558 - DNA, 15 bp, Homo sapiens
ctccctggctgctct

SEQ ID NO: 26559 - DNA, 15 bp, Homo sapiens
cctccctggctgctc

SEQ ID NO: 26560 - DNA, 15 bp, Homo sapiens
tcctccctggctgct

SEQ ID NO: 26561 - DNA, 15 bp, Homo sapiens
ctcctccctggctgc

SEQ ID NO: 26562 - DNA, 15 bp, Homo sapiens
gctcctccctggctg

SEQ ID NO: 26563 - DNA, 15 bp, Homo sapiens
tgctcctccctggct

SEQ ID NO: 26564 - DNA, 15 bp, Homo sapiens
ctgctcctccctggc

SEQ ID NO: 26565 - DNA, 15 bp, Homo sapiens
tctgctcctccctgg

SEQ ID NO: 26566 - DNA, 15 bp, Homo sapiens
ttctgctcctccctg

SEQ ID NO: 26567 - DNA, 15 bp, Homo sapiens
cttctgctcctccct

SEQ ID NO: 26568 - DNA, 15 bp, Homo sapiens
ccttctgctcctccc

SEQ ID NO: 26569 - DNA, 15 bp, Homo sapiens
tccttctgctcctcc

SEQ ID NO: 26570 - DNA, 15 bp, Homo sapiens
ctccttctgctcctc

SEQ ID NO: 26571 - DNA, 15 bp, Homo sapiens
gctccttctgctcct

SEQ ID NO: 26572 - DNA, 15 bp, Homo sapiens
agctccttctgctcc

SEQ ID NO: 26573 - DNA, 15 bp, Homo sapiens
aagctccttctgctc

SEQ ID NO: 26574 - DNA, 15 bp, Homo sapiens
taagctccttctgct

SEQ ID NO: 26575 - DNA, 15 bp, Homo sapiens
ctaagctccttctgc

SEQ ID NO: 26576 - DNA, 15 bp, Homo sapiens
cctaagctccttctg

SEQ ID NO: 26577 - DNA, 15 bp, Homo sapiens
ccctaagctccttct

SEQ ID NO: 26578 - DNA, 15 bp, Homo sapiens
tccctaagctccttc

SEQ ID NO: 26579 - DNA, 15 bp, Homo sapiens
gtccctaagctcctt

SEQ ID NO: 26580 - DNA, 15 bp, Homo sapiens
cgtccctaagctcct

SEQ ID NO: 26581 - DNA, 15 bp, Homo sapiens
acgtccctaagctcc

SEQ ID NO: 26582 - DNA, 15 bp, Homo sapiens
tacgtccctaagctc

SEQ ID NO: 26583 - DNA, 15 bp, Homo sapiens
ttacgtccctaagct

SEQ ID NO: 26584 - DNA, 15 bp, Homo sapiens
cttacgtccctaagc

SEQ ID NO: 26585 - DNA, 15 bp, Homo sapiens
acttacgtccctaag

SEQ ID NO: 26586 - DNA, 15 bp, Homo sapiens
gacttacgtccctaa

SEQ ID NO: 26587 - DNA, 15 bp, Homo sapiens
tgacttacgtcccta

SEQ ID NO: 26588 - DNA, 15 bp, Homo sapiens
ctgacttacgtccct

SEQ ID NO: 26589 - DNA, 15 bp, Homo sapiens
cctgacttacgtccc

SEQ ID NO: 26590 - DNA, 15 bp, Homo sapiens
gcctgacttacgtcc

SEQ ID NO: 26591 - DNA, 15 bp, Homo sapiens
agcctgacttacgtc

SEQ ID NO: 26592 - DNA, 15 bp, Homo sapiens
gagcctgacttacgt

SEQ ID NO: 26593 - DNA, 15 bp, Homo sapiens
agagcctgacttacg

SEQ ID NO: 26594 - DNA, 15 bp, Homo sapiens
gagagcctgacttac

SEQ ID NO: 26595 - DNA, 15 bp, Homo sapiens
tgagagcctgactta

SEQ ID NO: 26596 - DNA, 15 bp, Homo sapiens
ttgagagcctgactt

SEQ ID NO: 26597 - DNA, 15 bp, Homo sapiens
tttgagagcctgact

SEQ ID NO: 26598 - DNA, 15 bp, Homo sapiens
ctttgagagcctgac

SEQ ID NO: 26599 - DNA, 15 bp, Homo sapiens
actttgagagcctga

SEQ ID NO: 26600 - DNA, 15 bp, Homo sapiens
gactttgagagcctg

SEQ ID NO: 26601 - DNA, 15 bp, Homo sapiens
agactttgagagcct

SEQ ID NO: 26602 - DNA, 15 bp, Homo sapiens
tagactttgagagcc

SEQ ID NO: 26603 - DNA, 15 bp, Homo sapiens
atagactttgagagc

SEQ ID NO: 26604 - DNA, 15 bp, Homo sapiens
catagactttgagag

SEQ ID NO: 26605 - DNA, 15 bp, Homo sapiens
acatagactttgaga

SEQ ID NO: 26606 - DNA, 15 bp, Homo sapiens
gacatagactttgag

SEQ ID NO: 26607 - DNA, 15 bp, Homo sapiens
agacatagactttga

SEQ ID NO: 26608 - DNA, 15 bp, Homo sapiens
cagacatagactttg

SEQ ID NO: 26609 - DNA, 15 bp, Homo sapiens
ccagacatagacttt

SEQ ID NO: 26610 - DNA, 15 bp, Homo sapiens
accagacatagactt

SEQ ID NO: 26611 - DNA, 15 bp, Homo sapiens
aaccagacatagact

SEQ ID NO: 26612 - DNA, 15 bp, Homo sapiens
gaaccagacatagac

SEQ ID NO: 26613 - DNA, 15 bp, Homo sapiens
ggaaccagacataga

SEQ ID NO: 26614 - DNA, 15 bp, Homo sapiens
aggaaccagacatag

SEQ ID NO: 26615 - DNA, 15 bp, Homo sapiens
caggaaccagacata

SEQ ID NO: 26616 - DNA, 15 bp, Homo sapiens
gcaggaaccagacat

SEQ ID NO: 26617 - DNA, 15 bp, Homo sapiens
ggcaggaaccagaca

SEQ ID NO: 26618 - DNA, 15 bp, Homo sapiens
gggcaggaaccagac

SEQ ID NO: 26619 - DNA, 15 bp, Homo sapiens
ggggcaggaaccaga

SEQ ID NO: 26620 - DNA, 15 bp, Homo sapiens
gggggcaggaaccag

SEQ ID NO: 26621 - DNA, 15 bp, Homo sapiens
tgggggcaggaacca

SEQ ID NO: 26622 - DNA, 15 bp, Homo sapiens
gtgggggcaggaacc

SEQ ID NO: 26623 - DNA, 15 bp, Homo sapiens
tgtgggggcaggaac

SEQ ID NO: 26624 - DNA, 15 bp, Homo sapiens
ttgtgggggcaggaa

SEQ ID NO: 26625 - DNA, 15 bp, Homo sapiens
tttgtgggggcagga

SEQ ID NO: 26626 - DNA, 15 bp, Homo sapiens
gtttgtgggggcagg

SEQ ID NO: 26627 - DNA, 15 bp, Homo sapiens
ggtttgtgggggcag

SEQ ID NO: 26628 - DNA, 15 bp, Homo sapiens
tggtttgtgggggca

SEQ ID NO: 26629 - DNA, 15 bp, Homo sapiens
gtggtttgtgggggc

SEQ ID NO: 26630 - DNA, 15 bp, Homo sapiens
ggtggtttgtggggg

SEQ ID NO: 26631 - DNA, 15 bp, Homo sapiens
tggtggtttgtgggg

SEQ ID NO: 26632 - DNA, 15 bp, Homo sapiens
gtggtggtttgtggg

SEQ ID NO: 26633 - DNA, 15 bp, Homo sapiens
ggtggtggtttgtgg

SEQ ID NO: 26634 - DNA, 15 bp, Homo sapiens
gggtggtggtttgtg

SEQ ID NO: 26635 - DNA, 15 bp, Homo sapiens
tgggtggtggtttgt

SEQ ID NO: 26636 - DNA, 15 bp, Homo sapiens
ctgggtggtggtttg

SEQ ID NO: 26637 - DNA, 15 bp, Homo sapiens
cctgggtggtggttt

SEQ ID NO: 26638 - DNA, 15 bp, Homo sapiens
tcctgggtggtggtt

SEQ ID NO: 26639 - DNA, 15 bp, Homo sapiens
ttcctgggtggtggt

SEQ ID NO: 26640 - DNA, 15 bp, Homo sapiens
tttcctgggtggtgg

SEQ ID NO: 26641 - DNA, 15 bp, Homo sapiens
gtttcctgggtggtg

SEQ ID NO: 26642 - DNA, 15 bp, Homo sapiens
tgtttcctgggtggt

SEQ ID NO: 26643 - DNA, 15 bp, Homo sapiens
atgtttcctgggtgg

SEQ ID NO: 26644 - DNA, 15 bp, Homo sapiens
gatgtttcctgggtg

SEQ ID NO: 26645 - DNA, 15 bp, Homo sapiens
tgatgtttcctgggt

SEQ ID NO: 26646 - DNA, 15 bp, Homo sapiens
atgatgtttcctggg

SEQ ID NO: 26647 - DNA, 15 bp, Homo sapiens
aatgatgtttcctgg

SEQ ID NO: 26648 - DNA, 15 bp, Homo sapiens
gaatgatgtttcctg

SEQ ID NO: 26649 - DNA, 15 bp, Homo sapiens
ggaatgatgtttcct

SEQ ID NO: 26650 - DNA, 15 bp, Homo sapiens
aggaatgatgtttcc

SEQ ID NO: 26651 - DNA, 15 bp, Homo sapiens
caggaatgatgtttc

SEQ ID NO: 26652 - DNA, 15 bp, Homo sapiens
tcaggaatgatgttt

SEQ ID NO: 26653 - DNA, 15 bp, Homo sapiens
ctcaggaatgatgtt

SEQ ID NO: 26654 - DNA, 15 bp, Homo sapiens
gctcaggaatgatgt

SEQ ID NO: 26655 - DNA, 15 bp, Homo sapiens
agctcaggaatgatg

SEQ ID NO: 26656 - DNA, 15 bp, Homo sapiens
cagctcaggaatgat

SEQ ID NO: 26657 - DNA, 15 bp, Homo sapiens
acagctcaggaatga

SEQ ID NO: 26658 - DNA, 15 bp, Homo sapiens
cacagctcaggaatg

SEQ ID NO: 26659 - DNA, 15 bp, Homo sapiens
acacagctcaggaat

SEQ ID NO: 26660 - DNA, 15 bp, Homo sapiens
cacacagctcaggaa

SEQ ID NO: 26661 - DNA, 15 bp, Homo sapiens
ccacacagctcagga

SEQ ID NO: 26662 - DNA, 15 bp, Homo sapiens
gccacacagctcagg

SEQ ID NO: 26663 - DNA, 15 bp, Homo sapiens
tgccacacagctcag

SEQ ID NO: 26664 - DNA, 15 bp, Homo sapiens
ctgccacacagctca

SEQ ID NO: 26665 - DNA, 15 bp, Homo sapiens
gctgccacacagctc

SEQ ID NO: 26666 - DNA, 15 bp, Homo sapiens
tgctgccacacagct

SEQ ID NO: 26667 - DNA, 15 bp, Homo sapiens
ctgctgccacacagc

SEQ ID NO: 26668 - DNA, 15 bp, Homo sapiens
gctgctgccacacag

SEQ ID NO: 26669 - DNA, 15 bp, Homo sapiens
tgctgctgccacaca

SEQ ID NO: 26670 - DNA, 15 bp, Homo sapiens
ctgctgctgccacac

SEQ ID NO: 26671 - DNA, 15 bp, Homo sapiens
gctgctgctgccaca

SEQ ID NO: 26672 - DNA, 15 bp, Homo sapiens
tgctgctgctgccac

SEQ ID NO: 26673 - DNA, 15 bp, Homo sapiens
ctgctgctgctgcca

SEQ ID NO: 26674 - DNA, 15 bp, Homo sapiens
gctgctgctgctgcc

SEQ ID NO: 26675 - DNA, 15 bp, Homo sapiens
agctgctgctgctgc

SEQ ID NO: 26676 - DNA, 15 bp, Homo sapiens
cagctgctgctgctg

SEQ ID NO: 26677 - DNA, 15 bp, Homo sapiens
gcagctgctgctgct

SEQ ID NO: 26678 - DNA, 15 bp, Homo sapiens
agcagctgctgctgc

SEQ ID NO: 26679 - DNA, 15 bp, Homo sapiens
gagcagctgctgctg

SEQ ID NO: 26680 - DNA, 15 bp, Homo sapiens
ggagcagctgctgct

SEQ ID NO: 26681 - DNA, 15 bp, Homo sapiens
aggagcagctgctgc

SEQ ID NO: 26682 - DNA, 15 bp, Homo sapiens
aaggagcagctgctg

SEQ ID NO: 26683 - DNA, 15 bp, Homo sapiens
aaaggagcagctgct

SEQ ID NO: 26684 - DNA, 15 bp, Homo sapiens
aaaaggagcagctgc

SEQ ID NO: 26685 - DNA, 15 bp, Homo sapiens
taaaaggagcagctg

SEQ ID NO: 26686 - DNA, 15 bp, Homo sapiens
ataaaaggagcagct

SEQ ID NO: 26687 - DNA, 15 bp, Homo sapiens
tataaaaggagcagc

SEQ ID NO: 26688 - DNA, 15 bp, Homo sapiens
atataaaaggagcag

SEQ ID NO: 26689 - DNA, 15 bp, Homo sapiens
catataaaaggagca

SEQ ID NO: 26690 - DNA, 15 bp, Homo sapiens
ccatataaaaggagc

SEQ ID NO: 26691 - DNA, 15 bp, Homo sapiens
gccatataaaaggag

SEQ ID NO: 26692 - DNA, 15 bp, Homo sapiens
tgccatataaaagga

SEQ ID NO: 26693 - DNA, 15 bp, Homo sapiens
ctgccatataaaagg

SEQ ID NO: 26694 - DNA, 15 bp, Homo sapiens
tctgccatataaaag

SEQ ID NO: 26695 - DNA, 15 bp, Homo sapiens
gtctgccatataaaa

SEQ ID NO: 26696 - DNA, 15 bp, Homo sapiens
tgtctgccatataaa

SEQ ID NO: 26697 - DNA, 15 bp, Homo sapiens
ctgtctgccatataa

SEQ ID NO: 26698 - DNA, 15 bp, Homo sapiens
cctgtctgccatata

SEQ ID NO: 26699 - DNA, 15 bp, Homo sapiens
ccctgtctgccatat

SEQ ID NO: 26700 - DNA, 15 bp, Homo sapiens
accctgtctgccata

SEQ ID NO: 26701 - DNA, 15 bp, Homo sapiens
caccctgtctgccat

SEQ ID NO: 26702 - DNA, 15 bp, Homo sapiens
tcaccctgtctgcca

SEQ ID NO: 26703 - DNA, 15 bp, Homo sapiens
atcaccctgtctgcc

SEQ ID NO: 26704 - DNA, 15 bp, Homo sapiens
aatcaccctgtctgc

SEQ ID NO: 26705 - DNA, 15 bp, Homo sapiens
caatcaccctgtctg

SEQ ID NO: 26706 - DNA, 15 bp, Homo sapiens
gcaatcaccctgtct

SEQ ID NO: 26707 - DNA, 15 bp, Homo sapiens
agcaatcaccctgtc

SEQ ID NO: 26708 - DNA, 15 bp, Homo sapiens
aagcaatcaccctgt

SEQ ID NO: 26709 - DNA, 15 bp, Homo sapiens
caagcaatcaccctg

SEQ ID NO: 26710 - DNA, 15 bp, Homo sapiens
acaagcaatcaccct

SEQ ID NO: 26711 - DNA, 15 bp, Homo sapiens
aacaagcaatcaccc

SEQ ID NO: 26712 - DNA, 15 bp, Homo sapiens
caacaagcaatcacc

SEQ ID NO: 26713 - DNA, 15 bp, Homo sapiens
ccaacaagcaatcac

SEQ ID NO: 26714 - DNA, 15 bp, Homo sapiens
cccaacaagcaatca

SEQ ID NO: 26715 - DNA, 15 bp, Homo sapiens
gcccaacaagcaatc

SEQ ID NO: 26716 - DNA, 15 bp, Homo sapiens
tgcccaacaagcaat

SEQ ID NO: 26717 - DNA, 15 bp, Homo sapiens
ttgcccaacaagcaa

SEQ ID NO: 26718 - DNA, 15 bp, Homo sapiens
cttgcccaacaagca

SEQ ID NO: 26719 - DNA, 15 bp, Homo sapiens
tcttgcccaacaagc

SEQ ID NO: 26720 - DNA, 15 bp, Homo sapiens
ctcttgcccaacaag

SEQ ID NO: 26721 - DNA, 15 bp, Homo sapiens
gctcttgcccaacaa

SEQ ID NO: 26722 - DNA, 15 bp, Homo sapiens
ggctcttgcccaaca

SEQ ID NO: 26723 - DNA, 15 bp, Homo sapiens
gggctcttgcccaac

SEQ ID NO: 26724 - DNA, 15 bp, Homo sapiens
agggctcttgcccaa

SEQ ID NO: 26725 - DNA, 15 bp, Homo sapiens
gagggctcttgccca

SEQ ID NO: 26726 - DNA, 15 bp, Homo sapiens
ggagggctcttgccc

SEQ ID NO: 26727 - DNA, 15 bp, Homo sapiens
aggagggctcttgcc

SEQ ID NO: 26728 - DNA, 15 bp, Homo sapiens
taggagggctcttgc

SEQ ID NO: 26729 - DNA, 15 bp, Homo sapiens
gtaggagggctcttg

SEQ ID NO: 26730 - DNA, 15 bp, Homo sapiens
tgtaggagggctctt

SEQ ID NO: 26731 - DNA, 15 bp, Homo sapiens
gtgtaggagggctct

SEQ ID NO: 26732 - DNA, 15 bp, Homo sapiens
agtgtaggagggctc

SEQ ID NO: 26733 - DNA, 15 bp, Homo sapiens
tagtgtaggagggct

SEQ ID NO: 26734 - DNA, 15 bp, Homo sapiens
atagtgtaggagggc

SEQ ID NO: 26735 - DNA, 15 bp, Homo sapiens
gatagtgtaggaggg

SEQ ID NO: 26736 - DNA, 15 bp, Homo sapiens
agatagtgtaggagg

SEQ ID NO: 26737 - DNA, 15 bp, Homo sapiens
aagatagtgtaggag

SEQ ID NO: 26738 - DNA, 15 bp, Homo sapiens
taagatagtgtagga

SEQ ID NO: 26739 - DNA, 15 bp, Homo sapiens
ctaagatagtgtagg

SEQ ID NO: 26740 - DNA, 15 bp, Homo sapiens
tctaagatagtgtag

SEQ ID NO: 26741 - DNA, 15 bp, Homo sapiens
ctctaagatagtgta

SEQ ID NO: 26742 - DNA, 15 bp, Homo sapiens
actctaagatagtgt

SEQ ID NO: 26743 - DNA, 15 bp, Homo sapiens
cactctaagatagtg

SEQ ID NO: 26744 - DNA, 15 bp, Homo sapiens
tcactctaagatagt

SEQ ID NO: 26745 - DNA, 15 bp, Homo sapiens
ttcactctaagatag

SEQ ID NO: 26746 - DNA, 15 bp, Homo sapiens
attcactctaagata

SEQ ID NO: 26747 - DNA, 15 bp, Homo sapiens
tattcactctaagat

SEQ ID NO: 26748 - DNA, 15 bp, Homo sapiens
gtattcactctaaga

SEQ ID NO: 26749 - DNA, 15 bp, Homo sapiens
ggtattcactctaag

SEQ ID NO: 26750 - DNA, 15 bp, Homo sapiens
gggtattcactctaa

SEQ ID NO: 26751 - DNA, 15 bp, Homo sapiens
agggtattcactcta

SEQ ID NO: 26752 - DNA, 15 bp, Homo sapiens
gagggtattcactct

SEQ ID NO: 26753 - DNA, 15 bp, Homo sapiens
agagggtattcactc

SEQ ID NO: 26754 - DNA, 15 bp, Homo sapiens
tagagggtattcact

SEQ ID NO: 26755 - DNA, 15 bp, Homo sapiens
atagagggtattcac

SEQ ID NO: 26756 - DNA, 15 bp, Homo sapiens
gatagagggtattca

SEQ ID NO: 26757 - DNA, 15 bp, Homo sapiens
agatagagggtattc

SEQ ID NO: 26758 - DNA, 15 bp, Homo sapiens
cagatagagggtatt

SEQ ID NO: 26759 - DNA, 15 bp, Homo sapiens
gcagatagagggtat

SEQ ID NO: 26760 - DNA, 15 bp, Homo sapiens
tgcagatagagggta

SEQ ID NO: 26761 - DNA, 15 bp, Homo sapiens
ctgcagatagagggt

SEQ ID NO: 26762 - DNA, 15 bp, Homo sapiens
actgcagatagaggg

SEQ ID NO: 26763 - DNA, 15 bp, Homo sapiens
gactgcagatagagg

SEQ ID NO: 26764 - DNA, 15 bp, Homo sapiens
ggactgcagatagag

SEQ ID NO: 26765 - DNA, 15 bp, Homo sapiens
tggactgcagataga

SEQ ID NO: 26766 - DNA, 15 bp, Homo sapiens
ctggactgcagatag

SEQ ID NO: 26767 - DNA, 15 bp, Homo sapiens
cctggactgcagata

SEQ ID NO: 26768 - DNA, 15 bp, Homo sapiens
ccctggactgcagat

SEQ ID NO: 26769 - DNA, 15 bp, Homo sapiens
accctggactgcaga

SEQ ID NO: 26770 - DNA, 15 bp, Homo sapiens
gaccctggactgcag

SEQ ID NO: 26771 - DNA, 15 bp, Homo sapiens
agaccctggactgca

SEQ ID NO: 26772 - DNA, 15 bp, Homo sapiens
cagaccctggactgc

SEQ ID NO: 26773 - DNA, 15 bp, Homo sapiens
gcagaccctggactg

SEQ ID NO: 26774 - DNA, 15 bp, Homo sapiens
tgcagaccctggact

SEQ ID NO: 26775 - DNA, 15 bp, Homo sapiens
gtgcagaccctggac

SEQ ID NO: 26776 - DNA, 15 bp, Homo sapiens
tgtgcagaccctgga

SEQ ID NO: 26777 - DNA, 15 bp, Homo sapiens
ctgtgcagaccctgg

SEQ ID NO: 26778 - DNA, 15 bp, Homo sapiens
gctgtgcagaccctg

SEQ ID NO: 26779 - DNA, 15 bp, Homo sapiens
ggctgtgcagaccct

SEQ ID NO: 26780 - DNA, 15 bp, Homo sapiens
tggctgtgcagaccc

SEQ ID NO: 26781 - DNA, 15 bp, Homo sapiens
gtggctgtgcagacc

SEQ ID NO: 26782 - DNA, 15 bp, Homo sapiens
tgtggctgtgcagac

SEQ ID NO: 26783 - DNA, 15 bp, Homo sapiens
atgtggctgtgcaga

SEQ ID NO: 26784 - DNA, 15 bp, Homo sapiens
catgtggctgtgcag

SEQ ID NO: 26785 - DNA, 15 bp, Homo sapiens
ccatgtggctgtgca

SEQ ID NO: 26786 - DNA, 15 bp, Homo sapiens
accatgtggctgtgc

SEQ ID NO: 26787 - DNA, 15 bp, Homo sapiens
gaccatgtggctgtg

SEQ ID NO: 26788 - DNA, 15 bp, Homo sapiens
ggaccatgtggctgt

SEQ ID NO: 26789 - DNA, 15 bp, Homo sapiens
aggaccatgtggctg

SEQ ID NO: 26790 - DNA, 15 bp, Homo sapiens
gaggaccatgtggct

SEQ ID NO: 26791 - DNA, 15 bp, Homo sapiens
agaggaccatgtggc

SEQ ID NO: 26792 - DNA, 15 bp, Homo sapiens
tagaggaccatgtgg

SEQ ID NO: 26793 - DNA, 15 bp, Homo sapiens
ttagaggaccatgtg

SEQ ID NO: 26794 - DNA, 15 bp, Homo sapiens
attagaggaccatgt

SEQ ID NO: 26795 - DNA, 15 bp, Homo sapiens
tattagaggaccatg

SEQ ID NO: 26796 - DNA, 15 bp, Homo sapiens
ctattagaggaccat

SEQ ID NO: 26797 - DNA, 15 bp, Homo sapiens
cctattagaggacca

SEQ ID NO: 26798 - DNA, 15 bp, Homo sapiens
acctattagaggacc

SEQ ID NO: 26799 - DNA, 15 bp, Homo sapiens
gacctattagaggac

SEQ ID NO: 26800 - DNA, 15 bp, Homo sapiens
ggacctattagagga

SEQ ID NO: 26801 - DNA, 15 bp, Homo sapiens
tggacctattagagg

SEQ ID NO: 26802 - DNA, 15 bp, Homo sapiens
gtggacctattagag

SEQ ID NO: 26803 - DNA, 15 bp, Homo sapiens
ggtggacctattaga

SEQ ID NO: 26804 - DNA, 15 bp, Homo sapiens
tggtggacctattag

SEQ ID NO: 26805 - DNA, 15 bp, Homo sapiens
ctggtggacctatta

SEQ ID NO: 26806 - DNA, 15 bp, Homo sapiens
tctggtggacctatt

SEQ ID NO: 26807 - DNA, 15 bp, Homo sapiens
gtctggtggacctat

SEQ ID NO: 26808 - DNA, 15 bp, Homo sapiens
ggtctggtggaccta

SEQ ID NO: 26809 - DNA, 15 bp, Homo sapiens
tggtctggtggacct

SEQ ID NO: 26810 - DNA, 15 bp, Homo sapiens
atggtctggtggacc

SEQ ID NO: 26811 - DNA, 15 bp, Homo sapiens
aatggtctggtggac

SEQ ID NO: 26812 - DNA, 15 bp, Homo sapiens
aaatggtctggtgga

SEQ ID NO: 26813 - DNA, 15 bp, Homo sapiens
caaatggtctggtgg

SEQ ID NO: 26814 - DNA, 15 bp, Homo sapiens
gcaaatggtctggtg

SEQ ID NO: 26815 - DNA, 15 bp, Homo sapiens
ggcaaatggtctggt

SEQ ID NO: 26816 - DNA, 15 bp, Homo sapiens
aggcaaatggtctgg

SEQ ID NO: 26817 - DNA, 15 bp, Homo sapiens
caggcaaatggtctg

SEQ ID NO: 26818 - DNA, 15 bp, Homo sapiens
gcaggcaaatggtct

SEQ ID NO: 26819 - DNA, 15 bp, Homo sapiens
tgcaggcaaatggtc

SEQ ID NO: 26820 - DNA, 15 bp, Homo sapiens
ttgcaggcaaatggt

SEQ ID NO: 26821 - DNA, 15 bp, Homo sapiens
tttgcaggcaaatgg

SEQ ID NO: 26822 - DNA, 15 bp, Homo sapiens
gtttgcaggcaaatg

SEQ ID NO: 26823 - DNA, 15 bp, Homo sapiens
tgtttgcaggcaaat

SEQ ID NO: 26824 - DNA, 15 bp, Homo sapiens
ctgtttgcaggcaaa

SEQ ID NO: 26825 - DNA, 15 bp, Homo sapiens
gctgtttgcaggcaa

SEQ ID NO: 26826 - DNA, 15 bp, Homo sapiens
ggctgtttgcaggca

SEQ ID NO: 26827 - DNA, 15 bp, Homo sapiens
aggctgtttgcaggc

SEQ ID NO: 26828 - DNA, 15 bp, Homo sapiens
gaggctgtttgcagg

SEQ ID NO: 26829 - DNA, 15 bp, Homo sapiens
tgaggctgtttgcag

SEQ ID NO: 26830 - DNA, 15 bp, Homo sapiens
atgaggctgtttgca

SEQ ID NO: 26831 - DNA, 15 bp, Homo sapiens
gatgaggctgtttgc

SEQ ID NO: 26832 - DNA, 15 bp, Homo sapiens
ggatgaggctgtttg

SEQ ID NO: 26833 - DNA, 15 bp, Homo sapiens
aggatgaggctgttt

SEQ ID NO: 26834 - DNA, 15 bp, Homo sapiens
gaggatgaggctgtt

SEQ ID NO: 26835 - DNA, 15 bp, Homo sapiens
tgaggatgaggctgt

SEQ ID NO: 26836 - DNA, 15 bp, Homo sapiens
ctgaggatgaggctg

SEQ ID NO: 26837 - DNA, 15 bp, Homo sapiens
actgaggatgaggct

SEQ ID NO: 26838 - DNA, 15 bp, Homo sapiens
cactgaggatgaggc

SEQ ID NO: 26839 - DNA, 15 bp, Homo sapiens
gcactgaggatgagg

SEQ ID NO: 26840 - DNA, 15 bp, Homo sapiens
ggcactgaggatgag

SEQ ID NO: 26841 - DNA, 15 bp, Homo sapiens
gggcactgaggatga

SEQ ID NO: 26842 - DNA, 15 bp, Homo sapiens
tgggcactgaggatg

SEQ ID NO: 26843 - DNA, 15 bp, Homo sapiens
gtgggcactgaggat

SEQ ID NO: 26844 - DNA, 15 bp, Homo sapiens
agtgggcactgagga

SEQ ID NO: 26845 - DNA, 15 bp, Homo sapiens
cagtgggcactgagg

SEQ ID NO: 26846 - DNA, 15 bp, Homo sapiens
acagtgggcactgag

SEQ ID NO: 26847 - DNA, 15 bp, Homo sapiens
gacagtgggcactga

SEQ ID NO: 26848 - DNA, 15 bp, Homo sapiens
agacagtgggcactg

SEQ ID NO: 26849 - DNA, 15 bp, Homo sapiens
gagacagtgggcact

SEQ ID NO: 26850 - DNA, 15 bp, Homo sapiens
ggagacagtgggcac

SEQ ID NO: 26851 - DNA, 15 bp, Homo sapiens
aggagacagtgggca

SEQ ID NO: 26852 - DNA, 15 bp, Homo sapiens
taggagacagtgggc

SEQ ID NO: 26853 - DNA, 15 bp, Homo sapiens
ctaggagacagtggg

SEQ ID NO: 26854 - DNA, 15 bp, Homo sapiens
gctaggagacagtgg

SEQ ID NO: 26855 - DNA, 15 bp, Homo sapiens
agctaggagacagtg

SEQ ID NO: 26856 - DNA, 15 bp, Homo sapiens
cagctaggagacagt

SEQ ID NO: 26857 - DNA, 15 bp, Homo sapiens
acagctaggagacag

SEQ ID NO: 26858 - DNA, 15 bp, Homo sapiens
cacagctaggagaca

SEQ ID NO: 26859 - DNA, 15 bp, Homo sapiens
ccacagctaggagac

SEQ ID NO: 26860 - DNA, 15 bp, Homo sapiens
tccacagctaggaga

SEQ ID NO: 26861 - DNA, 15 bp, Homo sapiens
ctccacagctaggag

SEQ ID NO: 26862 - DNA, 15 bp, Homo sapiens
cagcaaaggaatggg

SEQ ID NO: 26863 - DNA, 15 bp, Homo sapiens
gcagcaaaggaatgg

SEQ ID NO: 26864 - DNA, 15 bp, Homo sapiens
ggcagcaaaggaatg

SEQ ID NO: 26865 - DNA, 15 bp, Homo sapiens
aggcagcaaaggaat

SEQ ID NO: 26866 - DNA, 15 bp, Homo sapiens
caggcagcaaaggaa

SEQ ID NO: 26867 - DNA, 15 bp, Homo sapiens
tcaggcagcaaagga

SEQ ID NO: 26868 - DNA, 15 bp, Homo sapiens
ctcaggcagcaaagg

SEQ ID NO: 26869 - DNA, 15 bp, Homo sapiens
tctcaggcagcaaag

SEQ ID NO: 26870 - DNA, 15 bp, Homo sapiens
gtctcaggcagcaaa

SEQ ID NO: 26871 - DNA, 15 bp, Homo sapiens
cgtctcaggcagcaa

SEQ ID NO: 26872 - DNA, 15 bp, Homo sapiens
ccgtctcaggcagca

SEQ ID NO: 26873 - DNA, 15 bp, Homo sapiens
accgtctcaggcagc

SEQ ID NO: 26874 - DNA, 15 bp, Homo sapiens
aaccgtctcaggcag

SEQ ID NO: 26875 - DNA, 15 bp, Homo sapiens
gaaccgtctcaggca

SEQ ID NO: 26876 - DNA, 15 bp, Homo sapiens
tgaaccgtctcaggc

SEQ ID NO: 26877 - DNA, 15 bp, Homo sapiens
ctgaaccgtctcagg

SEQ ID NO: 26878 - DNA, 15 bp, Homo sapiens
actgaaccgtctcag

SEQ ID NO: 26879 - DNA, 15 bp, Homo sapiens
cactgaaccgtctca

SEQ ID NO: 26880 - DNA, 15 bp, Homo sapiens
ccactgaaccgtctc

SEQ ID NO: 26881 - DNA, 15 bp, Homo sapiens
gccactgaaccgtct

SEQ ID NO: 26882 - DNA, 15 bp, Homo sapiens
agccactgaaccgtc

SEQ ID NO: 26883 - DNA, 15 bp, Homo sapiens
cagccactgaaccgt

SEQ ID NO: 26884 - DNA, 15 bp, Homo sapiens
ccagccactgaaccg

SEQ ID NO: 26885 - DNA, 15 bp, Homo sapiens
gccagccactgaacc

SEQ ID NO: 26886 - DNA, 15 bp, Homo sapiens
tgccagccactgaac

SEQ ID NO: 26887 - DNA, 15 bp, Homo sapiens
ctgccagccactgaa

SEQ ID NO: 26888 - DNA, 15 bp, Homo sapiens
cctgccagccactga

SEQ ID NO: 26889 - DNA, 15 bp, Homo sapiens
gcctgccagccactg

SEQ ID NO: 26890 - DNA, 15 bp, Homo sapiens
ggcctgccagccact

SEQ ID NO: 26891 - DNA, 15 bp, Homo sapiens
tggcctgccagccac

SEQ ID NO: 26892 - DNA, 15 bp, Homo sapiens
ctggcctgccagcca

SEQ ID NO: 26893 - DNA, 15 bp, Homo sapiens
gctggcctgccagcc

SEQ ID NO: 26894 - DNA, 15 bp, Homo sapiens
tgctggcctgccagc

SEQ ID NO: 26895 - DNA, 15 bp, Homo sapiens
ctgctggcctgccag

SEQ ID NO: 26896 - DNA, 15 bp, Homo sapiens
cctgctggcctgcca

SEQ ID NO: 26897 - DNA, 15 bp, Homo sapiens
tcctgctggcctgcc

SEQ ID NO: 26898 - DNA, 15 bp, Homo sapiens
atcctgctggcctgc

SEQ ID NO: 26899 - DNA, 15 bp, Homo sapiens
gatcctgctggcctg

SEQ ID NO: 26900 - DNA, 15 bp, Homo sapiens
cgatcctgctggcct

SEQ ID NO: 26901 - DNA, 15 bp, Homo sapiens
gcgatcctgctggcc

SEQ ID NO: 26902 - DNA, 15 bp, Homo sapiens
agcgatcctgctggc

SEQ ID NO: 26903 - DNA, 15 bp, Homo sapiens
cagcgatcctgctgg

SEQ ID NO: 26904 - DNA, 15 bp, Homo sapiens
gcagcgatcctgctg

SEQ ID NO: 26905 - DNA, 15 bp, Homo sapiens
tgcagcgatcctgct

SEQ ID NO: 26906 - DNA, 15 bp, Homo sapiens
ctgcagcgatcctgc

SEQ ID NO: 26907 - DNA, 15 bp, Homo sapiens
cctgcagcgatcctg

SEQ ID NO: 26908 - DNA, 15 bp, Homo sapiens
ccctgcagcgatcct

SEQ ID NO: 26909 - DNA, 15 bp, Homo sapiens
gccctgcagcgatcc

SEQ ID NO: 26910 - DNA, 15 bp, Homo sapiens
ggccctgcagcgatc

SEQ ID NO: 26911 - DNA, 15 bp, Homo sapiens
gggccctgcagcgat

SEQ ID NO: 26912 - DNA, 15 bp, Homo sapiens
agggccctgcagcga

SEQ ID NO: 26913 - DNA, 15 bp, Homo sapiens
cagggccctgcagcg

SEQ ID NO: 26914 - DNA, 15 bp, Homo sapiens
tcagggccctgcagc

SEQ ID NO: 26915 - DNA, 15 bp, Homo sapiens
ctcagggccctgcag

SEQ ID NO: 26916 - DNA, 15 bp, Homo sapiens
gctcagggccctgca

SEQ ID NO: 26917 - DNA, 15 bp, Homo sapiens
ggctcagggccctgc

SEQ ID NO: 26918 - DNA, 15 bp, Homo sapiens
gggctcagggccctg

SEQ ID NO: 26919 - DNA, 15 bp, Homo sapiens
ggggctcagggccct

SEQ ID NO: 26920 - DNA, 15 bp, Homo sapiens
tggggctcagggccc

SEQ ID NO: 26921 - DNA, 15 bp, Homo sapiens
atggggctcagggcc

SEQ ID NO: 26922 - DNA, 15 bp, Homo sapiens
gatggggctcagggc

SEQ ID NO: 26923 - DNA, 15 bp, Homo sapiens
agatggggctcaggg

SEQ ID NO: 26924 - DNA, 15 bp, Homo sapiens
tagatggggctcagg

SEQ ID NO: 26925 - DNA, 15 bp, Homo sapiens
ctagatggggctcag

SEQ ID NO: 26926 - DNA, 15 bp, Homo sapiens
actagatggggctca

SEQ ID NO: 26927 - DNA, 15 bp, Homo sapiens
gactagatggggctc

SEQ ID NO: 26928 - DNA, 15 bp, Homo sapiens
tgactagatggggct

SEQ ID NO: 26929 - DNA, 15 bp, Homo sapiens
ctgactagatggggc

SEQ ID NO: 26930 - DNA, 15 bp, Homo sapiens
actgactagatgggg

SEQ ID NO: 26931 - DNA, 15 bp, Homo sapiens
aactgactagatggg

SEQ ID NO: 26932 - DNA, 15 bp, Homo sapiens
gaactgactagatgg

SEQ ID NO: 26933 - DNA, 15 bp, Homo sapiens
tgaactgactagatg

SEQ ID NO: 26934 - DNA, 15 bp, Homo sapiens
atgaactgactagat

SEQ ID NO: 26935 - DNA, 15 bp, Homo sapiens
gatgaactgactaga

SEQ ID NO: 26936 - DNA, 15 bp, Homo sapiens
tgatgaactgactag

SEQ ID NO: 26937 - DNA, 15 bp, Homo sapiens
ctgatgaactgacta

SEQ ID NO: 26938 - DNA, 15 bp, Homo sapiens
gctgatgaactgact

SEQ ID NO: 26939 - DNA, 15 bp, Homo sapiens
ggctgatgaactgac

SEQ ID NO: 26940 - DNA, 15 bp, Homo sapiens
aggctgatgaactga

SEQ ID NO: 26941 - DNA, 15 bp, Homo sapiens
aaggctgatgaactg

SEQ ID NO: 26942 - DNA, 15 bp, Homo sapiens
gaaggctgatgaact

SEQ ID NO: 26943 - DNA, 15 bp, Homo sapiens
tgaaggctgatgaac

SEQ ID NO: 26944 - DNA, 15 bp, Homo sapiens
ctgaaggctgatgaa

SEQ ID NO: 26945 - DNA, 15 bp, Homo sapiens
actgaaggctgatga

SEQ ID NO: 26946 - DNA, 15 bp, Homo sapiens
gactgaaggctgatg

SEQ ID NO: 26947 - DNA, 15 bp, Homo sapiens
ggactgaaggctgat

SEQ ID NO: 26948 - DNA, 15 bp, Homo sapiens
aggactgaaggctga

SEQ ID NO: 26949 - DNA, 15 bp, Homo sapiens
gaggactgaaggctg

SEQ ID NO: 26950 - DNA, 15 bp, Homo sapiens
ggaggactgaaggct

SEQ ID NO: 26951 - DNA, 15 bp, Homo sapiens
gggaggactgaaggc

SEQ ID NO: 26952 - DNA, 15 bp, Homo sapiens
cgggaggactgaagg

SEQ ID NO: 26953 - DNA, 15 bp, Homo sapiens
acgggaggactgaag

SEQ ID NO: 26954 - DNA, 15 bp, Homo sapiens
tacgggaggactgaa

SEQ ID NO: 26955 - DNA, 15 bp, Homo sapiens
ctacgggaggactga

SEQ ID NO: 26956 - DNA, 15 bp, Homo sapiens
gctacgggaggactg

SEQ ID NO: 26957 - DNA, 15 bp, Homo sapiens
agctacgggaggact

SEQ ID NO: 26958 - DNA, 15 bp, Homo sapiens
aagctacgggaggac

SEQ ID NO: 26959 - DNA, 15 bp, Homo sapiens
gaagctacgggagga

SEQ ID NO: 26960 - DNA, 15 bp, Homo sapiens
ggaagctacgggagg

SEQ ID NO: 26961 - DNA, 15 bp, Homo sapiens
aggaagctacgggag

SEQ ID NO: 26962 - DNA, 15 bp, Homo sapiens
taggaagctacggga

SEQ ID NO: 26963 - DNA, 15 bp, Homo sapiens
ctaggaagctacggg

SEQ ID NO: 26964 - DNA, 15 bp, Homo sapiens
cctaggaagctacgg

SEQ ID NO: 26965 - DNA, 15 bp, Homo sapiens
acctaggaagctacg

SEQ ID NO: 26966 - DNA, 15 bp, Homo sapiens
aacctaggaagctac

SEQ ID NO: 26967 - DNA, 15 bp, Homo sapiens
taacctaggaagcta

SEQ ID NO: 26968 - DNA, 15 bp, Homo sapiens
ctaacctaggaagct

SEQ ID NO: 26969 - DNA, 15 bp, Homo sapiens
tctaacctaggaagc

SEQ ID NO: 26970 - DNA, 15 bp, Homo sapiens
atctaacctaggaag

SEQ ID NO: 26971 - DNA, 15 bp, Homo sapiens
catctaacctaggaa

SEQ ID NO: 26972 - DNA, 15 bp, Homo sapiens
gcatctaacctagga

SEQ ID NO: 26973 - DNA, 15 bp, Homo sapiens
agcatctaacctagg

SEQ ID NO: 26974 - DNA, 15 bp, Homo sapiens
cagcatctaacctag

SEQ ID NO: 26975 - DNA, 15 bp, Homo sapiens
tcagcatctaaccta

SEQ ID NO: 26976 - DNA, 15 bp, Homo sapiens
atcagcatctaacct

SEQ ID NO: 26977 - DNA, 15 bp, Homo sapiens
catcagcatctaacc

SEQ ID NO: 26978 - DNA, 15 bp, Homo sapiens
acatcagcatctaac

SEQ ID NO: 26979 - DNA, 15 bp, Homo sapiens
aacatcagcatctaa

SEQ ID NO: 26980 - DNA, 15 bp, Homo sapiens
gaacatcagcatcta

SEQ ID NO: 26981 - DNA, 15 bp, Homo sapiens
agaacatcagcatct

SEQ ID NO: 26982 - DNA, 15 bp, Homo sapiens
aagaacatcagcatc

SEQ ID NO: 26983 - DNA, 15 bp, Homo sapiens
caagaacatcagcat

SEQ ID NO: 26984 - DNA, 15 bp, Homo sapiens
ccaagaacatcagca

SEQ ID NO: 26985 - DNA, 15 bp, Homo sapiens
cccaagaacatcagc

SEQ ID NO: 26986 - DNA, 15 bp, Homo sapiens
ccccaagaacatcag

SEQ ID NO: 26987 - DNA, 15 bp, Homo sapiens
tccccaagaacatca

SEQ ID NO: 26988 - DNA, 15 bp, Homo sapiens
atccccaagaacatc

SEQ ID NO: 26989 - DNA, 15 bp, Homo sapiens
aatccccaagaacat

SEQ ID NO: 26990 - DNA, 15 bp, Homo sapiens
aaatccccaagaaca

SEQ ID NO: 26991 - DNA, 15 bp, Homo sapiens
gaaatccccaagaac

SEQ ID NO: 26992 - DNA, 15 bp, Homo sapiens
agaaatccccaagaa

SEQ ID NO: 26993 - DNA, 15 bp, Homo sapiens
tagaaatccccaaga

SEQ ID NO: 26994 - DNA, 15 bp, Homo sapiens
atagaaatccccaag

SEQ ID NO: 26995 - DNA, 15 bp, Homo sapiens
catagaaatccccaa

SEQ ID NO: 26996 - DNA, 15 bp, Homo sapiens
tcatagaaatcccca

SEQ ID NO: 26997 - DNA, 15 bp, Homo sapiens
atcatagaaatcccc

SEQ ID NO: 26998 - DNA, 15 bp, Homo sapiens
catcatagaaatccc

SEQ ID NO: 26999 - DNA, 15 bp, Homo sapiens
tcatcatagaaatcc

SEQ ID NO: 27000 - DNA, 15 bp, Homo sapiens
atcatcatagaaatc

SEQ ID NO: 27001 - DNA, 15 bp, Homo sapiens
aatcatcatagaaat

SEQ ID NO: 27002 - DNA, 15 bp, Homo sapiens
aaatcatcatagaaa

SEQ ID NO: 27003 - DNA, 15 bp, Homo sapiens
aaaatcatcatagaa

SEQ ID NO: 27004 - DNA, 15 bp, Homo sapiens
aaaaatcatcataga

SEQ ID NO: 27005 - DNA, 15 bp, Homo sapiens
taaaaatcatcatag

SEQ ID NO: 27006 - DNA, 15 bp, Homo sapiens
ttaaaaatcatcata

SEQ ID NO: 27007 - DNA, 15 bp, Homo sapiens
tttaaaaatcatcat

SEQ ID NO: 27008 - DNA, 15 bp, Homo sapiens
atttaaaaatcatca

SEQ ID NO: 27009 - DNA, 15 bp, Homo sapiens
catttaaaaatcatc

SEQ ID NO: 27010 - DNA, 15 bp, Homo sapiens
acatttaaaaatcat

SEQ ID NO: 27011 - DNA, 15 bp, Homo sapiens
cacatttaaaaatca

SEQ ID NO: 27012 - DNA, 15 bp, Homo sapiens
acacatttaaaaatc

SEQ ID NO: 27013 - DNA, 15 bp, Homo sapiens
cacacatttaaaaat

SEQ ID NO: 27014 - DNA, 15 bp, Homo sapiens
acacacatttaaaaa

SEQ ID NO: 27015 - DNA, 15 bp, Homo sapiens
gacacacatttaaaa

SEQ ID NO: 27016 - DNA, 15 bp, Homo sapiens
tgacacacatttaaa

SEQ ID NO: 27017 - DNA, 15 bp, Homo sapiens
ctgacacacatttaa

SEQ ID NO: 27018 - DNA, 15 bp, Homo sapiens
actgacacacattta

SEQ ID NO: 27019 - DNA, 15 bp, Homo sapiens
cactgacacacattt

SEQ ID NO: 27020 - DNA, 15 bp, Homo sapiens
ccactgacacacatt

SEQ ID NO: 27021 - DNA, 15 bp, Homo sapiens
cccactgacacacat

SEQ ID NO: 27022 - DNA, 15 bp, Homo sapiens
tcccactgacacaca

SEQ ID NO: 27023 - DNA, 15 bp, Homo sapiens
ctcccactgacacac

SEQ ID NO: 27024 - DNA, 15 bp, Homo sapiens
gctcccactgacaca

SEQ ID NO: 27025 - DNA, 15 bp, Homo sapiens
tgctcccactgacac

SEQ ID NO: 27026 - DNA, 15 bp, Homo sapiens
ttgctcccactgaca

SEQ ID NO: 27027 - DNA, 15 bp, Homo sapiens
tttgctcccactgac

SEQ ID NO: 27028 - DNA, 15 bp, Homo sapiens
atttgctcccactga

SEQ ID NO: 27029 - DNA, 15 bp, Homo sapiens
tatttgctcccactg

SEQ ID NO: 27030 - DNA, 15 bp, Homo sapiens
atatttgctcccact

SEQ ID NO: 27031 - DNA, 15 bp, Homo sapiens
tatatttgctcccac

SEQ ID NO: 27032 - DNA, 15 bp, Homo sapiens
ttatatttgctccca

SEQ ID NO: 27033 - DNA, 15 bp, Homo sapiens
attatatttgctccc

SEQ ID NO: 27034 - DNA, 15 bp, Homo sapiens
aattatatttgctcc

SEQ ID NO: 27035 - DNA, 15 bp, Homo sapiens
taattatatttgctc

SEQ ID NO: 27036 - DNA, 15 bp, Homo sapiens
ttaattatatttgct

SEQ ID NO: 27037 - DNA, 15 bp, Homo sapiens
gttaattatatttgc

SEQ ID NO: 27038 - DNA, 15 bp, Homo sapiens
agttaattatatttg

SEQ ID NO: 27039 - DNA, 15 bp, Homo sapiens
gagttaattatattt

SEQ ID NO: 27040 - DNA, 15 bp, Homo sapiens
tgagttaattatatt

SEQ ID NO: 27041 - DNA, 15 bp, Homo sapiens
gtgagttaattatat

SEQ ID NO: 27042 - DNA, 15 bp, Homo sapiens
ggtgagttaattata

SEQ ID NO: 27043 - DNA, 15 bp, Homo sapiens
tggtgagttaattat

SEQ ID NO: 27044 - DNA, 15 bp, Homo sapiens
gtggtgagttaatta

SEQ ID NO: 27045 - DNA, 15 bp, Homo sapiens
tgtggtgagttaatt

SEQ ID NO: 27046 - DNA, 15 bp, Homo sapiens
atgtggtgagttaat

SEQ ID NO: 27047 - DNA, 15 bp, Homo sapiens
aatgtggtgagttaa

SEQ ID NO: 27048 - DNA, 15 bp, Homo sapiens
taatgtggtgagtta

SEQ ID NO: 27049 - DNA, 15 bp, Homo sapiens
ttaatgtggtgagtt

SEQ ID NO: 27050 - DNA, 15 bp, Homo sapiens
gttaatgtggtgagt

SEQ ID NO: 27051 - DNA, 15 bp, Homo sapiens
ggttaatgtggtgag

SEQ ID NO: 27052 - DNA, 15 bp, Homo sapiens
tggttaatgtggtga

SEQ ID NO: 27053 - DNA, 15 bp, Homo sapiens
ttggttaatgtggtg

SEQ ID NO: 27054 - DNA, 15 bp, Homo sapiens
tttggttaatgtggt

SEQ ID NO: 27055 - DNA, 15 bp, Homo sapiens
atttggttaatgtgg

SEQ ID NO: 27056 - DNA, 15 bp, Homo sapiens
aatttggttaatgtg

SEQ ID NO: 27057 - DNA, 15 bp, Homo sapiens
taatttggttaatgt

SEQ ID NO: 27058 - DNA, 15 bp, Homo sapiens
ttaatttggttaatg

SEQ ID NO: 27059 - DNA, 15 bp, Homo sapiens
cttaatttggttaat

SEQ ID NO: 27060 - DNA, 15 bp, Homo sapiens
ccttaatttggttaa

SEQ ID NO: 27061 - DNA, 15 bp, Homo sapiens
accttaatttggtta

SEQ ID NO: 27062 - DNA, 15 bp, Homo sapiens
caccttaatttggtt

SEQ ID NO: 27063 - DNA, 15 bp, Homo sapiens
ccaccttaatttggt

SEQ ID NO: 27064 - DNA, 15 bp, Homo sapiens
tccaccttaatttgg

SEQ ID NO: 27065 - DNA, 15 bp, Homo sapiens
ttccaccttaatttg

SEQ ID NO: 27066 - DNA, 15 bp, Homo sapiens
tttccaccttaattt

SEQ ID NO: 27067 - DNA, 15 bp, Homo sapiens
ttttccaccttaatt

SEQ ID NO: 27068 - DNA, 15 bp, Homo sapiens
tttttccaccttaat

SEQ ID NO: 27069 - DNA, 15 bp, Homo sapiens
ttttttccaccttaa

SEQ ID NO: 27070 - DNA, 15 bp, Homo sapiens
gttttttccacctta

SEQ ID NO: 27071 - DNA, 15 bp, Homo sapiens
tgttttttccacctt

SEQ ID NO: 27072 - DNA, 15 bp, Homo sapiens
ttgttttttccacct

SEQ ID NO: 27073 - DNA, 15 bp, Homo sapiens
attgttttttccacc

SEQ ID NO: 27074 - DNA, 15 bp, Homo sapiens
tattgttttttccac

SEQ ID NO: 27075 - DNA, 15 bp, Homo sapiens
ttattgttttttcca

SEQ ID NO: 27076 - DNA, 15 bp, Homo sapiens
cttattgttttttcc

SEQ ID NO: 27077 - DNA, 15 bp, Homo sapiens
ccttattgttttttc

SEQ ID NO: 27078 - DNA, 15 bp, Homo sapiens
accttattgtttttt

SEQ ID NO: 27079 - DNA, 15 bp, Homo sapiens
gaccttattgttttt

SEQ ID NO: 27080 - DNA, 15 bp, Homo sapiens
tgaccttattgtttt

SEQ ID NO: 27081 - DNA, 15 bp, Homo sapiens
gtgaccttattgttt

SEQ ID NO: 27082 - DNA, 15 bp, Homo sapiens
ggtgaccttattgtt

SEQ ID NO: 27083 - DNA, 15 bp, Homo sapiens
aggtgaccttattgt

SEQ ID NO: 27084 - DNA, 15 bp, Homo sapiens
gaggtgaccttattg

SEQ ID NO: 27085 - DNA, 15 bp, Homo sapiens
tgaggtgaccttatt

SEQ ID NO: 27086 - DNA, 15 bp, Homo sapiens
ctgaggtgaccttat

SEQ ID NO: 27087 - DNA, 15 bp, Homo sapiens
actgaggtgacctta

SEQ ID NO: 27088 - DNA, 15 bp, Homo sapiens
tactgaggtgacctt

SEQ ID NO: 27089 - DNA, 15 bp, Homo sapiens
ctactgaggtgacct

SEQ ID NO: 27090 - DNA, 15 bp, Homo sapiens
cctactgaggtgacc

SEQ ID NO: 27091 - DNA, 15 bp, Homo sapiens
acctactgaggtgac

SEQ ID NO: 27092 - DNA, 15 bp, Homo sapiens
cacctactgaggtga

SEQ ID NO: 27093 - DNA, 15 bp, Homo sapiens
gcacctactgaggtg

SEQ ID NO: 27094 - DNA, 15 bp, Homo sapiens
tgcacctactgaggt

SEQ ID NO: 27095 - DNA, 15 bp, Homo sapiens
atgcacctactgagg

SEQ ID NO: 27096 - DNA, 15 bp, Homo sapiens
tatgcacctactgag

SEQ ID NO: 27097 - DNA, 15 bp, Homo sapiens
atatgcacctactga

SEQ ID NO: 27098 - DNA, 15 bp, Homo sapiens
catatgcacctactg

SEQ ID NO: 27099 - DNA, 15 bp, Homo sapiens
tcatatgcacctact

SEQ ID NO: 27100 - DNA, 15 bp, Homo sapiens
atcatatgcacctac

SEQ ID NO: 27101 - DNA, 15 bp, Homo sapiens
catcatatgcaccta

SEQ ID NO: 27102 - DNA, 15 bp, Homo sapiens
tcatcatatgcacct

SEQ ID NO: 27103 - DNA, 15 bp, Homo sapiens
ttcatcatatgcacc

SEQ ID NO: 27104 - DNA, 15 bp, Homo sapiens
tttcatcatatgcac

SEQ ID NO: 27105 - DNA, 15 bp, Homo sapiens
gtttcatcatatgca

SEQ ID NO: 27106 - DNA, 15 bp, Homo sapiens
cgtttcatcatatgc

SEQ ID NO: 27107 - DNA, 15 bp, Homo sapiens
gcgtttcatcatatg

SEQ ID NO: 27108 - DNA, 15 bp, Homo sapiens
tgcgtttcatcatat

SEQ ID NO: 27109 - DNA, 15 bp, Homo sapiens
atgcgtttcatcata

SEQ ID NO: 27110 - DNA, 15 bp, Homo sapiens
gatgcgtttcatcat

SEQ ID NO: 27111 - DNA, 15 bp, Homo sapiens
agatgcgtttcatca

SEQ ID NO: 27112 - DNA, 15 bp, Homo sapiens
aagatgcgtttcatc

SEQ ID NO: 27113 - DNA, 15 bp, Homo sapiens
taagatgcgtttcat

SEQ ID NO: 27114 - DNA, 15 bp, Homo sapiens
ataagatgcgtttca

SEQ ID NO: 27115 - DNA, 15 bp, Homo sapiens
gataagatgcgtttc

SEQ ID NO: 27116 - DNA, 15 bp, Homo sapiens
tgataagatgcgttt

SEQ ID NO: 27117 - DNA, 15 bp, Homo sapiens
gtgataagatgcgtt

SEQ ID NO: 27118 - DNA, 15 bp, Homo sapiens
tgtgataagatgcgt

SEQ ID NO: 27119 - DNA, 15 bp, Homo sapiens
gtgtgataagatgcg

SEQ ID NO: 27120 - DNA, 15 bp, Homo sapiens
ggtgtgataagatgc

SEQ ID NO: 27121 - DNA, 15 bp, Homo sapiens
tggtgtgataagatg

SEQ ID NO: 27122 - DNA, 15 bp, Homo sapiens
ttggtgtgataagat

SEQ ID NO: 27123 - DNA, 15 bp, Homo sapiens
tttggtgtgataaga

SEQ ID NO: 27124 - DNA, 15 bp, Homo sapiens
gtttggtgtgataag

SEQ ID NO: 27125 - DNA, 15 bp, Homo sapiens
agtttggtgtgataa

SEQ ID NO: 27126 - DNA, 15 bp, Homo sapiens
tagtttggtgtgata

SEQ ID NO: 27127 - DNA, 15 bp, Homo sapiens
ttagtttggtgtgat

SEQ ID NO: 27128 - DNA, 15 bp, Homo sapiens
cttagtttggtgtga

SEQ ID NO: 27129 - DNA, 15 bp, Homo sapiens
tcttagtttggtgtg

SEQ ID NO: 27130 - DNA, 15 bp, Homo sapiens
gtcttagtttggtgt

SEQ ID NO: 27131 - DNA, 15 bp, Homo sapiens
agtcttagtttggtg

SEQ ID NO: 27132 - DNA, 15 bp, Homo sapiens
tagtcttagtttggt

SEQ ID NO: 27133 - DNA, 15 bp, Homo sapiens
atagtcttagtttgg

SEQ ID NO: 27134 - DNA, 15 bp, Homo sapiens
tatagtcttagtttg

SEQ ID NO: 27135 - DNA, 15 bp, Homo sapiens
ttatagtcttagttt

SEQ ID NO: 27136 - DNA, 15 bp, Homo sapiens
tttatagtcttagtt

SEQ ID NO: 27137 - DNA, 15 bp, Homo sapiens
ttttatagtcttagt

SEQ ID NO: 27138 - DNA, 15 bp, Homo sapiens
cttttatagtcttag

SEQ ID NO: 27139 - DNA, 15 bp, Homo sapiens
acttttatagtctta

SEQ ID NO: 27140 - DNA, 15 bp, Homo sapiens
cacttttatagtctt

SEQ ID NO: 27141 - DNA, 15 bp, Homo sapiens
acacttttatagtct

SEQ ID NO: 27142 - DNA, 15 bp, Homo sapiens
cacacttttatagtc

SEQ ID NO: 27143 - DNA, 15 bp, Homo sapiens
acacacttttatagt

SEQ ID NO: 27144 - DNA, 15 bp, Homo sapiens
gacacacttttatag

SEQ ID NO: 27145 - DNA, 15 bp, Homo sapiens
agacacacttttata

SEQ ID NO: 27146 - DNA, 15 bp, Homo sapiens
aagacacacttttat

SEQ ID NO: 27147 - DNA, 15 bp, Homo sapiens
aaagacacactttta

SEQ ID NO: 27148 - DNA, 15 bp, Homo sapiens
taaagacacactttt

SEQ ID NO: 27149 - DNA, 15 bp, Homo sapiens
ttaaagacacacttt

SEQ ID NO: 27150 - DNA, 15 bp, Homo sapiens
gttaaagacacactt

SEQ ID NO: 27151 - DNA, 15 bp, Homo sapiens
cgttaaagacacact

SEQ ID NO: 27152 - DNA, 15 bp, Homo sapiens
gcgttaaagacacac

SEQ ID NO: 27153 - DNA, 15 bp, Homo sapiens
agcgttaaagacaca

SEQ ID NO: 27154 - DNA, 15 bp, Homo sapiens
cagcgttaaagacac

SEQ ID NO: 27155 - DNA, 15 bp, Homo sapiens
tcagcgttaaagaca

SEQ ID NO: 27156 - DNA, 15 bp, Homo sapiens
gtcagcgttaaagac

SEQ ID NO: 27157 - DNA, 15 bp, Homo sapiens
tgtcagcgttaaaga

SEQ ID NO: 27158 - DNA, 15 bp, Homo sapiens
ctgtcagcgttaaag

SEQ ID NO: 27159 - DNA, 15 bp, Homo sapiens
actgtcagcgttaaa

SEQ ID NO: 27160 - DNA, 15 bp, Homo sapiens
cactgtcagcgttaa

SEQ ID NO: 27161 - DNA, 15 bp, Homo sapiens
acactgtcagcgtta

SEQ ID NO: 27162 - DNA, 15 bp, Homo sapiens
cacactgtcagcgtt

SEQ ID NO: 27163 - DNA, 15 bp, Homo sapiens
acacactgtcagcgt

SEQ ID NO: 27164 - DNA, 15 bp, Homo sapiens
aacacactgtcagcg

SEQ ID NO: 27165 - DNA, 15 bp, Homo sapiens
aaacacactgtcagc

SEQ ID NO: 27166 - DNA, 15 bp, Homo sapiens
taaacacactgtcag

SEQ ID NO: 27167 - DNA, 15 bp, Homo sapiens
gtaaacacactgtca

SEQ ID NO: 27168 - DNA, 15 bp, Homo sapiens
tgtaaacacactgtc

SEQ ID NO: 27169 - DNA, 15 bp, Homo sapiens
gtgtaaacacactgt

SEQ ID NO: 27170 - DNA, 15 bp, Homo sapiens
tgtgtaaacacactg

SEQ ID NO: 27171 - DNA, 15 bp, Homo sapiens
ctgtgtaaacacact

SEQ ID NO: 27172 - DNA, 15 bp, Homo sapiens
tctgtgtaaacacac

SEQ ID NO: 27173 - DNA, 15 bp, Homo sapiens
ctctgtgtaaacaca

SEQ ID NO: 27174 - DNA, 15 bp, Homo sapiens
tctctgtgtaaacac

SEQ ID NO: 27175 - DNA, 15 bp, Homo sapiens
gtctctgtgtaaaca

SEQ ID NO: 27176 - DNA, 15 bp, Homo sapiens
ggtctctgtgtaaac

SEQ ID NO: 27177 - DNA, 15 bp, Homo sapiens
tggtctctgtgtaaa

SEQ ID NO: 27178 - DNA, 15 bp, Homo sapiens
atggtctctgtgtaa

SEQ ID NO: 27179 - DNA, 15 bp, Homo sapiens
catggtctctgtgta

SEQ ID NO: 27180 - DNA, 15 bp, Homo sapiens
gcatggtctctgtgt

SEQ ID NO: 27181 - DNA, 15 bp, Homo sapiens
agcatggtctctgtg

SEQ ID NO: 27182 - DNA, 15 bp, Homo sapiens
tagcatggtctctgt

SEQ ID NO: 27183 - DNA, 15 bp, Homo sapiens
ttagcatggtctctg

SEQ ID NO: 27184 - DNA, 15 bp, Homo sapiens
gttagcatggtctct

SEQ ID NO: 27185 - DNA, 15 bp, Homo sapiens
tgttagcatggtctc

SEQ ID NO: 27186 - DNA, 15 bp, Homo sapiens
atgttagcatggtct

SEQ ID NO: 27187 - DNA, 15 bp, Homo sapiens
tatgttagcatggtc

SEQ ID NO: 27188 - DNA, 15 bp, Homo sapiens
ttatgttagcatggt

SEQ ID NO: 27189 - DNA, 15 bp, Homo sapiens
gttatgttagcatgg

SEQ ID NO: 27190 - DNA, 15 bp, Homo sapiens
tgttatgttagcatg

SEQ ID NO: 27191 - DNA, 15 bp, Homo sapiens
ctgttatgttagcat

SEQ ID NO: 27192 - DNA, 15 bp, Homo sapiens
tctgttatgttagca

SEQ ID NO: 27193 - DNA, 15 bp, Homo sapiens
ttctgttatgttagc

SEQ ID NO: 27194 - DNA, 15 bp, Homo sapiens
attctgttatgttag

SEQ ID NO: 27195 - DNA, 15 bp, Homo sapiens
aattctgttatgtta

SEQ ID NO: 27196 - DNA, 15 bp, Homo sapiens
gaattctgttatgtt

SEQ ID NO: 27197 - DNA, 15 bp, Homo sapiens
agaattctgttatgt

SEQ ID NO: 27198 - DNA, 15 bp, Homo sapiens
gagaattctgttatg

SEQ ID NO: 27199 - DNA, 15 bp, Homo sapiens
tgagaattctgttat

SEQ ID NO: 27200 - DNA, 15 bp, Homo sapiens
gtgagaattctgtta

SEQ ID NO: 27201 - DNA, 15 bp, Homo sapiens
ggtgagaattctgtt

SEQ ID NO: 27202 - DNA, 15 bp, Homo sapiens
tggtgagaattctgt

SEQ ID NO: 27203 - DNA, 15 bp, Homo sapiens
atggtgagaattctg

SEQ ID NO: 27204 - DNA, 15 bp, Homo sapiens
aatggtgagaattct

SEQ ID NO: 27205 - DNA, 15 bp, Homo sapiens
aaatggtgagaattc

SEQ ID NO: 27206 - DNA, 15 bp, Homo sapiens
gaaatggtgagaatt

SEQ ID NO: 27207 - DNA, 15 bp, Homo sapiens
agaaatggtgagaat

SEQ ID NO: 27208 - DNA, 15 bp, Homo sapiens
tagaaatggtgagaa

SEQ ID NO: 27209 - DNA, 15 bp, Homo sapiens
atagaaatggtgaga

SEQ ID NO: 27210 - DNA, 15 bp, Homo sapiens
catagaaatggtgag

SEQ ID NO: 27211 - DNA, 15 bp, Homo sapiens
gcatagaaatggtga

SEQ ID NO: 27212 - DNA, 15 bp, Homo sapiens
tgcatagaaatggtg

SEQ ID NO: 27213 - DNA, 15 bp, Homo sapiens
ctgcatagaaatggt

SEQ ID NO: 27214 - DNA, 15 bp, Homo sapiens
actgcatagaaatgg

SEQ ID NO: 27215 - DNA, 15 bp, Homo sapiens
tactgcatagaaatg

SEQ ID NO: 27216 - DNA, 15 bp, Homo sapiens
atactgcatagaaat

SEQ ID NO: 27217 - DNA, 15 bp, Homo sapiens
aatactgcatagaaa

SEQ ID NO: 27218 - DNA, 15 bp, Homo sapiens
taatactgcatagaa

SEQ ID NO: 27219 - DNA, 15 bp, Homo sapiens
ataatactgcataga

SEQ ID NO: 27220 - DNA, 15 bp, Homo sapiens
tataatactgcatag

SEQ ID NO: 27221 - DNA, 15 bp, Homo sapiens
gtataatactgcata

SEQ ID NO: 27222 - DNA, 15 bp, Homo sapiens
agtataatactgcat

SEQ ID NO: 27223 - DNA, 15 bp, Homo sapiens
cagtataatactgca

SEQ ID NO: 27224 - DNA, 15 bp, Homo sapiens
ccagtataatactgc

SEQ ID NO: 27225 - DNA, 15 bp, Homo sapiens
gccagtataatactg

SEQ ID NO: 27226 - DNA, 15 bp, Homo sapiens
tgccagtataatact

SEQ ID NO: 27227 - DNA, 15 bp, Homo sapiens
atgccagtataatac

SEQ ID NO: 27228 - DNA, 15 bp, Homo sapiens
aatgccagtataata

SEQ ID NO: 27229 - DNA, 15 bp, Homo sapiens
gaatgccagtataat

SEQ ID NO: 27230 - DNA, 15 bp, Homo sapiens
ggaatgccagtataa

SEQ ID NO: 27231 - DNA, 15 bp, Homo sapiens
aggaatgccagtata

SEQ ID NO: 27232 - DNA, 15 bp, Homo sapiens
caggaatgccagtat

SEQ ID NO: 27233 - DNA, 15 bp, Homo sapiens
ccaggaatgccagta

SEQ ID NO: 27234 - DNA, 15 bp, Homo sapiens
accaggaatgccagt

SEQ ID NO: 27235 - DNA, 15 bp, Homo sapiens
gaccaggaatgccag

SEQ ID NO: 27236 - DNA, 15 bp, Homo sapiens
agaccaggaatgcca

SEQ ID NO: 27237 - DNA, 15 bp, Homo sapiens
cagaccaggaatgcc

SEQ ID NO: 27238 - DNA, 15 bp, Homo sapiens
acagaccaggaatgc

SEQ ID NO: 27239 - DNA, 15 bp, Homo sapiens
cacagaccaggaatg

SEQ ID NO: 27240 - DNA, 15 bp, Homo sapiens
acacagaccaggaat

SEQ ID NO: 27241 - DNA, 15 bp, Homo sapiens
tacacagaccaggaa

SEQ ID NO: 27242 - DNA, 15 bp, Homo sapiens
ttacacagaccagga

SEQ ID NO: 27243 - DNA, 15 bp, Homo sapiens
attacacagaccagg

SEQ ID NO: 27244 - DNA, 15 bp, Homo sapiens
tattacacagaccag

SEQ ID NO: 27245 - DNA, 15 bp, Homo sapiens
ctattacacagacca

SEQ ID NO: 27246 - DNA, 15 bp, Homo sapiens
cctattacacagacc

SEQ ID NO: 27247 - DNA, 15 bp, Homo sapiens
gcctattacacagac

SEQ ID NO: 27248 - DNA, 15 bp, Homo sapiens
tgcctattacacaga

SEQ ID NO: 27249 - DNA, 15 bp, Homo sapiens
ttgcctattacacag

SEQ ID NO: 27250 - DNA, 15 bp, Homo sapiens
cttgcctattacaca

SEQ ID NO: 27251 - DNA, 15 bp, Homo sapiens
tcttgcctattacac

SEQ ID NO: 27252 - DNA, 15 bp, Homo sapiens
ttcttgcctattaca

SEQ ID NO: 27253 - DNA, 15 bp, Homo sapiens
tttcttgcctattac

SEQ ID NO: 27254 - DNA, 15 bp, Homo sapiens
ttttcttgcctatta

SEQ ID NO: 27255 - DNA, 15 bp, Homo sapiens
cttttcttgcctatt

SEQ ID NO: 27256 - DNA, 15 bp, Homo sapiens
acttttcttgcctat

SEQ ID NO: 27257 - DNA, 15 bp, Homo sapiens
tacttttcttgccta

SEQ ID NO: 27258 - DNA, 15 bp, Homo sapiens
gtacttttcttgcct

SEQ ID NO: 27259 - DNA, 15 bp, Homo sapiens
tgtacttttcttgcc

SEQ ID NO: 27260 - DNA, 15 bp, Homo sapiens
ttgtacttttcttgc

SEQ ID NO: 27261 - DNA, 15 bp, Homo sapiens
tttgtacttttcttg

SEQ ID NO: 27262 - DNA, 15 bp, Homo sapiens
ttttgtacttttctt

SEQ ID NO: 27263 - DNA, 15 bp, Homo sapiens
tttttgtacttttct

SEQ ID NO: 27264 - DNA, 15 bp, Homo sapiens
gtttttgtacttttc

SEQ ID NO: 27265 - DNA, 15 bp, Homo sapiens
agtttttgtactttt

SEQ ID NO: 27266 - DNA, 15 bp, Homo sapiens
cagtttttgtacttt

SEQ ID NO: 27267 - DNA, 15 bp, Homo sapiens
ccagtttttgtactt

SEQ ID NO: 27268 - DNA, 15 bp, Homo sapiens
tccagtttttgtact

SEQ ID NO: 27269 - DNA, 15 bp, Homo sapiens
ttccagtttttgtac

SEQ ID NO: 27270 - DNA, 15 bp, Homo sapiens
cttccagtttttgta

SEQ ID NO: 27271 - DNA, 15 bp, Homo sapiens
tcttccagtttttgt

SEQ ID NO: 27272 - DNA, 15 bp, Homo sapiens
ctcttccagtttttg

SEQ ID NO: 27273 - DNA, 15 bp, Homo sapiens
tctcttccagttttt

SEQ ID NO: 27274 - DNA, 15 bp, Homo sapiens
ttctcttccagtttt

SEQ ID NO: 27275 - DNA, 15 bp, Homo sapiens
cttctcttccagttt

SEQ ID NO: 27276 - DNA, 15 bp, Homo sapiens
ccttctcttccagtt

SEQ ID NO: 27277 - DNA, 15 bp, Homo sapiens
cccttctcttccagt

SEQ ID NO: 27278 - DNA, 15 bp, Homo sapiens
ccccttctcttccag

SEQ ID NO: 27279 - DNA, 15 bp, Homo sapiens
accccttctcttcca

SEQ ID NO: 27280 - DNA, 15 bp, Homo sapiens
taccccttctcttcc

SEQ ID NO: 27281 - DNA, 15 bp, Homo sapiens
ataccccttctcttc

SEQ ID NO: 27282 - DNA, 15 bp, Homo sapiens
gataccccttctctt

SEQ ID NO: 27283 - DNA, 15 bp, Homo sapiens
agataccccttctct

SEQ ID NO: 27284 - DNA, 15 bp, Homo sapiens
aagataccccttctc

SEQ ID NO: 27285 - DNA, 15 bp, Homo sapiens
aaagataccccttct

SEQ ID NO: 27286 - DNA, 15 bp, Homo sapiens
taaagataccccttc

SEQ ID NO: 27287 - DNA, 15 bp, Homo sapiens
ctaaagatacccctt

SEQ ID NO: 27288 - DNA, 15 bp, Homo sapiens
actaaagatacccct

SEQ ID NO: 27289 - DNA, 15 bp, Homo sapiens
aactaaagatacccc

SEQ ID NO: 27290 - DNA, 15 bp, Homo sapiens
caactaaagataccc

SEQ ID NO: 27291 - DNA, 15 bp, Homo sapiens
acaactaaagatacc

SEQ ID NO: 27292 - DNA, 15 bp, Homo sapiens
tacaactaaagatac

SEQ ID NO: 27293 - DNA, 15 bp, Homo sapiens
ctacaactaaagata

SEQ ID NO: 27294 - DNA, 15 bp, Homo sapiens
cctacaactaaagat

SEQ ID NO: 27295 - DNA, 15 bp, Homo sapiens
acctacaactaaaga

SEQ ID NO: 27296 - DNA, 15 bp, Homo sapiens
tacctacaactaaag

SEQ ID NO: 27297 - DNA, 15 bp, Homo sapiens
ttacctacaactaaa

SEQ ID NO: 27298 - DNA, 15 bp, Homo sapiens
gttacctacaactaa

SEQ ID NO: 27299 - DNA, 15 bp, Homo sapiens
cgttacctacaacta

SEQ ID NO: 27300 - DNA, 15 bp, Homo sapiens
tcgttacctacaact

SEQ ID NO: 27301 - DNA, 15 bp, Homo sapiens
atcgttacctacaac

SEQ ID NO: 27302 - DNA, 15 bp, Homo sapiens
tatcgttacctacaa

SEQ ID NO: 27303 - DNA, 15 bp, Homo sapiens
atatcgttacctaca

SEQ ID NO: 27304 - DNA, 15 bp, Homo sapiens
tatatcgttacctac

SEQ ID NO: 27305 - DNA, 15 bp, Homo sapiens
ttatatcgttaccta

SEQ ID NO: 27306 - DNA, 15 bp, Homo sapiens
tttatatcgttacct

SEQ ID NO: 27307 - DNA, 15 bp, Homo sapiens
ctttatatcgttacc

SEQ ID NO: 27308 - DNA, 15 bp, Homo sapiens
gctttatatcgttac

SEQ ID NO: 27309 - DNA, 15 bp, Homo sapiens
ggctttatatcgtta

SEQ ID NO: 27310 - DNA, 15 bp, Homo sapiens
tggctttatatcgtt

SEQ ID NO: 27311 - DNA, 15 bp, Homo sapiens
ttggctttatatcgt

SEQ ID NO: 27312 - DNA, 15 bp, Homo sapiens
tttggctttatatcg

SEQ ID NO: 27313 - DNA, 15 bp, Homo sapiens
ctttggctttatatc

SEQ ID NO: 27314 - DNA, 15 bp, Homo sapiens
cctttggctttatat

SEQ ID NO: 27315 - DNA, 15 bp, Homo sapiens
acctttggctttata

SEQ ID NO: 27316 - DNA, 15 bp, Homo sapiens
aacctttggctttat

SEQ ID NO: 27317 - DNA, 15 bp, Homo sapiens
aaacctttggcttta

SEQ ID NO: 27318 - DNA, 15 bp, Homo sapiens
taaacctttggcttt

SEQ ID NO: 27319 - DNA, 15 bp, Homo sapiens
ataaacctttggctt

SEQ ID NO: 27320 - DNA, 15 bp, Homo sapiens
aataaacctttggct

SEQ ID NO: 27321 - DNA, 15 bp, Homo sapiens
gaataaacctttggc

SEQ ID NO: 27322 - DNA, 15 bp, Homo sapiens
agaataaacctttgg

SEQ ID NO: 27323 - DNA, 15 bp, Homo sapiens
gagaataaacctttg

SEQ ID NO: 27324 - DNA, 15 bp, Homo sapiens
tgagaataaaccttt

SEQ ID NO: 27325 - DNA, 15 bp, Homo sapiens
ctgagaataaacctt

SEQ ID NO: 27326 - DNA, 15 bp, Homo sapiens
actgagaataaacct

SEQ ID NO: 27327 - DNA, 15 bp, Homo sapiens
gactgagaataaacc

SEQ ID NO: 27328 - DNA, 15 bp, Homo sapiens
agactgagaataaac

SEQ ID NO: 27329 - DNA, 15 bp, Homo sapiens
aagactgagaataaa

SEQ ID NO: 27330 - DNA, 15 bp, Homo sapiens
gaagactgagaataa

SEQ ID NO: 27331 - DNA, 15 bp, Homo sapiens
cgaagactgagaata

SEQ ID NO: 27332 - DNA, 15 bp, Homo sapiens
acgaagactgagaat

SEQ ID NO: 27333 - DNA, 15 bp, Homo sapiens
gacgaagactgagaa

SEQ ID NO: 27334 - DNA, 15 bp, Homo sapiens
agacgaagactgaga

SEQ ID NO: 27335 - DNA, 15 bp, Homo sapiens
aagacgaagactgag

SEQ ID NO: 27336 - DNA, 15 bp, Homo sapiens
gaagacgaagactga

SEQ ID NO: 27337 - DNA, 15 bp, Homo sapiens
ggaagacgaagactg

SEQ ID NO: 27338 - DNA, 15 bp, Homo sapiens
aggaagacgaagact

SEQ ID NO: 27339 - DNA, 15 bp, Homo sapiens
taggaagacgaagac

SEQ ID NO: 27340 - DNA, 15 bp, Homo sapiens
ataggaagacgaaga

SEQ ID NO: 27341 - DNA, 15 bp, Homo sapiens
aataggaagacgaag

SEQ ID NO: 27342 - DNA, 15 bp, Homo sapiens
aaataggaagacgaa

SEQ ID NO: 27343 - DNA, 15 bp, Homo sapiens
aaaataggaagacga

SEQ ID NO: 27344 - DNA, 15 bp, Homo sapiens
caaaataggaagacg

SEQ ID NO: 27345 - DNA, 15 bp, Homo sapiens
acaaaataggaagac

SEQ ID NO: 27346 - DNA, 15 bp, Homo sapiens
aacaaaataggaaga

SEQ ID NO: 27347 - DNA, 15 bp, Homo sapiens
caacaaaataggaag

SEQ ID NO: 27348 - DNA, 15 bp, Homo sapiens
ccaacaaaataggaa

SEQ ID NO: 27349 - DNA, 15 bp, Homo sapiens
accaacaaaatagga

SEQ ID NO: 27350 - DNA, 15 bp, Homo sapiens
caccaacaaaatagg

SEQ ID NO: 27351 - DNA, 15 bp, Homo sapiens
gcaccaacaaaatag

SEQ ID NO: 27352 - DNA, 15 bp, Homo sapiens
agcaccaacaaaata

SEQ ID NO: 27353 - DNA, 15 bp, Homo sapiens
cagcaccaacaaaat

SEQ ID NO: 27354 - DNA, 15 bp, Homo sapiens
acagcaccaacaaaa

SEQ ID NO: 27355 - DNA, 15 bp, Homo sapiens
gacagcaccaacaaa

SEQ ID NO: 27356 - DNA, 15 bp, Homo sapiens
tgacagcaccaacaa

SEQ ID NO: 27357 - DNA, 15 bp, Homo sapiens
gtgacagcaccaaca

SEQ ID NO: 27358 - DNA, 15 bp, Homo sapiens
agtgacagcaccaac

SEQ ID NO: 27359 - DNA, 15 bp, Homo sapiens
gagtgacagcaccaa

SEQ ID NO: 27360 - DNA, 15 bp, Homo sapiens
cgagtgacagcacca

SEQ ID NO: 27361 - DNA, 15 bp, Homo sapiens
gcgagtgacagcacc

SEQ ID NO: 27362 - DNA, 15 bp, Homo sapiens
agcgagtgacagcac

SEQ ID NO: 27363 - DNA, 15 bp, Homo sapiens
gagcgagtgacagca

SEQ ID NO: 27364 - DNA, 15 bp, Homo sapiens
ggagcgagtgacagc

SEQ ID NO: 27365 - DNA, 15 bp, Homo sapiens
gggagcgagtgacag

SEQ ID NO: 27366 - DNA, 15 bp, Homo sapiens
agggagcgagtgaca

SEQ ID NO: 27367 - DNA, 15 bp, Homo sapiens
gagggagcgagtgac

SEQ ID NO: 27368 - DNA, 15 bp, Homo sapiens
agagggagcgagtga

SEQ ID NO: 27369 - DNA, 15 bp, Homo sapiens
aagagggagcgagtg

SEQ ID NO: 27370 - DNA, 15 bp, Homo sapiens
aaagagggagcgagt

SEQ ID NO: 27371 - DNA, 15 bp, Homo sapiens
caaagagggagcgag

SEQ ID NO: 27372 - DNA, 15 bp, Homo sapiens
tcaaagagggagcga

SEQ ID NO: 27373 - DNA, 15 bp, Homo sapiens
ttcaaagagggagcg

SEQ ID NO: 27374 - DNA, 15 bp, Homo sapiens
cttcaaagagggagc

SEQ ID NO: 27375 - DNA, 15 bp, Homo sapiens
gcttcaaagagggag

SEQ ID NO: 27376 - DNA, 15 bp, Homo sapiens
tgcttcaaagaggga

SEQ ID NO: 27377 - DNA, 15 bp, Homo sapiens
gtgcttcaaagaggg

SEQ ID NO: 27378 - DNA, 15 bp, Homo sapiens
ggtgcttcaaagagg

SEQ ID NO: 27379 - DNA, 15 bp, Homo sapiens
aggtgcttcaaagag

SEQ ID NO: 27380 - DNA, 15 bp, Homo sapiens
gaggtgcttcaaaga

SEQ ID NO: 27381 - DNA, 15 bp, Homo sapiens
agaggtgcttcaaag

SEQ ID NO: 27382 - DNA, 15 bp, Homo sapiens
aagaggtgcttcaaa

SEQ ID NO: 27383 - DNA, 15 bp, Homo sapiens
gaagaggtgcttcaa

SEQ ID NO: 27384 - DNA, 15 bp, Homo sapiens
tgaagaggtgcttca

SEQ ID NO: 27385 - DNA, 15 bp, Homo sapiens
gtgaagaggtgcttc

SEQ ID NO: 27386 - DNA, 15 bp, Homo sapiens
agtgaagaggtgctt

SEQ ID NO: 27387 - DNA, 15 bp, Homo sapiens
aagtgaagaggtgct

SEQ ID NO: 27388 - DNA, 15 bp, Homo sapiens
caagtgaagaggtgc

SEQ ID NO: 27389 - DNA, 15 bp, Homo sapiens
ccaagtgaagaggtg

SEQ ID NO: 27390 - DNA, 15 bp, Homo sapiens
gccaagtgaagaggt

SEQ ID NO: 27391 - DNA, 15 bp, Homo sapiens
agccaagtgaagagg

SEQ ID NO: 27392 - DNA, 15 bp, Homo sapiens
aagccaagtgaagag

SEQ ID NO: 27393 - DNA, 15 bp, Homo sapiens
gaagccaagtgaaga

SEQ ID NO: 27394 - DNA, 15 bp, Homo sapiens
ggaagccaagtgaag

SEQ ID NO: 27395 - DNA, 15 bp, Homo sapiens
tggaagccaagtgaa

SEQ ID NO: 27396 - DNA, 15 bp, Homo sapiens
gtggaagccaagtga

SEQ ID NO: 27397 - DNA, 15 bp, Homo sapiens
cgtggaagccaagtg

SEQ ID NO: 27398 - DNA, 15 bp, Homo sapiens
tcgtggaagccaagt

SEQ ID NO: 27399 - DNA, 15 bp, Homo sapiens
atcgtggaagccaag

SEQ ID NO: 27400 - DNA, 15 bp, Homo sapiens
gatcgtggaagccaa

SEQ ID NO: 27401 - DNA, 15 bp, Homo sapiens
ggatcgtggaagcca

SEQ ID NO: 27402 - DNA, 15 bp, Homo sapiens
gggatcgtggaagcc

SEQ ID NO: 27403 - DNA, 15 bp, Homo sapiens
tgggatcgtggaagc

SEQ ID NO: 27404 - DNA, 15 bp, Homo sapiens
atgggatcgtggaag

SEQ ID NO: 27405 - DNA, 15 bp, Homo sapiens
tatgggatcgtggaa

SEQ ID NO: 27406 - DNA, 15 bp, Homo sapiens
gtatgggatcgtgga

SEQ ID NO: 27407 - DNA, 15 bp, Homo sapiens
agtatgggatcgtgg

SEQ ID NO: 27408 - DNA, 15 bp, Homo sapiens
aagtatgggatcgtg

SEQ ID NO: 27409 - DNA, 15 bp, Homo sapiens
caagtatgggatcgt

SEQ ID NO: 27410 - DNA, 15 bp, Homo sapiens
gcaagtatgggatcg

SEQ ID NO: 27411 - DNA, 15 bp, Homo sapiens
agcaagtatgggatc

SEQ ID NO: 27412 - DNA, 15 bp, Homo sapiens
gagcaagtatgggat

SEQ ID NO: 27413 - DNA, 15 bp, Homo sapiens
agagcaagtatggga

SEQ ID NO: 27414 - DNA, 15 bp, Homo sapiens
gagagcaagtatggg

SEQ ID NO: 27415 - DNA, 15 bp, Homo sapiens
ggagagcaagtatgg

SEQ ID NO: 27416 - DNA, 15 bp, Homo sapiens
gggagagcaagtatg

SEQ ID NO: 27417 - DNA, 15 bp, Homo sapiens
agggagagcaagtat

SEQ ID NO: 27418 - DNA, 15 bp, Homo sapiens
gagggagagcaagta

SEQ ID NO: 27419 - DNA, 15 bp, Homo sapiens
ggagggagagcaagt

SEQ ID NO: 27420 - DNA, 15 bp, Homo sapiens
gggagggagagcaag

SEQ ID NO: 27421 - DNA, 15 bp, Homo sapiens
agggagggagagcaa

SEQ ID NO: 27422 - DNA, 15 bp, Homo sapiens
cagggagggagagca

SEQ ID NO: 27423 - DNA, 15 bp, Homo sapiens
ccagggagggagagc

SEQ ID NO: 27424 - DNA, 15 bp, Homo sapiens
gccagggagggagag

SEQ ID NO: 27425 - DNA, 15 bp, Homo sapiens
ggccagggagggaga

SEQ ID NO: 27426 - DNA, 15 bp, Homo sapiens
aggccagggagggag

SEQ ID NO: 27427 - DNA, 15 bp, Homo sapiens
gaggccagggaggga

SEQ ID NO: 27428 - DNA, 15 bp, Homo sapiens
agaggccagggaggg

SEQ ID NO: 27429 - DNA, 15 bp, Homo sapiens
gagaggccagggagg

SEQ ID NO: 27430 - DNA, 15 bp, Homo sapiens
tgagaggccagggag

SEQ ID NO: 27431 - DNA, 15 bp, Homo sapiens
atgagaggccaggga

SEQ ID NO: 27432 - DNA, 15 bp, Homo sapiens
aatgagaggccaggg

SEQ ID NO: 27433 - DNA, 15 bp, Homo sapiens
gaatgagaggccagg

SEQ ID NO: 27434 - DNA, 15 bp, Homo sapiens
cgaatgagaggccag

SEQ ID NO: 27435 - DNA, 15 bp, Homo sapiens
tcgaatgagaggcca

SEQ ID NO: 27436 - DNA, 15 bp, Homo sapiens
ctcgaatgagaggcc

SEQ ID NO: 27437 - DNA, 15 bp, Homo sapiens
cctcgaatgagaggc

SEQ ID NO: 27438 - DNA, 15 bp, Homo sapiens
acctcgaatgagagg

SEQ ID NO: 27439 - DNA, 15 bp, Homo sapiens
gacctcgaatgagag

SEQ ID NO: 27440 - DNA, 15 bp, Homo sapiens
agacctcgaatgaga

SEQ ID NO: 27441 - DNA, 15 bp, Homo sapiens
aagacctcgaatgag

SEQ ID NO: 27442 - DNA, 15 bp, Homo sapiens
aaagacctcgaatga

SEQ ID NO: 27443 - DNA, 15 bp, Homo sapiens
caaagacctcgaatg

SEQ ID NO: 27444 - DNA, 15 bp, Homo sapiens
acaaagacctcgaat

SEQ ID NO: 27445 - DNA, 15 bp, Homo sapiens
tacaaagacctcgaa

SEQ ID NO: 27446 - DNA, 15 bp, Homo sapiens
ctacaaagacctcga

SEQ ID NO: 27447 - DNA, 15 bp, Homo sapiens
gctacaaagacctcg

SEQ ID NO: 27448 - DNA, 15 bp, Homo sapiens
agctacaaagacctc

SEQ ID NO: 27449 - DNA, 15 bp, Homo sapiens
cagctacaaagacct

SEQ ID NO: 27450 - DNA, 15 bp, Homo sapiens
ccagctacaaagacc

SEQ ID NO: 27451 - DNA, 15 bp, Homo sapiens
cccagctacaaagac

SEQ ID NO: 27452 - DNA, 15 bp, Homo sapiens
acccagctacaaaga

SEQ ID NO: 27453 - DNA, 15 bp, Homo sapiens
gacccagctacaaag

SEQ ID NO: 27454 - DNA, 15 bp, Homo sapiens
agacccagctacaaa

SEQ ID NO: 27455 - DNA, 15 bp, Homo sapiens
aagacccagctacaa

SEQ ID NO: 27456 - DNA, 15 bp, Homo sapiens
aaagacccagctaca

SEQ ID NO: 27457 - DNA, 15 bp, Homo sapiens
gaaagacccagctac

SEQ ID NO: 27458 - DNA, 15 bp, Homo sapiens
tgaaagacccagcta

SEQ ID NO: 27459 - DNA, 15 bp, Homo sapiens
gtgaaagacccagct

SEQ ID NO: 27460 - DNA, 15 bp, Homo sapiens
tgtgaaagacccagc

SEQ ID NO: 27461 - DNA, 15 bp, Homo sapiens
ttgtgaaagacccag

SEQ ID NO: 27462 - DNA, 15 bp, Homo sapiens
cttgtgaaagaccca

SEQ ID NO: 27463 - DNA, 15 bp, Homo sapiens
ccttgtgaaagaccc

SEQ ID NO: 27464 - DNA, 15 bp, Homo sapiens
gccttgtgaaagacc

SEQ ID NO: 27465 - DNA, 15 bp, Homo sapiens
tgccttgtgaaagac

SEQ ID NO: 27466 - DNA, 15 bp, Homo sapiens
gtgccttgtgaaaga

SEQ ID NO: 27467 - DNA, 15 bp, Homo sapiens
ggtgccttgtgaaag

SEQ ID NO: 27468 - DNA, 15 bp, Homo sapiens
tggtgccttgtgaaa

SEQ ID NO: 27469 - DNA, 15 bp, Homo sapiens
ctggtgccttgtgaa

SEQ ID NO: 27470 - DNA, 15 bp, Homo sapiens
cctggtgccttgtga

SEQ ID NO: 27471 - DNA, 15 bp, Homo sapiens
tcctggtgccttgtg

SEQ ID NO: 27472 - DNA, 15 bp, Homo sapiens
ctcctggtgccttgt

SEQ ID NO: 27473 - DNA, 15 bp, Homo sapiens
cctcctggtgccttg

SEQ ID NO: 27474 - DNA, 15 bp, Homo sapiens
acctcctggtgcctt

SEQ ID NO: 27475 - DNA, 15 bp, Homo sapiens
cacctcctggtgcct

SEQ ID NO: 27476 - DNA, 15 bp, Homo sapiens
tcacctcctggtgcc

SEQ ID NO: 27477 - DNA, 15 bp, Homo sapiens
ttcacctcctggtgc

SEQ ID NO: 27478 - DNA, 15 bp, Homo sapiens
cttcacctcctggtg

SEQ ID NO: 27479 - DNA, 15 bp, Homo sapiens
ccttcacctcctggt

SEQ ID NO: 27480 - DNA, 15 bp, Homo sapiens
gccttcacctcctgg

SEQ ID NO: 27481 - DNA, 15 bp, Homo sapiens
agccttcacctcctg

SEQ ID NO: 27482 - DNA, 15 bp, Homo sapiens
gagccttcacctcct

SEQ ID NO: 27483 - DNA, 15 bp, Homo sapiens
ggagccttcacctcc

SEQ ID NO: 27484 - DNA, 15 bp, Homo sapiens
tggagccttcacctc

SEQ ID NO: 27485 - DNA, 15 bp, Homo sapiens
atggagccttcacct

SEQ ID NO: 27486 - DNA, 15 bp, Homo sapiens
tatggagccttcacc

SEQ ID NO: 27487 - DNA, 15 bp, Homo sapiens
ctatggagccttcac

SEQ ID NO: 27488 - DNA, 15 bp, Homo sapiens
actatggagccttca

SEQ ID NO: 27489 - DNA, 15 bp, Homo sapiens
gactatggagccttc

SEQ ID NO: 27490 - DNA, 15 bp, Homo sapiens
ggactatggagcctt

SEQ ID NO: 27491 - DNA, 15 bp, Homo sapiens
aggactatggagcct

SEQ ID NO: 27492 - DNA, 15 bp, Homo sapiens
gaggactatggagcc

SEQ ID NO: 27493 - DNA, 15 bp, Homo sapiens
tgaggactatggagc

SEQ ID NO: 27494 - DNA, 15 bp, Homo sapiens
ctgaggactatggag

SEQ ID NO: 27495 - DNA, 15 bp, Homo sapiens
gctgaggactatgga

SEQ ID NO: 27496 - DNA, 15 bp, Homo sapiens
ggctgaggactatgg

SEQ ID NO: 27497 - DNA, 15 bp, Homo sapiens
tggctgaggactatg

SEQ ID NO: 27498 - DNA, 15 bp, Homo sapiens
atggctgaggactat

SEQ ID NO: 27499 - DNA, 15 bp, Homo sapiens
aatggctgaggacta

SEQ ID NO: 27500 - DNA, 15 bp, Homo sapiens
aaatggctgaggact

SEQ ID NO: 27501 - DNA, 15 bp, Homo sapiens
gaaatggctgaggac

SEQ ID NO: 27502 - DNA, 15 bp, Homo sapiens
agaaatggctgagga

SEQ ID NO: 27503 - DNA, 15 bp, Homo sapiens
cagaaatggctgagg

SEQ ID NO: 27504 - DNA, 15 bp, Homo sapiens
acagaaatggctgag

SEQ ID NO: 27505 - DNA, 15 bp, Homo sapiens
gacagaaatggctga

SEQ ID NO: 27506 - DNA, 15 bp, Homo sapiens
agacagaaatggctg

SEQ ID NO: 27507 - DNA, 15 bp, Homo sapiens
tagacagaaatggct

SEQ ID NO: 27508 - DNA, 15 bp, Homo sapiens
atagacagaaatggc

SEQ ID NO: 27509 - DNA, 15 bp, Homo sapiens
tatagacagaaatgg

SEQ ID NO: 27510 - DNA, 15 bp, Homo sapiens
ctatagacagaaatg

SEQ ID NO: 27511 - DNA, 15 bp, Homo sapiens
actatagacagaaat

SEQ ID NO: 27512 - DNA, 15 bp, Homo sapiens
aactatagacagaaa

SEQ ID NO: 27513 - DNA, 15 bp, Homo sapiens
taactatagacagaa

SEQ ID NO: 27514 - DNA, 15 bp, Homo sapiens
gtaactatagacaga

SEQ ID NO: 27515 - DNA, 15 bp, Homo sapiens
agtaactatagacag

SEQ ID NO: 27516 - DNA, 15 bp, Homo sapiens
gagtaactatagaca

SEQ ID NO: 27517 - DNA, 15 bp, Homo sapiens
ggagtaactatagac

SEQ ID NO: 27518 - DNA, 15 bp, Homo sapiens
gggagtaactataga

SEQ ID NO: 27519 - DNA, 15 bp, Homo sapiens
tgggagtaactatag

SEQ ID NO: 27520 - DNA, 15 bp, Homo sapiens
atgggagtaactata

SEQ ID NO: 27521 - DNA, 15 bp, Homo sapiens
catgggagtaactat

SEQ ID NO: 27522 - DNA, 15 bp, Homo sapiens
tcatgggagtaacta

SEQ ID NO: 27523 - DNA, 15 bp, Homo sapiens
atcatgggagtaact

SEQ ID NO: 27524 - DNA, 15 bp, Homo sapiens
gatcatgggagtaac

SEQ ID NO: 27525 - DNA, 15 bp, Homo sapiens
agatcatgggagtaa

SEQ ID NO: 27526 - DNA, 15 bp, Homo sapiens
gagatcatgggagta

SEQ ID NO: 27527 - DNA, 15 bp, Homo sapiens
agagatcatgggagt

SEQ ID NO: 27528 - DNA, 15 bp, Homo sapiens
aagagatcatgggag

SEQ ID NO: 27529 - DNA, 15 bp, Homo sapiens
gaagagatcatggga

SEQ ID NO: 27530 - DNA, 15 bp, Homo sapiens
agaagagatcatggg

SEQ ID NO: 27531 - DNA, 15 bp, Homo sapiens
cagaagagatcatgg

SEQ ID NO: 27532 - DNA, 15 bp, Homo sapiens
ccagaagagatcatg

SEQ ID NO: 27533 - DNA, 15 bp, Homo sapiens
accagaagagatcat

SEQ ID NO: 27534 - DNA, 15 bp, Homo sapiens
gaccagaagagatca

SEQ ID NO: 27535 - DNA, 15 bp, Homo sapiens
agaccagaagagatc

SEQ ID NO: 27536 - DNA, 15 bp, Homo sapiens
gagaccagaagagat

SEQ ID NO: 27537 - DNA, 15 bp, Homo sapiens
tgagaccagaagaga

SEQ ID NO: 27538 - DNA, 15 bp, Homo sapiens
atgagaccagaagag

SEQ ID NO: 27539 - DNA, 15 bp, Homo sapiens
aatgagaccagaaga

SEQ ID NO: 27540 - DNA, 15 bp, Homo sapiens
taatgagaccagaag

SEQ ID NO: 27541 - DNA, 15 bp, Homo sapiens
gtaatgagaccagaa

SEQ ID NO: 27542 - DNA, 15 bp, Homo sapiens
agtaatgagaccaga

SEQ ID NO: 27543 - DNA, 15 bp, Homo sapiens
tagtaatgagaccag

SEQ ID NO: 27544 - DNA, 15 bp, Homo sapiens
atagtaatgagacca

SEQ ID NO: 27545 - DNA, 15 bp, Homo sapiens
tatagtaatgagacc

SEQ ID NO: 27546 - DNA, 15 bp, Homo sapiens
ttatagtaatgagac

SEQ ID NO: 27547 - DNA, 15 bp, Homo sapiens
attatagtaatgaga

SEQ ID NO: 27548 - DNA, 15 bp, Homo sapiens
gattatagtaatgag

SEQ ID NO: 27549 - DNA, 15 bp, Homo sapiens
tgattatagtaatga

SEQ ID NO: 27550 - DNA, 15 bp, Homo sapiens
ctgattatagtaatg

SEQ ID NO: 27551 - DNA, 15 bp, Homo sapiens
actgattatagtaat

SEQ ID NO: 27552 - DNA, 15 bp, Homo sapiens
tactgattatagtaa

SEQ ID NO: 27553 - DNA, 15 bp, Homo sapiens
ctactgattatagta

SEQ ID NO: 27554 - DNA, 15 bp, Homo sapiens
gctactgattatagt

SEQ ID NO: 27555 - DNA, 15 bp, Homo sapiens
ggctactgattatag

SEQ ID NO: 27556 - DNA, 15 bp, Homo sapiens
tggctactgattata

SEQ ID NO: 27557 - DNA, 15 bp, Homo sapiens
gtggctactgattat

SEQ ID NO: 27558 - DNA, 15 bp, Homo sapiens
agtggctactgatta

SEQ ID NO: 27559 - DNA, 15 bp, Homo sapiens
tagtggctactgatt

SEQ ID NO: 27560 - DNA, 15 bp, Homo sapiens
ctagtggctactgat

SEQ ID NO: 27561 - DNA, 15 bp, Homo sapiens
gctagtggctactga

SEQ ID NO: 27562 - DNA, 15 bp, Homo sapiens
agctagtggctactg

SEQ ID NO: 27563 - DNA, 15 bp, Homo sapiens
tagctagtggctact

SEQ ID NO: 27564 - DNA, 15 bp, Homo sapiens
atagctagtggctac

SEQ ID NO: 27565 - DNA, 15 bp, Homo sapiens
gatagctagtggcta

SEQ ID NO: 27566 - DNA, 15 bp, Homo sapiens
agatagctagtggct

SEQ ID NO: 27567 - DNA, 15 bp, Homo sapiens
tagatagctagtggc

SEQ ID NO: 27568 - DNA, 15 bp, Homo sapiens
ttagatagctagtgg

SEQ ID NO: 27569 - DNA, 15 bp, Homo sapiens
tttagatagctagtg

SEQ ID NO: 27570 - DNA, 15 bp, Homo sapiens
ttttagatagctagt

SEQ ID NO: 27571 - DNA, 15 bp, Homo sapiens
gttttagatagctag

SEQ ID NO: 27572 - DNA, 15 bp, Homo sapiens
agttttagatagcta

SEQ ID NO: 27573 - DNA, 15 bp, Homo sapiens
tagttttagatagct

SEQ ID NO: 27574 - DNA, 15 bp, Homo sapiens
gtagttttagatagc

SEQ ID NO: 27575 - DNA, 15 bp, Homo sapiens
agtagttttagatag

SEQ ID NO: 27576 - DNA, 15 bp, Homo sapiens
aagtagttttagata

SEQ ID NO: 27577 - DNA, 15 bp, Homo sapiens
taagtagttttagat

SEQ ID NO: 27578 - DNA, 15 bp, Homo sapiens
ctaagtagttttaga

SEQ ID NO: 27579 - DNA, 15 bp, Homo sapiens
tctaagtagttttag

SEQ ID NO: 27580 - DNA, 15 bp, Homo sapiens
ttctaagtagtttta

SEQ ID NO: 27581 - DNA, 15 bp, Homo sapiens
attctaagtagtttt

SEQ ID NO: 27582 - DNA, 15 bp, Homo sapiens
tattctaagtagttt

SEQ ID NO: 27583 - DNA, 15 bp, Homo sapiens
gtattctaagtagtt

SEQ ID NO: 27584 - DNA, 15 bp, Homo sapiens
ggtattctaagtagt

SEQ ID NO: 27585 - DNA, 15 bp, Homo sapiens
aggtattctaagtag

SEQ ID NO: 27586 - DNA, 15 bp, Homo sapiens
taggtattctaagta

SEQ ID NO: 27587 - DNA, 15 bp, Homo sapiens
ttaggtattctaagt

SEQ ID NO: 27588 - DNA, 15 bp, Homo sapiens
tttaggtattctaag

SEQ ID NO: 27589 - DNA, 15 bp, Homo sapiens
ttttaggtattctaa

SEQ ID NO: 27590 - DNA, 15 bp, Homo sapiens
tttttaggtattcta

SEQ ID NO: 27591 - DNA, 15 bp, Homo sapiens
gtttttaggtattct

SEQ ID NO: 27592 - DNA, 15 bp, Homo sapiens
tgtttttaggtattc

SEQ ID NO: 27593 - DNA, 15 bp, Homo sapiens
gtgtttttaggtatt

SEQ ID NO: 27594 - DNA, 15 bp, Homo sapiens
agtgtttttaggtat

SEQ ID NO: 27595 - DNA, 15 bp, Homo sapiens
aagtgtttttaggta

SEQ ID NO: 27596 - DNA, 15 bp, Homo sapiens
gaagtgtttttaggt

SEQ ID NO: 27597 - DNA, 15 bp, Homo sapiens
ggaagtgtttttagg

SEQ ID NO: 27598 - DNA, 15 bp, Homo sapiens
aggaagtgtttttag

SEQ ID NO: 27599 - DNA, 15 bp, Homo sapiens
aaggaagtgttttta

SEQ ID NO: 27600 - DNA, 15 bp, Homo sapiens
taaggaagtgttttt

SEQ ID NO: 27601 - DNA, 15 bp, Homo sapiens
ctaaggaagtgtttt

SEQ ID NO: 27602 - DNA, 15 bp, Homo sapiens
tctaaggaagtgttt

SEQ ID NO: 27603 - DNA, 15 bp, Homo sapiens
atctaaggaagtgtt

SEQ ID NO: 27604 - DNA, 15 bp, Homo sapiens
catctaaggaagtgt

SEQ ID NO: 27605 - DNA, 15 bp, Homo sapiens
gcatctaaggaagtg

SEQ ID NO: 27606 - DNA, 15 bp, Homo sapiens
ggcatctaaggaagt

SEQ ID NO: 27607 - DNA, 15 bp, Homo sapiens
gggcatctaaggaag

SEQ ID NO: 27608 - DNA, 15 bp, Homo sapiens
agggcatctaaggaa

SEQ ID NO: 27609 - DNA, 15 bp, Homo sapiens
tagggcatctaagga

SEQ ID NO: 27610 - DNA, 15 bp, Homo sapiens
ctagggcatctaagg

SEQ ID NO: 27611 - DNA, 15 bp, Homo sapiens
gctagggcatctaag

SEQ ID NO: 27612 - DNA, 15 bp, Homo sapiens
ggctagggcatctaa

SEQ ID NO: 27613 - DNA, 15 bp, Homo sapiens
tggctagggcatcta

SEQ ID NO: 27614 - DNA, 15 bp, Homo sapiens
atggctagggcatct

SEQ ID NO: 27615 - DNA, 15 bp, Homo sapiens
tatggctagggcatc

SEQ ID NO: 27616 - DNA, 15 bp, Homo sapiens
atatggctagggcat

SEQ ID NO: 27617 - DNA, 15 bp, Homo sapiens
aatatggctagggca

SEQ ID NO: 27618 - DNA, 15 bp, Homo sapiens
gaatatggctagggc

SEQ ID NO: 27619 - DNA, 15 bp, Homo sapiens
tgaatatggctaggg

SEQ ID NO: 27620 - DNA, 15 bp, Homo sapiens
gtgaatatggctagg

SEQ ID NO: 27621 - DNA, 15 bp, Homo sapiens
agtgaatatggctag

SEQ ID NO: 27622 - DNA, 15 bp, Homo sapiens
aagtgaatatggcta

SEQ ID NO: 27623 - DNA, 15 bp, Homo sapiens
taagtgaatatggct

SEQ ID NO: 27624 - DNA, 15 bp, Homo sapiens
ttaagtgaatatggc

SEQ ID NO: 27625 - DNA, 15 bp, Homo sapiens
tttaagtgaatatgg

SEQ ID NO: 27626 - DNA, 15 bp, Homo sapiens
ctttaagtgaatatg

SEQ ID NO: 27627 - DNA, 15 bp, Homo sapiens
actttaagtgaatat

SEQ ID NO: 27628 - DNA, 15 bp, Homo sapiens
cactttaagtgaata

SEQ ID NO: 27629 - DNA, 15 bp, Homo sapiens
gcactttaagtgaat

SEQ ID NO: 27630 - DNA, 15 bp, Homo sapiens
agcactttaagtgaa

SEQ ID NO: 27631 - DNA, 15 bp, Homo sapiens
aagcactttaagtga

SEQ ID NO: 27632 - DNA, 15 bp, Homo sapiens
taagcactttaagtg

SEQ ID NO: 27633 - DNA, 15 bp, Homo sapiens
ataagcactttaagt

SEQ ID NO: 27634 - DNA, 15 bp, Homo sapiens
gataagcactttaag

SEQ ID NO: 27635 - DNA, 15 bp, Homo sapiens
ggataagcactttaa

SEQ ID NO: 27636 - DNA, 15 bp, Homo sapiens
tggataagcacttta

SEQ ID NO: 27637 - DNA, 15 bp, Homo sapiens
atggataagcacttt

SEQ ID NO: 27638 - DNA, 15 bp, Homo sapiens
gatggataagcactt

SEQ ID NO: 27639 - DNA, 15 bp, Homo sapiens
tgatggataagcact

SEQ ID NO: 27640 - DNA, 15 bp, Homo sapiens
gtgatggataagcac

SEQ ID NO: 27641 - DNA, 15 bp, Homo sapiens
cgtgatggataagca

SEQ ID NO: 27642 - DNA, 15 bp, Homo sapiens
acgtgatggataagc

SEQ ID NO: 27643 - DNA, 15 bp, Homo sapiens
cacgtgatggataag

SEQ ID NO: 27644 - DNA, 15 bp, Homo sapiens
acacgtgatggataa

SEQ ID NO: 27645 - DNA, 15 bp, Homo sapiens
cacacgtgatggata

SEQ ID NO: 27646 - DNA, 15 bp, Homo sapiens
tcacacgtgatggat

SEQ ID NO: 27647 - DNA, 15 bp, Homo sapiens
gtcacacgtgatgga

SEQ ID NO: 27648 - DNA, 15 bp, Homo sapiens
tgtcacacgtgatgg

SEQ ID NO: 27649 - DNA, 15 bp, Homo sapiens
ctgtcacacgtgatg

SEQ ID NO: 27650 - DNA, 15 bp, Homo sapiens
gctgtcacacgtgat

SEQ ID NO: 27651 - DNA, 15 bp, Homo sapiens
ggctgtcacacgtga

SEQ ID NO: 27652 - DNA, 15 bp, Homo sapiens
tggctgtcacacgtg

SEQ ID NO: 27653 - DNA, 15 bp, Homo sapiens
gtggctgtcacacgt

SEQ ID NO: 27654 - DNA, 15 bp, Homo sapiens
tgtggctgtcacacg

SEQ ID NO: 27655 - DNA, 15 bp, Homo sapiens
atgtggctgtcacac

SEQ ID NO: 27656 - DNA, 15 bp, Homo sapiens
catgtggctgtcaca

SEQ ID NO: 27657 - DNA, 15 bp, Homo sapiens
tcatgtggctgtcac

SEQ ID NO: 27658 - DNA, 15 bp, Homo sapiens
ttcatgtggctgtca

SEQ ID NO: 27659 - DNA, 15 bp, Homo sapiens
gttcatgtggctgtc

SEQ ID NO: 27660 - DNA, 15 bp, Homo sapiens
tgttcatgtggctgt

SEQ ID NO: 27661 - DNA, 15 bp, Homo sapiens
ctgttcatgtggctg

SEQ ID NO: 27662 - DNA, 15 bp, Homo sapiens
actgttcatgtggct

SEQ ID NO: 27663 - DNA, 15 bp, Homo sapiens
cactgttcatgtggc

SEQ ID NO: 27664 - DNA, 15 bp, Homo sapiens
ccactgttcatgtgg

SEQ ID NO: 27665 - DNA, 15 bp, Homo sapiens
gccactgttcatgtg

SEQ ID NO: 27666 - DNA, 15 bp, Homo sapiens
ggccactgttcatgt

SEQ ID NO: 27667 - DNA, 15 bp, Homo sapiens
tggccactgttcatg

SEQ ID NO: 27668 - DNA, 15 bp, Homo sapiens
gtggccactgttcat

SEQ ID NO: 27669 - DNA, 15 bp, Homo sapiens
tgtggccactgttca

SEQ ID NO: 27670 - DNA, 15 bp, Homo sapiens
ctgtggccactgttc

SEQ ID NO: 27671 - DNA, 15 bp, Homo sapiens
tctgtggccactgtt

SEQ ID NO: 27672 - DNA, 15 bp, Homo sapiens
ctctgtggccactgt

SEQ ID NO: 27673 - DNA, 15 bp, Homo sapiens
gctctgtggccactg

SEQ ID NO: 27674 - DNA, 15 bp, Homo sapiens
tgctctgtggccact

SEQ ID NO: 27675 - DNA, 15 bp, Homo sapiens
atgctctgtggccac

SEQ ID NO: 27676 - DNA, 15 bp, Homo sapiens
aatgctctgtggcca

SEQ ID NO: 27677 - DNA, 15 bp, Homo sapiens
caatgctctgtggcc

SEQ ID NO: 27678 - DNA, 15 bp, Homo sapiens
gcaatgctctgtggc

SEQ ID NO: 27679 - DNA, 15 bp, Homo sapiens
ggcaatgctctgtgg

SEQ ID NO: 27680 - DNA, 15 bp, Homo sapiens
tggcaatgctctgtg

SEQ ID NO: 27681 - DNA, 15 bp, Homo sapiens
atggcaatgctctgt

SEQ ID NO: 27682 - DNA, 15 bp, Homo sapiens
gatggcaatgctctg

SEQ ID NO: 27683 - DNA, 15 bp, Homo sapiens
agatggcaatgctct

SEQ ID NO: 27684 - DNA, 15 bp, Homo sapiens
aagatggcaatgctc

SEQ ID NO: 27685 - DNA, 15 bp, Homo sapiens
aaagatggcaatgct

SEQ ID NO: 27686 - DNA, 15 bp, Homo sapiens
gaaagatggcaatgc

SEQ ID NO: 27687 - DNA, 15 bp, Homo sapiens
tgaaagatggcaatg

SEQ ID NO: 27688 - DNA, 15 bp, Homo sapiens
gtgaaagatggcaat

SEQ ID NO: 27689 - DNA, 15 bp, Homo sapiens
tgtgaaagatggcaa

SEQ ID NO: 27690 - DNA, 15 bp, Homo sapiens
ctgtgaaagatggca

SEQ ID NO: 27691 - DNA, 15 bp, Homo sapiens
tctgtgaaagatggc

SEQ ID NO: 27692 - DNA, 15 bp, Homo sapiens
ctctgtgaaagatgg

SEQ ID NO: 27693 - DNA, 15 bp, Homo sapiens
actctgtgaaagatg

SEQ ID NO: 27694 - DNA, 15 bp, Homo sapiens
aactctgtgaaagat

SEQ ID NO: 27695 - DNA, 15 bp, Homo sapiens
gaactctgtgaaaga

SEQ ID NO: 27696 - DNA, 15 bp, Homo sapiens
agaactctgtgaaag

SEQ ID NO: 27697 - DNA, 15 bp, Homo sapiens
cagaactctgtgaaa

SEQ ID NO: 27698 - DNA, 15 bp, Homo sapiens
ccagaactctgtgaa

SEQ ID NO: 27699 - DNA, 15 bp, Homo sapiens
accagaactctgtga

SEQ ID NO: 27700 - DNA, 15 bp, Homo sapiens
caccagaactctgtg

SEQ ID NO: 27701 - DNA, 15 bp, Homo sapiens
ccaccagaactctgt

SEQ ID NO: 27702 - DNA, 15 bp, Homo sapiens
tccaccagaactctg

SEQ ID NO: 27703 - DNA, 15 bp, Homo sapiens
gtccaccagaactct

SEQ ID NO: 27704 - DNA, 15 bp, Homo sapiens
tgtccaccagaactc

SEQ ID NO: 27705 - DNA, 15 bp, Homo sapiens
ctgtccaccagaact

SEQ ID NO: 27706 - DNA, 15 bp, Homo sapiens
gctgtccaccagaac

SEQ ID NO: 27707 - DNA, 15 bp, Homo sapiens
agctgtccaccagaa

SEQ ID NO: 27708 - DNA, 15 bp, Homo sapiens
gagctgtccaccaga

SEQ ID NO: 27709 - DNA, 15 bp, Homo sapiens
agagctgtccaccag

SEQ ID NO: 27710 - DNA, 15 bp, Homo sapiens
cagagctgtccacca

SEQ ID NO: 27711 - DNA, 15 bp, Homo sapiens
gcagagctgtccacc

SEQ ID NO: 27712 - DNA, 15 bp, Homo sapiens
agcagagctgtccac

SEQ ID NO: 27713 - DNA, 15 bp, Homo sapiens
aagcagagctgtcca

SEQ ID NO: 27714 - DNA, 15 bp, Homo sapiens
caagcagagctgtcc

SEQ ID NO: 27715 - DNA, 15 bp, Homo sapiens
ccaagcagagctgtc

SEQ ID NO: 27716 - DNA, 15 bp, Homo sapiens
cccaagcagagctgt

SEQ ID NO: 27717 - DNA, 15 bp, Homo sapiens
ccccaagcagagctg

SEQ ID NO: 27718 - DNA, 15 bp, Homo sapiens
gccccaagcagagct

SEQ ID NO: 27719 - DNA, 15 bp, Homo sapiens
ggccccaagcagagc

SEQ ID NO: 27720 - DNA, 15 bp, Homo sapiens
tggccccaagcagag

SEQ ID NO: 27721 - DNA, 15 bp, Homo sapiens
atggccccaagcaga

SEQ ID NO: 27722 - DNA, 15 bp, Homo sapiens
gatggccccaagcag

SEQ ID NO: 27723 - DNA, 15 bp, Homo sapiens
agatggccccaagca

SEQ ID NO: 27724 - DNA, 15 bp, Homo sapiens
gagatggccccaagc

SEQ ID NO: 27725 - DNA, 15 bp, Homo sapiens
agagatggccccaag

SEQ ID NO: 27726 - DNA, 15 bp, Homo sapiens
aagagatggccccaa

SEQ ID NO: 27727 - DNA, 15 bp, Homo sapiens
gaagagatggcccca

SEQ ID NO: 27728 - DNA, 15 bp, Homo sapiens
tgaagagatggcccc

SEQ ID NO: 27729 - DNA, 15 bp, Homo sapiens
gtgaagagatggccc

SEQ ID NO: 27730 - DNA, 15 bp, Homo sapiens
ggtgaagagatggcc

SEQ ID NO: 27731 - DNA, 15 bp, Homo sapiens
aggtgaagagatggc

SEQ ID NO: 27732 - DNA, 15 bp, Homo sapiens
gaggtgaagagatgg

SEQ ID NO: 27733 - DNA, 15 bp, Homo sapiens
ggaggtgaagagatg

SEQ ID NO: 27734 - DNA, 15 bp, Homo sapiens
tggaggtgaagagat

SEQ ID NO: 27735 - DNA, 15 bp, Homo sapiens
ttggaggtgaagaga

SEQ ID NO: 27736 - DNA, 15 bp, Homo sapiens
gttggaggtgaagag

SEQ ID NO: 27737 - DNA, 15 bp, Homo sapiens
cgttggaggtgaaga

SEQ ID NO: 27738 - DNA, 15 bp, Homo sapiens
acgttggaggtgaag

SEQ ID NO: 27739 - DNA, 15 bp, Homo sapiens
aacgttggaggtgaa

SEQ ID NO: 27740 - DNA, 15 bp, Homo sapiens
gaacgttggaggtga

SEQ ID NO: 27741 - DNA, 15 bp, Homo sapiens
ggaacgttggaggtg

SEQ ID NO: 27742 - DNA, 15 bp, Homo sapiens
gggaacgttggaggt

SEQ ID NO: 27743 - DNA, 15 bp, Homo sapiens
agggaacgttggagg

SEQ ID NO: 27744 - DNA, 15 bp, Homo sapiens
tagggaacgttggag

SEQ ID NO: 27745 - DNA, 15 bp, Homo sapiens
ctagggaacgttgga

SEQ ID NO: 27746 - DNA, 15 bp, Homo sapiens
actagggaacgttgg

SEQ ID NO: 27747 - DNA, 15 bp, Homo sapiens
aactagggaacgttg

SEQ ID NO: 27748 - DNA, 15 bp, Homo sapiens
aaactagggaacgtt

SEQ ID NO: 27749 - DNA, 15 bp, Homo sapiens
taaactagggaacgt

SEQ ID NO: 27750 - DNA, 15 bp, Homo sapiens
ttaaactagggaacg

SEQ ID NO: 27751 - DNA, 15 bp, Homo sapiens
cttaaactagggaac

SEQ ID NO: 27752 - DNA, 15 bp, Homo sapiens
acttaaactagggaa

SEQ ID NO: 27753 - DNA, 15 bp, Homo sapiens
gacttaaactaggga

SEQ ID NO: 27754 - DNA, 15 bp, Homo sapiens
tgacttaaactaggg

SEQ ID NO: 27755 - DNA, 15 bp, Homo sapiens
ctgacttaaactagg

SEQ ID NO: 27756 - DNA, 15 bp, Homo sapiens
actgacttaaactag

SEQ ID NO: 27757 - DNA, 15 bp, Homo sapiens
cactgacttaaacta

SEQ ID NO: 27758 - DNA, 15 bp, Homo sapiens
acactgacttaaact

SEQ ID NO: 27759 - DNA, 15 bp, Homo sapiens
gacactgacttaaac

SEQ ID NO: 27760 - DNA, 15 bp, Homo sapiens
tgacactgacttaaa

SEQ ID NO: 27761 - DNA, 15 bp, Homo sapiens
atgacactgacttaa

SEQ ID NO: 27762 - DNA, 15 bp, Homo sapiens
aatgacactgactta

SEQ ID NO: 27763 - DNA, 15 bp, Homo sapiens
taatgacactgactt

SEQ ID NO: 27764 - DNA, 15 bp, Homo sapiens
ataatgacactgact

SEQ ID NO: 27765 - DNA, 15 bp, Homo sapiens
tataatgacactgac

SEQ ID NO: 27766 - DNA, 15 bp, Homo sapiens
gtataatgacactga

SEQ ID NO: 27767 - DNA, 15 bp, Homo sapiens
agtataatgacactg

SEQ ID NO: 27768 - DNA, 15 bp, Homo sapiens
cagtataatgacact

SEQ ID NO: 27769 - DNA, 15 bp, Homo sapiens
tcagtataatgacac

SEQ ID NO: 27770 - DNA, 15 bp, Homo sapiens
ttcagtataatgaca

SEQ ID NO: 27771 - DNA, 15 bp, Homo sapiens
attcagtataatgac

SEQ ID NO: 27772 - DNA, 15 bp, Homo sapiens
cattcagtataatga

SEQ ID NO: 27773 - DNA, 15 bp, Homo sapiens
ccattcagtataatg

SEQ ID NO: 27774 - DNA, 15 bp, Homo sapiens
accattcagtataat

SEQ ID NO: 27775 - DNA, 15 bp, Homo sapiens
taccattcagtataa

SEQ ID NO: 27776 - DNA, 15 bp, Homo sapiens
aataccattcagtat

SEQ ID NO: 27777 - DNA, 15 bp, Homo sapiens
gaataccattcagta

SEQ ID NO: 27778 - DNA, 15 bp, Homo sapiens
ggaataccattcagt

SEQ ID NO: 27779 - DNA, 15 bp, Homo sapiens
aggaataccattcag

SEQ ID NO: 27780 - DNA, 15 bp, Homo sapiens
aaggaataccattca

SEQ ID NO: 27781 - DNA, 15 bp, Homo sapiens
caaggaataccattc

SEQ ID NO: 27782 - DNA, 15 bp, Homo sapiens
acaaggaataccatt

SEQ ID NO: 27783 - DNA, 15 bp, Homo sapiens
gacaaggaataccat

SEQ ID NO: 27784 - DNA, 15 bp, Homo sapiens
agacaaggaatacca

SEQ ID NO: 27785 - DNA, 15 bp, Homo sapiens
gagacaaggaatacc

SEQ ID NO: 27786 - DNA, 15 bp, Homo sapiens
ggagacaaggaatac

SEQ ID NO: 27787 - DNA, 15 bp, Homo sapiens
gggagacaaggaata

SEQ ID NO: 27788 - DNA, 15 bp, Homo sapiens
agggagacaaggaat

SEQ ID NO: 27789 - DNA, 15 bp, Homo sapiens
aagggagacaaggaa

SEQ ID NO: 27790 - DNA, 15 bp, Homo sapiens
gaagggagacaagga

SEQ ID NO: 27791 - DNA, 15 bp, Homo sapiens
tgaagggagacaagg

SEQ ID NO: 27792 - DNA, 15 bp, Homo sapiens
ctgaagggagacaag

SEQ ID NO: 27793 - DNA, 15 bp, Homo sapiens
gctgaagggagacaa

SEQ ID NO: 27794 - DNA, 15 bp, Homo sapiens
ggctgaagggagaca

SEQ ID NO: 27795 - DNA, 15 bp, Homo sapiens
tggctgaagggagac

SEQ ID NO: 27796 - DNA, 15 bp, Homo sapiens
ttggctgaagggaga

SEQ ID NO: 27797 - DNA, 15 bp, Homo sapiens
attggctgaagggag

SEQ ID NO: 27798 - DNA, 15 bp, Homo sapiens
cattggctgaaggga

SEQ ID NO: 27799 - DNA, 15 bp, Homo sapiens
gcattggctgaaggg

SEQ ID NO: 27800 - DNA, 15 bp, Homo sapiens
agcattggctgaagg

SEQ ID NO: 27801 - DNA, 15 bp, Homo sapiens
aagcattggctgaag

SEQ ID NO: 27802 - DNA, 15 bp, Homo sapiens
aaagcattggctgaa

SEQ ID NO: 27803 - DNA, 15 bp, Homo sapiens
aaaagcattggctga

SEQ ID NO: 27804 - DNA, 15 bp, Homo sapiens
caaaagcattggctg

SEQ ID NO: 27805 - DNA, 15 bp, Homo sapiens
acaaaagcattggct

SEQ ID NO: 27806 - DNA, 15 bp, Homo sapiens
aacaaaagcattggc

SEQ ID NO: 27807 - DNA, 15 bp, Homo sapiens
aaacaaaagcattgg

SEQ ID NO: 27808 - DNA, 15 bp, Homo sapiens
aaaacaaaagcattg

SEQ ID NO: 27809 - DNA, 15 bp, Homo sapiens
aaaaacaaaagcatt

SEQ ID NO: 27810 - DNA, 15 bp, Homo sapiens
aaaaaacaaaagcat

SEQ ID NO: 27811 - DNA, 15 bp, Homo sapiens
caaaaaacaaaagca

SEQ ID NO: 27812 - DNA, 15 bp, Homo sapiens
tcaaaaaacaaaagc

SEQ ID NO: 27813 - DNA, 15 bp, Homo sapiens
ctcaaaaaacaaaag

SEQ ID NO: 27814 - DNA, 15 bp, Homo sapiens
tccatctcaaaaaac

SEQ ID NO: 27815 - DNA, 15 bp, Homo sapiens
caaactccatctcaa

SEQ ID NO: 27816 - DNA, 15 bp, Homo sapiens
gcaaactccatctca

SEQ ID NO: 27817 - DNA, 15 bp, Homo sapiens
agcaaactccatctc

SEQ ID NO: 27818 - DNA, 15 bp, Homo sapiens
gagcaaactccatct

SEQ ID NO: 27819 - DNA, 15 bp, Homo sapiens
agagcaaactccatc

SEQ ID NO: 27820 - DNA, 15 bp, Homo sapiens
aagagcaaactccat

SEQ ID NO: 27821 - DNA, 15 bp, Homo sapiens
aaagagcaaactcca

SEQ ID NO: 27822 - DNA, 15 bp, Homo sapiens
gaaagagcaaactcc

SEQ ID NO: 27823 - DNA, 15 bp, Homo sapiens
cgaaagagcaaactc

SEQ ID NO: 27824 - DNA, 15 bp, Homo sapiens
acgaaagagcaaact

SEQ ID NO: 27825 - DNA, 15 bp, Homo sapiens
gacgaaagagcaaac

SEQ ID NO: 27826 - DNA, 15 bp, Homo sapiens
ggacgaaagagcaaa

SEQ ID NO: 27827 - DNA, 15 bp, Homo sapiens
tggacgaaagagcaa

SEQ ID NO: 27828 - DNA, 15 bp, Homo sapiens
ctggacgaaagagca

SEQ ID NO: 27829 - DNA, 15 bp, Homo sapiens
cctggacgaaagagc

SEQ ID NO: 27830 - DNA, 15 bp, Homo sapiens
ccctggacgaaagag

SEQ ID NO: 27831 - DNA, 15 bp, Homo sapiens
accctggacgaaaga

SEQ ID NO: 27832 - DNA, 15 bp, Homo sapiens
caccctggacgaaag

SEQ ID NO: 27833 - DNA, 15 bp, Homo sapiens
ccaccctggacgaaa

SEQ ID NO: 27834 - DNA, 15 bp, Homo sapiens
tccaccctggacgaa

SEQ ID NO: 27835 - DNA, 15 bp, Homo sapiens
ctccaccctggacga

SEQ ID NO: 27836 - DNA, 15 bp, Homo sapiens
actccaccctggacg

SEQ ID NO: 27837 - DNA, 15 bp, Homo sapiens
cactccaccctggac

SEQ ID NO: 27838 - DNA, 15 bp, Homo sapiens
tcactccaccctgga

SEQ ID NO: 27839 - DNA, 15 bp, Homo sapiens
ttcactccaccctgg

SEQ ID NO: 27840 - DNA, 15 bp, Homo sapiens
cttcactccaccctg

SEQ ID NO: 27841 - DNA, 15 bp, Homo sapiens
acttcactccaccct

SEQ ID NO: 27842 - DNA, 15 bp, Homo sapiens
cacttcactccaccc

SEQ ID NO: 27843 - DNA, 15 bp, Homo sapiens
ccacttcactccacc

SEQ ID NO: 27844 - DNA, 15 bp, Homo sapiens
gccacttcactccac

SEQ ID NO: 27845 - DNA, 15 bp, Homo sapiens
cgccacttcactcca

SEQ ID NO: 27846 - DNA, 15 bp, Homo sapiens
gcgccacttcactcc

SEQ ID NO: 27847 - DNA, 15 bp, Homo sapiens
tgcgccacttcactc

SEQ ID NO: 27848 - DNA, 15 bp, Homo sapiens
ttgcgccacttcact

SEQ ID NO: 27849 - DNA, 15 bp, Homo sapiens
attgcgccacttcac

SEQ ID NO: 27850 - DNA, 15 bp, Homo sapiens
gattgcgccacttca

SEQ ID NO: 27851 - DNA, 15 bp, Homo sapiens
agattgcgccacttc

SEQ ID NO: 27852 - DNA, 15 bp, Homo sapiens
gagattgcgccactt

SEQ ID NO: 27853 - DNA, 15 bp, Homo sapiens
atgagattgcgccac

SEQ ID NO: 27854 - DNA, 15 bp, Homo sapiens
gatgagattgcgcca

SEQ ID NO: 27855 - DNA, 15 bp, Homo sapiens
agatgagattgcgcc

SEQ ID NO: 27856 - DNA, 15 bp, Homo sapiens
gagatgagattgcgc

SEQ ID NO: 27857 - DNA, 15 bp, Homo sapiens
tgagatgagattgcg

SEQ ID NO: 27858 - DNA, 15 bp, Homo sapiens
gtgagatgagattgc

SEQ ID NO: 27859 - DNA, 15 bp, Homo sapiens
agtgagatgagattg

SEQ ID NO: 27860 - DNA, 15 bp, Homo sapiens
cagtgagatgagatt

SEQ ID NO: 27861 - DNA, 15 bp, Homo sapiens
ccagtgagatgagat

SEQ ID NO: 27862 - DNA, 15 bp, Homo sapiens
tccagtgagatgaga

SEQ ID NO: 27863 - DNA, 15 bp, Homo sapiens
ttccagtgagatgag

SEQ ID NO: 27864 - DNA, 15 bp, Homo sapiens
attccagtgagatga

SEQ ID NO: 27865 - DNA, 15 bp, Homo sapiens
gattccagtgagatg

SEQ ID NO: 27866 - DNA, 15 bp, Homo sapiens
agattccagtgagat

SEQ ID NO: 27867 - DNA, 15 bp, Homo sapiens
gagattccagtgaga

SEQ ID NO: 27868 - DNA, 15 bp, Homo sapiens
agagattccagtgag

SEQ ID NO: 27869 - DNA, 15 bp, Homo sapiens
cagagattccagtga

SEQ ID NO: 27870 - DNA, 15 bp, Homo sapiens
gcagagattccagtg

SEQ ID NO: 27871 - DNA, 15 bp, Homo sapiens
ggcagagattccagt

SEQ ID NO: 27872 - DNA, 15 bp, Homo sapiens
gggcagagattccag

SEQ ID NO: 27873 - DNA, 15 bp, Homo sapiens
ggggcagagattcca

SEQ ID NO: 27874 - DNA, 15 bp, Homo sapiens
gggggcagagattcc

SEQ ID NO: 27875 - DNA, 15 bp, Homo sapiens
ggggggcagagattc

SEQ ID NO: 27876 - DNA, 15 bp, Homo sapiens
aggggggcagagatt

SEQ ID NO: 27877 - DNA, 15 bp, Homo sapiens
caggggggcagagat

SEQ ID NO: 27878 - DNA, 15 bp, Homo sapiens
ccaggggggcagaga

SEQ ID NO: 27879 - DNA, 15 bp, Homo sapiens
gccaggggggcagag

SEQ ID NO: 27880 - DNA, 15 bp, Homo sapiens
agccaggggggcaga

SEQ ID NO: 27881 - DNA, 15 bp, Homo sapiens
aagccaggggggcag

SEQ ID NO: 27882 - DNA, 15 bp, Homo sapiens
aaagccaggggggca

SEQ ID NO: 27883 - DNA, 15 bp, Homo sapiens
taaagccaggggggc

SEQ ID NO: 27884 - DNA, 15 bp, Homo sapiens
ttaaagccagggggg

SEQ ID NO: 27885 - DNA, 15 bp, Homo sapiens
cttaaagccaggggg

SEQ ID NO: 27886 - DNA, 15 bp, Homo sapiens
gcttaaagccagggg

SEQ ID NO: 27887 - DNA, 15 bp, Homo sapiens
tgcttaaagccaggg

SEQ ID NO: 27888 - DNA, 15 bp, Homo sapiens
ctgcttaaagccagg

SEQ ID NO: 27889 - DNA, 15 bp, Homo sapiens
actgcttaaagccag

SEQ ID NO: 27890 - DNA, 15 bp, Homo sapiens
aactgcttaaagcca

SEQ ID NO: 27891 - DNA, 15 bp, Homo sapiens
gaactgcttaaagcc

SEQ ID NO: 27892 - DNA, 15 bp, Homo sapiens
agaactgcttaaagc

SEQ ID NO: 27893 - DNA, 15 bp, Homo sapiens
gagaactgcttaaag

SEQ ID NO: 27894 - DNA, 15 bp, Homo sapiens
ggagaactgcttaaa

SEQ ID NO: 27895 - DNA, 15 bp, Homo sapiens
aggagaactgcttaa

SEQ ID NO: 27896 - DNA, 15 bp, Homo sapiens
caggagaactgctta

SEQ ID NO: 27897 - DNA, 15 bp, Homo sapiens
gcaggagaactgctt

SEQ ID NO: 27898 - DNA, 15 bp, Homo sapiens
ggcaggagaactgct

SEQ ID NO: 27899 - DNA, 15 bp, Homo sapiens
aggcaggagaactgc

SEQ ID NO: 27900 - DNA, 15 bp, Homo sapiens
gaggcaggagaactg

SEQ ID NO: 27901 - DNA, 15 bp, Homo sapiens
cgaggcaggagaact

SEQ ID NO: 27902 - DNA, 15 bp, Homo sapiens
ccgaggcaggagaac

SEQ ID NO: 27903 - DNA, 15 bp, Homo sapiens
gccgaggcaggagaa

SEQ ID NO: 27904 - DNA, 15 bp, Homo sapiens
ggccgaggcaggaga

SEQ ID NO: 27905 - DNA, 15 bp, Homo sapiens
aggccgaggcaggag

SEQ ID NO: 27906 - DNA, 15 bp, Homo sapiens
gaggccgaggcagga

SEQ ID NO: 27907 - DNA, 15 bp, Homo sapiens
aggaggccgaggcag

SEQ ID NO: 27908 - DNA, 15 bp, Homo sapiens
caggaggccgaggca

SEQ ID NO: 27909 - DNA, 15 bp, Homo sapiens
tcaggaggccgaggc

SEQ ID NO: 27910 - DNA, 15 bp, Homo sapiens
ctcaggaggccgagg

SEQ ID NO: 27911 - DNA, 15 bp, Homo sapiens
actcaggaggccgag

SEQ ID NO: 27912 - DNA, 15 bp, Homo sapiens
tactcaggaggccga

SEQ ID NO: 27913 - DNA, 15 bp, Homo sapiens
ctactcaggaggccg

SEQ ID NO: 27914 - DNA, 15 bp, Homo sapiens
gctactcaggaggcc

SEQ ID NO: 27915 - DNA, 15 bp, Homo sapiens
aggcacctgtaatcc

SEQ ID NO: 27916 - DNA, 15 bp, Homo sapiens
caggcacctgtaatc

SEQ ID NO: 27917 - DNA, 15 bp, Homo sapiens
gcaggcacctgtaat

SEQ ID NO: 27918 - DNA, 15 bp, Homo sapiens
ggcaggcacctgtaa

SEQ ID NO: 27919 - DNA, 15 bp, Homo sapiens
tggcaggcacctgta

SEQ ID NO: 27920 - DNA, 15 bp, Homo sapiens
gtggcaggcacctgt

SEQ ID NO: 27921 - DNA, 15 bp, Homo sapiens
ggtggcaggcacctg

SEQ ID NO: 27922 - DNA, 15 bp, Homo sapiens
tggtggcaggcacct

SEQ ID NO: 27923 - DNA, 15 bp, Homo sapiens
gtggtggcaggcacc

SEQ ID NO: 27924 - DNA, 15 bp, Homo sapiens
tgtggtggcaggcac

SEQ ID NO: 27925 - DNA, 15 bp, Homo sapiens
gtgtggtggcaggca

SEQ ID NO: 27926 - DNA, 15 bp, Homo sapiens
ggtgtggtggcaggc

SEQ ID NO: 27927 - DNA, 15 bp, Homo sapiens
aggtgtggtggcagg

SEQ ID NO: 27928 - DNA, 15 bp, Homo sapiens
taggtgtggtggcag

SEQ ID NO: 27929 - DNA, 15 bp, Homo sapiens
ctaggtgtggtggca

SEQ ID NO: 27930 - DNA, 15 bp, Homo sapiens
gctaggtgtggtggc

SEQ ID NO: 27931 - DNA, 15 bp, Homo sapiens
agctaggtgtggtgg

SEQ ID NO: 27932 - DNA, 15 bp, Homo sapiens
tagctaggtgtggtg

SEQ ID NO: 27933 - DNA, 15 bp, Homo sapiens
ttagctaggtgtggt

SEQ ID NO: 27934 - DNA, 15 bp, Homo sapiens
attagctaggtgtgg

SEQ ID NO: 27935 - DNA, 15 bp, Homo sapiens
aattagctaggtgtg

SEQ ID NO: 27936 - DNA, 15 bp, Homo sapiens
aaattagctaggtgt

SEQ ID NO: 27937 - DNA, 15 bp, Homo sapiens
aaaattagctaggtg

SEQ ID NO: 27938 - DNA, 15 bp, Homo sapiens
aaaaattagctaggt

SEQ ID NO: 27939 - DNA, 15 bp, Homo sapiens
caaaaattagctagg

SEQ ID NO: 27940 - DNA, 15 bp, Homo sapiens
acaaaaattagctag

SEQ ID NO: 27941 - DNA, 15 bp, Homo sapiens
tacaaaaattagcta

SEQ ID NO: 27942 - DNA, 15 bp, Homo sapiens
ctacaaaaattagct

SEQ ID NO: 27943 - DNA, 15 bp, Homo sapiens
tctacaaaaattagc

SEQ ID NO: 27944 - DNA, 15 bp, Homo sapiens
gtctacaaaaattag

SEQ ID NO: 27945 - DNA, 15 bp, Homo sapiens
tgtctacaaaaatta

SEQ ID NO: 27946 - DNA, 15 bp, Homo sapiens
ctgtctacaaaaatt

SEQ ID NO: 27947 - DNA, 15 bp, Homo sapiens
cctgtctacaaaaat

SEQ ID NO: 27948 - DNA, 15 bp, Homo sapiens
ccctgtctacaaaaa

SEQ ID NO: 27949 - DNA, 15 bp, Homo sapiens
accctgtctacaaaa

SEQ ID NO: 27950 - DNA, 15 bp, Homo sapiens
aaccctgtctacaaa

SEQ ID NO: 27951 - DNA, 15 bp, Homo sapiens
aaaccctgtctacaa

SEQ ID NO: 27952 - DNA, 15 bp, Homo sapiens
gaaaccctgtctaca

SEQ ID NO: 27953 - DNA, 15 bp, Homo sapiens
tgaaaccctgtctac

SEQ ID NO: 27954 - DNA, 15 bp, Homo sapiens
gtgaaaccctgtcta

SEQ ID NO: 27955 - DNA, 15 bp, Homo sapiens
tgaccagcctggcca

SEQ ID NO: 27956 - DNA, 15 bp, Homo sapiens
atgaccagcctggcc

SEQ ID NO: 27957 - DNA, 15 bp, Homo sapiens
catgaccagcctggc

SEQ ID NO: 27958 - DNA, 15 bp, Homo sapiens
tcatgaccagcctgg

SEQ ID NO: 27959 - DNA, 15 bp, Homo sapiens
ttcatgaccagcctg

SEQ ID NO: 27960 - DNA, 15 bp, Homo sapiens
gttcatgaccagcct

SEQ ID NO: 27961 - DNA, 15 bp, Homo sapiens
agttcatgaccagcc

SEQ ID NO: 27962 - DNA, 15 bp, Homo sapiens
cagttcatgaccagc

SEQ ID NO: 27963 - DNA, 15 bp, Homo sapiens
gcagttcatgaccag

SEQ ID NO: 27964 - DNA, 15 bp, Homo sapiens
agcagttcatgacca

SEQ ID NO: 27965 - DNA, 15 bp, Homo sapiens
cagcagttcatgacc

SEQ ID NO: 27966 - DNA, 15 bp, Homo sapiens
tcagcagttcatgac

SEQ ID NO: 27967 - DNA, 15 bp, Homo sapiens
gtcagcagttcatga

SEQ ID NO: 27968 - DNA, 15 bp, Homo sapiens
ggtcagcagttcatg

SEQ ID NO: 27969 - DNA, 15 bp, Homo sapiens
aggtcagcagttcat

SEQ ID NO: 27970 - DNA, 15 bp, Homo sapiens
gaggtcagcagttca

SEQ ID NO: 27971 - DNA, 15 bp, Homo sapiens
tgaggtcagcagttc

SEQ ID NO: 27972 - DNA, 15 bp, Homo sapiens
ctgaggtcagcagtt

SEQ ID NO: 27973 - DNA, 15 bp, Homo sapiens
cctgaggtcagcagt

SEQ ID NO: 27974 - DNA, 15 bp, Homo sapiens
acctgaggtcagcag

SEQ ID NO: 27975 - DNA, 15 bp, Homo sapiens
cacctgaggtcagca

SEQ ID NO: 27976 - DNA, 15 bp, Homo sapiens
tcacctgaggtcagc

SEQ ID NO: 27977 - DNA, 15 bp, Homo sapiens
agtggatcacctgag

SEQ ID NO: 27978 - DNA, 15 bp, Homo sapiens
cagtggatcacctga

SEQ ID NO: 27979 - DNA, 15 bp, Homo sapiens
gcagtggatcacctg

SEQ ID NO: 27980 - DNA, 15 bp, Homo sapiens
tgcagtggatcacct

SEQ ID NO: 27981 - DNA, 15 bp, Homo sapiens
gtgcagtggatcacc

SEQ ID NO: 27982 - DNA, 15 bp, Homo sapiens
ggtgcagtggatcac

SEQ ID NO: 27983 - DNA, 15 bp, Homo sapiens
gggtgcagtggatca

SEQ ID NO: 27984 - DNA, 15 bp, Homo sapiens
cgggtgcagtggatc

SEQ ID NO: 27985 - DNA, 15 bp, Homo sapiens
tcgggtgcagtggat

SEQ ID NO: 27986 - DNA, 15 bp, Homo sapiens
gtcgggtgcagtgga

SEQ ID NO: 27987 - DNA, 15 bp, Homo sapiens
ggtcgggtgcagtgg

SEQ ID NO: 27988 - DNA, 15 bp, Homo sapiens
tggtcgggtgcagtg

SEQ ID NO: 27989 - DNA, 15 bp, Homo sapiens
gtggtcgggtgcagt

SEQ ID NO: 27990 - DNA, 15 bp, Homo sapiens
ggtggtcgggtgcag

SEQ ID NO: 27991 - DNA, 15 bp, Homo sapiens
aggtggtcgggtgca

SEQ ID NO: 27992 - DNA, 15 bp, Homo sapiens
aaggtggtcgggtgc

SEQ ID NO: 27993 - DNA, 15 bp, Homo sapiens
gaaggtggtcgggtg

SEQ ID NO: 27994 - DNA, 15 bp, Homo sapiens
tgaaggtggtcgggt

SEQ ID NO: 27995 - DNA, 15 bp, Homo sapiens
ctgaaggtggtcggg

SEQ ID NO: 27996 - DNA, 15 bp, Homo sapiens
gctgaaggtggtcgg

SEQ ID NO: 27997 - DNA, 15 bp, Homo sapiens
ggctgaaggtggtcg

SEQ ID NO: 27998 - DNA, 15 bp, Homo sapiens
tggctgaaggtggtc

SEQ ID NO: 27999 - DNA, 15 bp, Homo sapiens
ttggctgaaggtggt

SEQ ID NO: 28000 - DNA, 15 bp, Homo sapiens
attggctgaaggtgg

SEQ ID NO: 28001 - DNA, 15 bp, Homo sapiens
aattggctgaaggtg

SEQ ID NO: 28002 - DNA, 15 bp, Homo sapiens
gaattggctgaaggt

SEQ ID NO: 28003 - DNA, 15 bp, Homo sapiens
agaattggctgaagg

SEQ ID NO: 28004 - DNA, 15 bp, Homo sapiens
aagaattggctgaag

SEQ ID NO: 28005 - DNA, 15 bp, Homo sapiens
caagaattggctgaa

SEQ ID NO: 28006 - DNA, 15 bp, Homo sapiens
tcaagaattggctga

SEQ ID NO: 28007 - DNA, 15 bp, Homo sapiens
gtcaagaattggctg

SEQ ID NO: 28008 - DNA, 15 bp, Homo sapiens
tgtcaagaattggct

SEQ ID NO: 28009 - DNA, 15 bp, Homo sapiens
ttgtcaagaattggc

SEQ ID NO: 28010 - DNA, 15 bp, Homo sapiens
gttgtcaagaattgg

SEQ ID NO: 28011 - DNA, 15 bp, Homo sapiens
agttgtcaagaattg

SEQ ID NO: 28012 - DNA, 15 bp, Homo sapiens
cagttgtcaagaatt

SEQ ID NO: 28013 - DNA, 15 bp, Homo sapiens
ccagttgtcaagaat

SEQ ID NO: 28014 - DNA, 15 bp, Homo sapiens
tccagttgtcaagaa

SEQ ID NO: 28015 - DNA, 15 bp, Homo sapiens
ctccagttgtcaaga

SEQ ID NO: 28016 - DNA, 15 bp, Homo sapiens
gctccagttgtcaag

SEQ ID NO: 28017 - DNA, 15 bp, Homo sapiens
agctccagttgtcaa

SEQ ID NO: 28018 - DNA, 15 bp, Homo sapiens
aagctccagttgtca

SEQ ID NO: 28019 - DNA, 15 bp, Homo sapiens
caagctccagttgtc

SEQ ID NO: 28020 - DNA, 15 bp, Homo sapiens
tcaagctccagttgt

SEQ ID NO: 28021 - DNA, 15 bp, Homo sapiens
ctcaagctccagttg

SEQ ID NO: 28022 - DNA, 15 bp, Homo sapiens
tctcaagctccagtt

SEQ ID NO: 28023 - DNA, 15 bp, Homo sapiens
gtctcaagctccagt

SEQ ID NO: 28024 - DNA, 15 bp, Homo sapiens
ggtctcaagctccag

SEQ ID NO: 28025 - DNA, 15 bp, Homo sapiens
gggtctcaagctcca

SEQ ID NO: 28026 - DNA, 15 bp, Homo sapiens
agggtctcaagctcc

SEQ ID NO: 28027 - DNA, 15 bp, Homo sapiens
gagggtctcaagctc

SEQ ID NO: 28028 - DNA, 15 bp, Homo sapiens
ggagggtctcaagct

SEQ ID NO: 28029 - DNA, 15 bp, Homo sapiens
cggagggtctcaagc

SEQ ID NO: 28030 - DNA, 15 bp, Homo sapiens
acggagggtctcaag

SEQ ID NO: 28031 - DNA, 15 bp, Homo sapiens
aacggagggtctcaa

SEQ ID NO: 28032 - DNA, 15 bp, Homo sapiens
caacggagggtctca

SEQ ID NO: 28033 - DNA, 15 bp, Homo sapiens
acaacggagggtctc

SEQ ID NO: 28034 - DNA, 15 bp, Homo sapiens
gacaacggagggtct

SEQ ID NO: 28035 - DNA, 15 bp, Homo sapiens
agacaacggagggtc

SEQ ID NO: 28036 - DNA, 15 bp, Homo sapiens
aagacaacggagggt

SEQ ID NO: 28037 - DNA, 15 bp, Homo sapiens
gaagacaacggaggg

SEQ ID NO: 28038 - DNA, 15 bp, Homo sapiens
agaagacaacggagg

SEQ ID NO: 28039 - DNA, 15 bp, Homo sapiens
cagaagacaacggag

SEQ ID NO: 28040 - DNA, 15 bp, Homo sapiens
acagaagacaacgga

SEQ ID NO: 28041 - DNA, 15 bp, Homo sapiens
aacagaagacaacgg

SEQ ID NO: 28042 - DNA, 15 bp, Homo sapiens
aaacagaagacaacg

SEQ ID NO: 28043 - DNA, 15 bp, Homo sapiens
aaaacagaagacaac

SEQ ID NO: 28044 - DNA, 15 bp, Homo sapiens
taaaacagaagacaa

SEQ ID NO: 28045 - DNA, 15 bp, Homo sapiens
gtaaaacagaagaca

SEQ ID NO: 28046 - DNA, 15 bp, Homo sapiens
agtaaaacagaagac

SEQ ID NO: 28047 - DNA, 15 bp, Homo sapiens
aagtaaaacagaaga

SEQ ID NO: 28048 - DNA, 15 bp, Homo sapiens
caagtaaaacagaag

SEQ ID NO: 28049 - DNA, 15 bp, Homo sapiens
acaagtaaaacagaa

SEQ ID NO: 28050 - DNA, 15 bp, Homo sapiens
gacaagtaaaacaga

SEQ ID NO: 28051 - DNA, 15 bp, Homo sapiens
agacaagtaaaacag

SEQ ID NO: 28052 - DNA, 15 bp, Homo sapiens
aagacaagtaaaaca

SEQ ID NO: 28053 - DNA, 15 bp, Homo sapiens
taagacaagtaaaac

SEQ ID NO: 28054 - DNA, 15 bp, Homo sapiens
ttaagacaagtaaaa

SEQ ID NO: 28055 - DNA, 15 bp, Homo sapiens
tttaagacaagtaaa

SEQ ID NO: 28056 - DNA, 15 bp, Homo sapiens
ttttaagacaagtaa

SEQ ID NO: 28057 - DNA, 15 bp, Homo sapiens
cttttaagacaagta

SEQ ID NO: 28058 - DNA, 15 bp, Homo sapiens
gcttttaagacaagt

SEQ ID NO: 28059 - DNA, 15 bp, Homo sapiens
ggcttttaagacaag

SEQ ID NO: 28060 - DNA, 15 bp, Homo sapiens
tggcttttaagacaa

SEQ ID NO: 28061 - DNA, 15 bp, Homo sapiens
ttggcttttaagaca

SEQ ID NO: 28062 - DNA, 15 bp, Homo sapiens
tttggcttttaagac

SEQ ID NO: 28063 - DNA, 15 bp, Homo sapiens
atttggcttttaaga

SEQ ID NO: 28064 - DNA, 15 bp, Homo sapiens
catttggcttttaag

SEQ ID NO: 28065 - DNA, 15 bp, Homo sapiens
gcatttggcttttaa

SEQ ID NO: 28066 - DNA, 15 bp, Homo sapiens
ggcatttggctttta

SEQ ID NO: 28067 - DNA, 15 bp, Homo sapiens
gggcatttggctttt

SEQ ID NO: 28068 - DNA, 15 bp, Homo sapiens
ggggcatttggcttt

SEQ ID NO: 28069 - DNA, 15 bp, Homo sapiens
tggggcatttggctt

SEQ ID NO: 28070 - DNA, 15 bp, Homo sapiens
atggggcatttggct

SEQ ID NO: 28071 - DNA, 15 bp, Homo sapiens
tatggggcatttggc

SEQ ID NO: 28072 - DNA, 15 bp, Homo sapiens
ttatggggcatttgg

SEQ ID NO: 28073 - DNA, 15 bp, Homo sapiens
attatggggcatttg

SEQ ID NO: 28074 - DNA, 15 bp, Homo sapiens
cattatggggcattt

SEQ ID NO: 28075 - DNA, 15 bp, Homo sapiens
tcattatggggcatt

SEQ ID NO: 28076 - DNA, 15 bp, Homo sapiens
gtcattatggggcat

SEQ ID NO: 28077 - DNA, 15 bp, Homo sapiens
agtcattatggggca

SEQ ID NO: 28078 - DNA, 15 bp, Homo sapiens
aagtcattatggggc

SEQ ID NO: 28079 - DNA, 15 bp, Homo sapiens
aaagtcattatgggg

SEQ ID NO: 28080 - DNA, 15 bp, Homo sapiens
aaaagtcattatggg

SEQ ID NO: 28081 - DNA, 15 bp, Homo sapiens
caaaagtcattatgg

SEQ ID NO: 28082 - DNA, 15 bp, Homo sapiens
tcaaaagtcattatg

SEQ ID NO: 28083 - DNA, 15 bp, Homo sapiens
ctcaaaagtcattat

SEQ ID NO: 28084 - DNA, 15 bp, Homo sapiens
cctcaaaagtcatta

SEQ ID NO: 28085 - DNA, 15 bp, Homo sapiens
acctcaaaagtcatt

SEQ ID NO: 28086 - DNA, 15 bp, Homo sapiens
gacctcaaaagtcat

SEQ ID NO: 28087 - DNA, 15 bp, Homo sapiens
agacctcaaaagtca

SEQ ID NO: 28088 - DNA, 15 bp, Homo sapiens
aagacctcaaaagtc

SEQ ID NO: 28089 - DNA, 15 bp, Homo sapiens
taagacctcaaaagt

SEQ ID NO: 28090 - DNA, 15 bp, Homo sapiens
ttaagacctcaaaag

SEQ ID NO: 28091 - DNA, 15 bp, Homo sapiens
attaagacctcaaaa

SEQ ID NO: 28092 - DNA, 15 bp, Homo sapiens
cattaagacctcaaa

SEQ ID NO: 28093 - DNA, 15 bp, Homo sapiens
tcattaagacctcaa

SEQ ID NO: 28094 - DNA, 15 bp, Homo sapiens
gtcattaagacctca

SEQ ID NO: 28095 - DNA, 15 bp, Homo sapiens
ggtcattaagacctc

SEQ ID NO: 28096 - DNA, 15 bp, Homo sapiens
aggtcattaagacct

SEQ ID NO: 28097 - DNA, 15 bp, Homo sapiens
caggtcattaagacc

SEQ ID NO: 28098 - DNA, 15 bp, Homo sapiens
gcaggtcattaagac

SEQ ID NO: 28099 - DNA, 15 bp, Homo sapiens
agcaggtcattaaga

SEQ ID NO: 28100 - DNA, 15 bp, Homo sapiens
aagcaggtcattaag

SEQ ID NO: 28101 - DNA, 15 bp, Homo sapiens
gaagcaggtcattaa

SEQ ID NO: 28102 - DNA, 15 bp, Homo sapiens
agaagcaggtcatta

SEQ ID NO: 28103 - DNA, 15 bp, Homo sapiens
tagaagcaggtcatt

SEQ ID NO: 28104 - DNA, 15 bp, Homo sapiens
gtagaagcaggtcat

SEQ ID NO: 28105 - DNA, 15 bp, Homo sapiens
ggtagaagcaggtca

SEQ ID NO: 28106 - DNA, 15 bp, Homo sapiens
tggtagaagcaggtc

SEQ ID NO: 28107 - DNA, 15 bp, Homo sapiens
atggtagaagcaggt

SEQ ID NO: 28108 - DNA, 15 bp, Homo sapiens
gatggtagaagcagg

SEQ ID NO: 28109 - DNA, 15 bp, Homo sapiens
ggatggtagaagcag

SEQ ID NO: 28110 - DNA, 15 bp, Homo sapiens
aggatggtagaagca

SEQ ID NO: 28111 - DNA, 15 bp, Homo sapiens
gaggatggtagaagc

SEQ ID NO: 28112 - DNA, 15 bp, Homo sapiens
agaggatggtagaag

SEQ ID NO: 28113 - DNA, 15 bp, Homo sapiens
cagaggatggtagaa

SEQ ID NO: 28114 - DNA, 15 bp, Homo sapiens
gcagaggatggtaga

SEQ ID NO: 28115 - DNA, 15 bp, Homo sapiens
ggcagaggatggtag

SEQ ID NO: 28116 - DNA, 15 bp, Homo sapiens
tggcagaggatggta

SEQ ID NO: 28117 - DNA, 15 bp, Homo sapiens
atggcagaggatggt

SEQ ID NO: 28118 - DNA, 15 bp, Homo sapiens
aatggcagaggatgg

SEQ ID NO: 28119 - DNA, 15 bp, Homo sapiens
taatggcagaggatg

SEQ ID NO: 28120 - DNA, 15 bp, Homo sapiens
gtaatggcagaggat

SEQ ID NO: 28121 - DNA, 15 bp, Homo sapiens
ggtaatggcagagga

SEQ ID NO: 28122 - DNA, 15 bp, Homo sapiens
aggtaatggcagagg

SEQ ID NO: 28123 - DNA, 15 bp, Homo sapiens
caggtaatggcagag

SEQ ID NO: 28124 - DNA, 15 bp, Homo sapiens
gcaggtaatggcaga

SEQ ID NO: 28125 - DNA, 15 bp, Homo sapiens
ggcaggtaatggcag

SEQ ID NO: 28126 - DNA, 15 bp, Homo sapiens
aggcaggtaatggca

SEQ ID NO: 28127 - DNA, 15 bp, Homo sapiens
gaggcaggtaatggc

SEQ ID NO: 28128 - DNA, 15 bp, Homo sapiens
tgaggcaggtaatgg

SEQ ID NO: 28129 - DNA, 15 bp, Homo sapiens
gtgaggcaggtaatg

SEQ ID NO: 28130 - DNA, 15 bp, Homo sapiens
ggtgaggcaggtaat

SEQ ID NO: 28131 - DNA, 15 bp, Homo sapiens
aggtgaggcaggtaa

SEQ ID NO: 28132 - DNA, 15 bp, Homo sapiens
aaggtgaggcaggta

SEQ ID NO: 28133 - DNA, 15 bp, Homo sapiens
aaaggtgaggcaggt

SEQ ID NO: 28134 - DNA, 15 bp, Homo sapiens
aaaaggtgaggcagg

SEQ ID NO: 28135 - DNA, 15 bp, Homo sapiens
caaaaggtgaggcag

SEQ ID NO: 28136 - DNA, 15 bp, Homo sapiens
gcaaaaggtgaggca

SEQ ID NO: 28137 - DNA, 15 bp, Homo sapiens
agcaaaaggtgaggc

SEQ ID NO: 28138 - DNA, 15 bp, Homo sapiens
gagcaaaaggtgagg

SEQ ID NO: 28139 - DNA, 15 bp, Homo sapiens
tgagcaaaaggtgag

SEQ ID NO: 28140 - DNA, 15 bp, Homo sapiens
atgagcaaaaggtga

SEQ ID NO: 28141 - DNA, 15 bp, Homo sapiens
catgagcaaaaggtg

SEQ ID NO: 28142 - DNA, 15 bp, Homo sapiens
acatgagcaaaaggt

SEQ ID NO: 28143 - DNA, 15 bp, Homo sapiens
tacatgagcaaaagg

SEQ ID NO: 28144 - DNA, 15 bp, Homo sapiens
ttacatgagcaaaag

SEQ ID NO: 28145 - DNA, 15 bp, Homo sapiens
tttacatgagcaaaa

SEQ ID NO: 28146 - DNA, 15 bp, Homo sapiens
gtttacatgagcaaa

SEQ ID NO: 28147 - DNA, 15 bp, Homo sapiens
agtttacatgagcaa

SEQ ID NO: 28148 - DNA, 15 bp, Homo sapiens
gagtttacatgagca

SEQ ID NO: 28149 - DNA, 15 bp, Homo sapiens
agagtttacatgagc

SEQ ID NO: 28150 - DNA, 15 bp, Homo sapiens
tagagtttacatgag

SEQ ID NO: 28151 - DNA, 15 bp, Homo sapiens
atagagtttacatga

SEQ ID NO: 28152 - DNA, 15 bp, Homo sapiens
aatagagtttacatg

SEQ ID NO: 28153 - DNA, 15 bp, Homo sapiens
gaatagagtttacat

SEQ ID NO: 28154 - DNA, 15 bp, Homo sapiens
ggaatagagtttaca

SEQ ID NO: 28155 - DNA, 15 bp, Homo sapiens
tggaatagagtttac

SEQ ID NO: 28156 - DNA, 15 bp, Homo sapiens
ctggaatagagttta

SEQ ID NO: 28157 - DNA, 15 bp, Homo sapiens
gctggaatagagttt

SEQ ID NO: 28158 - DNA, 15 bp, Homo sapiens
ggctggaatagagtt

SEQ ID NO: 28159 - DNA, 15 bp, Homo sapiens
tggctggaatagagt

SEQ ID NO: 28160 - DNA, 15 bp, Homo sapiens
gtggctggaatagag

SEQ ID NO: 28161 - DNA, 15 bp, Homo sapiens
cgtggctggaataga

SEQ ID NO: 28162 - DNA, 15 bp, Homo sapiens
acgtggctggaatag

SEQ ID NO: 28163 - DNA, 15 bp, Homo sapiens
aacgtggctggaata

SEQ ID NO: 28164 - DNA, 15 bp, Homo sapiens
caacgtggctggaat

SEQ ID NO: 28165 - DNA, 15 bp, Homo sapiens
ccaacgtggctggaa

SEQ ID NO: 28166 - DNA, 15 bp, Homo sapiens
gccaacgtggctgga

SEQ ID NO: 28167 - DNA, 15 bp, Homo sapiens
tgccaacgtggctgg

SEQ ID NO: 28168 - DNA, 15 bp, Homo sapiens
gtgccaacgtggctg

SEQ ID NO: 28169 - DNA, 15 bp, Homo sapiens
agtgccaacgtggct

SEQ ID NO: 28170 - DNA, 15 bp, Homo sapiens
gagtgccaacgtggc

SEQ ID NO: 28171 - DNA, 15 bp, Homo sapiens
ggagtgccaacgtgg

SEQ ID NO: 28172 - DNA, 15 bp, Homo sapiens
aggagtgccaacgtg

SEQ ID NO: 28173 - DNA, 15 bp, Homo sapiens
aaggagtgccaacgt

SEQ ID NO: 28174 - DNA, 15 bp, Homo sapiens
aaaggagtgccaacg

SEQ ID NO: 28175 - DNA, 15 bp, Homo sapiens
taaaggagtgccaac

SEQ ID NO: 28176 - DNA, 15 bp, Homo sapiens
gtaaaggagtgccaa

SEQ ID NO: 28177 - DNA, 15 bp, Homo sapiens
ggtaaaggagtgcca

SEQ ID NO: 28178 - DNA, 15 bp, Homo sapiens
tggtaaaggagtgcc

SEQ ID NO: 28179 - DNA, 15 bp, Homo sapiens
atggtaaaggagtgc

SEQ ID NO: 28180 - DNA, 15 bp, Homo sapiens
aatggtaaaggagtg

SEQ ID NO: 28181 - DNA, 15 bp, Homo sapiens
gaatggtaaaggagt

SEQ ID NO: 28182 - DNA, 15 bp, Homo sapiens
ggaatggtaaaggag

SEQ ID NO: 28183 - DNA, 15 bp, Homo sapiens
tggaatggtaaagga

SEQ ID NO: 28184 - DNA, 15 bp, Homo sapiens
ctggaatggtaaagg

SEQ ID NO: 28185 - DNA, 15 bp, Homo sapiens
cctggaatggtaaag

SEQ ID NO: 28186 - DNA, 15 bp, Homo sapiens
tcctggaatggtaaa

SEQ ID NO: 28187 - DNA, 15 bp, Homo sapiens
gtcctggaatggtaa

SEQ ID NO: 28188 - DNA, 15 bp, Homo sapiens
agtcctggaatggta

SEQ ID NO: 28189 - DNA, 15 bp, Homo sapiens
aagtcctggaatggt

SEQ ID NO: 28190 - DNA, 15 bp, Homo sapiens
caagtcctggaatgg

SEQ ID NO: 28191 - DNA, 15 bp, Homo sapiens
gcaagtcctggaatg

SEQ ID NO: 28192 - DNA, 15 bp, Homo sapiens
ggcaagtcctggaat

SEQ ID NO: 28193 - DNA, 15 bp, Homo sapiens
tggcaagtcctggaa

SEQ ID NO: 28194 - DNA, 15 bp, Homo sapiens
ctggcaagtcctgga

SEQ ID NO: 28195 - DNA, 15 bp, Homo sapiens
cctggcaagtcctgg

SEQ ID NO: 28196 - DNA, 15 bp, Homo sapiens
acctggcaagtcctg

SEQ ID NO: 28197 - DNA, 15 bp, Homo sapiens
aacctggcaagtcct

SEQ ID NO: 28198 - DNA, 15 bp, Homo sapiens
caacctggcaagtcc

SEQ ID NO: 28199 - DNA, 15 bp, Homo sapiens
gcaacctggcaagtc

SEQ ID NO: 28200 - DNA, 15 bp, Homo sapiens
tgcaacctggcaagt

SEQ ID NO: 28201 - DNA, 15 bp, Homo sapiens
gtgcaacctggcaag

SEQ ID NO: 28202 - DNA, 15 bp, Homo sapiens
agtgcaacctggcaa

SEQ ID NO: 28203 - DNA, 15 bp, Homo sapiens
aagtgcaacctggca

SEQ ID NO: 28204 - DNA, 15 bp, Homo sapiens
gaagtgcaacctggc

SEQ ID NO: 28205 - DNA, 15 bp, Homo sapiens
ggaagtgcaacctgg

SEQ ID NO: 28206 - DNA, 15 bp, Homo sapiens
cggaagtgcaacctg

SEQ ID NO: 28207 - DNA, 15 bp, Homo sapiens
acggaagtgcaacct

SEQ ID NO: 28208 - DNA, 15 bp, Homo sapiens
aacggaagtgcaacc

SEQ ID NO: 28209 - DNA, 15 bp, Homo sapiens
gaacggaagtgcaac

SEQ ID NO: 28210 - DNA, 15 bp, Homo sapiens
agaacggaagtgcaa

SEQ ID NO: 28211 - DNA, 15 bp, Homo sapiens
gagaacggaagtgca

SEQ ID NO: 28212 - DNA, 15 bp, Homo sapiens
agagaacggaagtgc

SEQ ID NO: 28213 - DNA, 15 bp, Homo sapiens
cagagaacggaagtg

SEQ ID NO: 28214 - DNA, 15 bp, Homo sapiens
gcagagaacggaagt

SEQ ID NO: 28215 - DNA, 15 bp, Homo sapiens
ggcagagaacggaag

SEQ ID NO: 28216 - DNA, 15 bp, Homo sapiens
aggcagagaacggaa

SEQ ID NO: 28217 - DNA, 15 bp, Homo sapiens
caggcagagaacgga

SEQ ID NO: 28218 - DNA, 15 bp, Homo sapiens
ccaggcagagaacgg

SEQ ID NO: 28219 - DNA, 15 bp, Homo sapiens
accaggcagagaacg

SEQ ID NO: 28220 - DNA, 15 bp, Homo sapiens
caccaggcagagaac

SEQ ID NO: 28221 - DNA, 15 bp, Homo sapiens
ccaccaggcagagaa

SEQ ID NO: 28222 - DNA, 15 bp, Homo sapiens
cccaccaggcagaga

SEQ ID NO: 28223 - DNA, 15 bp, Homo sapiens
acccaccaggcagag

SEQ ID NO: 28224 - DNA, 15 bp, Homo sapiens
gacccaccaggcaga

SEQ ID NO: 28225 - DNA, 15 bp, Homo sapiens
agacccaccaggcag

SEQ ID NO: 28226 - DNA, 15 bp, Homo sapiens
aagacccaccaggca

SEQ ID NO: 28227 - DNA, 15 bp, Homo sapiens
gaagacccaccaggc

SEQ ID NO: 28228 - DNA, 15 bp, Homo sapiens
tgaagacccaccagg

SEQ ID NO: 28229 - DNA, 15 bp, Homo sapiens
gtgaagacccaccag

SEQ ID NO: 28230 - DNA, 15 bp, Homo sapiens
ggtgaagacccacca

SEQ ID NO: 28231 - DNA, 15 bp, Homo sapiens
tggtgaagacccacc

SEQ ID NO: 28232 - DNA, 15 bp, Homo sapiens
gtggtgaagacccac

SEQ ID NO: 28233 - DNA, 15 bp, Homo sapiens
ggtggtgaagaccca

SEQ ID NO: 28234 - DNA, 15 bp, Homo sapiens
tggtggtgaagaccc

SEQ ID NO: 28235 - DNA, 15 bp, Homo sapiens
gtggtggtgaagacc

SEQ ID NO: 28236 - DNA, 15 bp, Homo sapiens
ggtggtggtgaagac

SEQ ID NO: 28237 - DNA, 15 bp, Homo sapiens
gggtggtggtgaaga

SEQ ID NO: 28238 - DNA, 15 bp, Homo sapiens
tgggtggtggtgaag

SEQ ID NO: 28239 - DNA, 15 bp, Homo sapiens
gtgggtggtggtgaa

SEQ ID NO: 28240 - DNA, 15 bp, Homo sapiens
agtgggtggtggtga

SEQ ID NO: 28241 - DNA, 15 bp, Homo sapiens
cagtgggtggtggtg

SEQ ID NO: 28242 - DNA, 15 bp, Homo sapiens
ccagtgggtggtggt

SEQ ID NO: 28243 - DNA, 15 bp, Homo sapiens
cccagtgggtggtgg

SEQ ID NO: 28244 - DNA, 15 bp, Homo sapiens
acccagtgggtggtg

SEQ ID NO: 28245 - DNA, 15 bp, Homo sapiens
aacccagtgggtggt

SEQ ID NO: 28246 - DNA, 15 bp, Homo sapiens
gaacccagtgggtgg

SEQ ID NO: 28247 - DNA, 15 bp, Homo sapiens
tgaacccagtgggtg

SEQ ID NO: 28248 - DNA, 15 bp, Homo sapiens
gtgaacccagtgggt

SEQ ID NO: 28249 - DNA, 15 bp, Homo sapiens
tgtgaacccagtggg

SEQ ID NO: 28250 - DNA, 15 bp, Homo sapiens
gtgtgaacccagtgg

SEQ ID NO: 28251 - DNA, 15 bp, Homo sapiens
tgtgtgaacccagtg

SEQ ID NO: 28252 - DNA, 15 bp, Homo sapiens
gtgtgtgaacccagt

SEQ ID NO: 28253 - DNA, 15 bp, Homo sapiens
tgtgtgtgaacccag

SEQ ID NO: 28254 - DNA, 15 bp, Homo sapiens
atgtgtgtgaaccca

SEQ ID NO: 28255 - DNA, 15 bp, Homo sapiens
gatgtgtgtgaaccc

SEQ ID NO: 28256 - DNA, 15 bp, Homo sapiens
agatgtgtgtgaacc

SEQ ID NO: 28257 - DNA, 15 bp, Homo sapiens
aagatgtgtgtgaac

SEQ ID NO: 28258 - DNA, 15 bp, Homo sapiens
aaagatgtgtgtgaa

SEQ ID NO: 28259 - DNA, 15 bp, Homo sapiens
aaaagatgtgtgtga

SEQ ID NO: 28260 - DNA, 15 bp, Homo sapiens
gaaaagatgtgtgtg

SEQ ID NO: 28261 - DNA, 15 bp, Homo sapiens
tgaaaagatgtgtgt

SEQ ID NO: 28262 - DNA, 15 bp, Homo sapiens
ctgaaaagatgtgtg

SEQ ID NO: 28263 - DNA, 15 bp, Homo sapiens
cctgaaaagatgtgt

SEQ ID NO: 28264 - DNA, 15 bp, Homo sapiens
gcctgaaaagatgtg

SEQ ID NO: 28265 - DNA, 15 bp, Homo sapiens
ggcctgaaaagatgt

SEQ ID NO: 28266 - DNA, 15 bp, Homo sapiens
gggcctgaaaagatg

SEQ ID NO: 28267 - DNA, 15 bp, Homo sapiens
ggggcctgaaaagat

SEQ ID NO: 28268 - DNA, 15 bp, Homo sapiens
tggggcctgaaaaga

SEQ ID NO: 28269 - DNA, 15 bp, Homo sapiens
atggggcctgaaaag

SEQ ID NO: 28270 - DNA, 15 bp, Homo sapiens
catggggcctgaaaa

SEQ ID NO: 28271 - DNA, 15 bp, Homo sapiens
ccatggggcctgaaa

SEQ ID NO: 28272 - DNA, 15 bp, Homo sapiens
cccatggggcctgaa

SEQ ID NO: 28273 - DNA, 15 bp, Homo sapiens
ccccatggggcctga

SEQ ID NO: 28274 - DNA, 15 bp, Homo sapiens
gccccatggggcctg

SEQ ID NO: 28275 - DNA, 15 bp, Homo sapiens
ggccccatggggcct

SEQ ID NO: 28276 - DNA, 15 bp, Homo sapiens
tggccccatggggcc

SEQ ID NO: 28277 - DNA, 15 bp, Homo sapiens
atggccccatggggc

SEQ ID NO: 28278 - DNA, 15 bp, Homo sapiens
gatggccccatgggg

SEQ ID NO: 28279 - DNA, 15 bp, Homo sapiens
agatggccccatggg

SEQ ID NO: 28280 - DNA, 15 bp, Homo sapiens
aagatggccccatgg

SEQ ID NO: 28281 - DNA, 15 bp, Homo sapiens
aaagatggccccatg

SEQ ID NO: 28282 - DNA, 15 bp, Homo sapiens
taaagatggccccat

SEQ ID NO: 28283 - DNA, 15 bp, Homo sapiens
ataaagatggcccca

SEQ ID NO: 28284 - DNA, 15 bp, Homo sapiens
aataaagatggcccc

SEQ ID NO: 28285 - DNA, 15 bp, Homo sapiens
gaataaagatggccc

SEQ ID NO: 28286 - DNA, 15 bp, Homo sapiens
tgaataaagatggcc

SEQ ID NO: 28287 - DNA, 15 bp, Homo sapiens
ttgaataaagatggc

SEQ ID NO: 28288 - DNA, 15 bp, Homo sapiens
tttgaataaagatgg

SEQ ID NO: 28289 - DNA, 15 bp, Homo sapiens
atttgaataaagatg

SEQ ID NO: 28290 - DNA, 15 bp, Homo sapiens
catttgaataaagat

SEQ ID NO: 28291 - DNA, 15 bp, Homo sapiens
acatttgaataaaga

SEQ ID NO: 28292 - DNA, 15 bp, Homo sapiens
gacatttgaataaag

SEQ ID NO: 28293 - DNA, 15 bp, Homo sapiens
tgacatttgaataaa

SEQ ID NO: 28294 - DNA, 15 bp, Homo sapiens
gtgacatttgaataa

SEQ ID NO: 28295 - DNA, 15 bp, Homo sapiens
ggtgacatttgaata

SEQ ID NO: 28296 - DNA, 15 bp, Homo sapiens
cggtgacatttgaat

SEQ ID NO: 28297 - DNA, 15 bp, Homo sapiens
gcggtgacatttgaa

SEQ ID NO: 28298 - DNA, 15 bp, Homo sapiens
ggcggtgacatttga

SEQ ID NO: 28299 - DNA, 15 bp, Homo sapiens
aggcggtgacatttg

SEQ ID NO: 28300 - DNA, 15 bp, Homo sapiens
aaggcggtgacattt

SEQ ID NO: 28301 - DNA, 15 bp, Homo sapiens
gaaggcggtgacatt

SEQ ID NO: 28302 - DNA, 15 bp, Homo sapiens
agaaggcggtgacat

SEQ ID NO: 28303 - DNA, 15 bp, Homo sapiens
cagaaggcggtgaca

SEQ ID NO: 28304 - DNA, 15 bp, Homo sapiens
ccagaaggcggtgac

SEQ ID NO: 28305 - DNA, 15 bp, Homo sapiens
gccagaaggcggtga

SEQ ID NO: 28306 - DNA, 15 bp, Homo sapiens
ggccagaaggcggtg

SEQ ID NO: 28307 - DNA, 15 bp, Homo sapiens
tggccagaaggcggt

SEQ ID NO: 28308 - DNA, 15 bp, Homo sapiens
gtggccagaaggcgg

SEQ ID NO: 28309 - DNA, 15 bp, Homo sapiens
agtggccagaaggcg

SEQ ID NO: 28310 - DNA, 15 bp, Homo sapiens
aagtggccagaaggc

SEQ ID NO: 28311 - DNA, 15 bp, Homo sapiens
aaagtggccagaagg

SEQ ID NO: 28312 - DNA, 15 bp, Homo sapiens
taaagtggccagaag

SEQ ID NO: 28313 - DNA, 15 bp, Homo sapiens
ataaagtggccagaa

SEQ ID NO: 28314 - DNA, 15 bp, Homo sapiens
cataaagtggccaga

SEQ ID NO: 28315 - DNA, 15 bp, Homo sapiens
acataaagtggccag

SEQ ID NO: 28316 - DNA, 15 bp, Homo sapiens
tacataaagtggcca

SEQ ID NO: 28317 - DNA, 15 bp, Homo sapiens
ttacataaagtggcc

SEQ ID NO: 28318 - DNA, 15 bp, Homo sapiens
gttacataaagtggc

SEQ ID NO: 28319 - DNA, 15 bp, Homo sapiens
tgttacataaagtgg

SEQ ID NO: 28320 - DNA, 15 bp, Homo sapiens
ctgttacataaagtg

SEQ ID NO: 28321 - DNA, 15 bp, Homo sapiens
actgttacataaagt

SEQ ID NO: 28322 - DNA, 15 bp, Homo sapiens
aactgttacataaag

SEQ ID NO: 28323 - DNA, 15 bp, Homo sapiens
gaactgttacataaa

SEQ ID NO: 28324 - DNA, 15 bp, Homo sapiens
tgaactgttacataa

SEQ ID NO: 28325 - DNA, 15 bp, Homo sapiens
atgaactgttacata

SEQ ID NO: 28326 - DNA, 15 bp, Homo sapiens
tatgaactgttacat

SEQ ID NO: 28327 - DNA, 15 bp, Homo sapiens
atatgaactgttaca

SEQ ID NO: 28328 - DNA, 15 bp, Homo sapiens
catatgaactgttac

SEQ ID NO: 28329 - DNA, 15 bp, Homo sapiens
acatatgaactgtta

SEQ ID NO: 28330 - DNA, 15 bp, Homo sapiens
tacatatgaactgtt

SEQ ID NO: 28331 - DNA, 15 bp, Homo sapiens
atacatatgaactgt

SEQ ID NO: 28332 - DNA, 15 bp, Homo sapiens
catacatatgaactg

SEQ ID NO: 28333 - DNA, 15 bp, Homo sapiens
acatacatatgaact

SEQ ID NO: 28334 - DNA, 15 bp, Homo sapiens
tacatacatatgaac

SEQ ID NO: 28335 - DNA, 15 bp, Homo sapiens
atacatacatatgaa

SEQ ID NO: 28336 - DNA, 15 bp, Homo sapiens
catacatacatatga

SEQ ID NO: 28337 - DNA, 15 bp, Homo sapiens
gcatacatacatatg

SEQ ID NO: 28338 - DNA, 15 bp, Homo sapiens
tgcatacatacatat

SEQ ID NO: 28339 - DNA, 15 bp, Homo sapiens
ttgcatacatacata

SEQ ID NO: 28340 - DNA, 15 bp, Homo sapiens
tttgcatacatacat

SEQ ID NO: 28341 - DNA, 15 bp, Homo sapiens
atttgcatacataca

SEQ ID NO: 28342 - DNA, 15 bp, Homo sapiens
aatttgcatacatac

SEQ ID NO: 28343 - DNA, 15 bp, Homo sapiens
aaatttgcatacata

SEQ ID NO: 28344 - DNA, 15 bp, Homo sapiens
aaaatttgcatacat

SEQ ID NO: 28345 - DNA, 15 bp, Homo sapiens
gaaaatttgcataca

SEQ ID NO: 28346 - DNA, 15 bp, Homo sapiens
agaaaatttgcatac

SEQ ID NO: 28347 - DNA, 15 bp, Homo sapiens
tagaaaatttgcata

SEQ ID NO: 28348 - DNA, 15 bp, Homo sapiens
atagaaaatttgcat

SEQ ID NO: 28349 - DNA, 15 bp, Homo sapiens
gatagaaaatttgca

SEQ ID NO: 28350 - DNA, 15 bp, Homo sapiens
ggatagaaaatttgc

SEQ ID NO: 28351 - DNA, 15 bp, Homo sapiens
gggatagaaaatttg

SEQ ID NO: 28352 - DNA, 15 bp, Homo sapiens
ggggatagaaaattt

SEQ ID NO: 28353 - DNA, 15 bp, Homo sapiens
gggggatagaaaatt

SEQ ID NO: 28354 - DNA, 15 bp, Homo sapiens
agggggatagaaaat

SEQ ID NO: 28355 - DNA, 15 bp, Homo sapiens
aagggggatagaaaa

SEQ ID NO: 28356 - DNA, 15 bp, Homo sapiens
gaagggggatagaaa

SEQ ID NO: 28357 - DNA, 15 bp, Homo sapiens
ggaagggggatagaa

SEQ ID NO: 28358 - DNA, 15 bp, Homo sapiens
gggaagggggataga

SEQ ID NO: 28359 - DNA, 15 bp, Homo sapiens
agggaagggggatag

SEQ ID NO: 28360 - DNA, 15 bp, Homo sapiens
aagggaagggggata

SEQ ID NO: 28361 - DNA, 15 bp, Homo sapiens
aaagggaagggggat

SEQ ID NO: 28362 - DNA, 15 bp, Homo sapiens
aaaagggaaggggga

SEQ ID NO: 28363 - DNA, 15 bp, Homo sapiens
aaaaagggaaggggg

SEQ ID NO: 28364 - DNA, 15 bp, Homo sapiens
gaaaaagggaagggg

SEQ ID NO: 28365 - DNA, 15 bp, Homo sapiens
agaaaaagggaaggg

SEQ ID NO: 28366 - DNA, 15 bp, Homo sapiens
gagaaaaagggaagg

SEQ ID NO: 28367 - DNA, 15 bp, Homo sapiens
agagaaaaagggaag

SEQ ID NO: 28368 - DNA, 15 bp, Homo sapiens
tagagaaaaagggaa

SEQ ID NO: 28369 - DNA, 15 bp, Homo sapiens
atagagaaaaaggga

SEQ ID NO: 28370 - DNA, 15 bp, Homo sapiens
tatagagaaaaaggg

SEQ ID NO: 28371 - DNA, 15 bp, Homo sapiens
ctatagagaaaaagg

SEQ ID NO: 28372 - DNA, 15 bp, Homo sapiens
gctatagagaaaaag

SEQ ID NO: 28373 - DNA, 15 bp, Homo sapiens
tgctatagagaaaaa

SEQ ID NO: 28374 - DNA, 15 bp, Homo sapiens
gtgctatagagaaaa

SEQ ID NO: 28375 - DNA, 15 bp, Homo sapiens
agtgctatagagaaa

SEQ ID NO: 28376 - DNA, 15 bp, Homo sapiens
aagtgctatagagaa

SEQ ID NO: 28377 - DNA, 15 bp, Homo sapiens
caagtgctatagaga

SEQ ID NO: 28378 - DNA, 15 bp, Homo sapiens
acaagtgctatagag

SEQ ID NO: 28379 - DNA, 15 bp, Homo sapiens
cacaagtgctataga

SEQ ID NO: 28380 - DNA, 15 bp, Homo sapiens
acacaagtgctatag

SEQ ID NO: 28381 - DNA, 15 bp, Homo sapiens
aacacaagtgctata

SEQ ID NO: 28382 - DNA, 15 bp, Homo sapiens
taacacaagtgctat

SEQ ID NO: 28383 - DNA, 15 bp, Homo sapiens
gtaacacaagtgcta

SEQ ID NO: 28384 - DNA, 15 bp, Homo sapiens
agtaacacaagtgct

SEQ ID NO: 28385 - DNA, 15 bp, Homo sapiens
aagtaacacaagtgc

SEQ ID NO: 28386 - DNA, 15 bp, Homo sapiens
aaagtaacacaagtg

SEQ ID NO: 28387 - DNA, 15 bp, Homo sapiens
aaaagtaacacaagt

SEQ ID NO: 28388 - DNA, 15 bp, Homo sapiens
caaaagtaacacaag

SEQ ID NO: 28389 - DNA, 15 bp, Homo sapiens
gcaaaagtaacacaa

SEQ ID NO: 28390 - DNA, 15 bp, Homo sapiens
tgcaaaagtaacaca

SEQ ID NO: 28391 - DNA, 15 bp, Homo sapiens
atgcaaaagtaacac

SEQ ID NO: 28392 - DNA, 15 bp, Homo sapiens
gatgcaaaagtaaca

SEQ ID NO: 28393 - DNA, 15 bp, Homo sapiens
agatgcaaaagtaac

SEQ ID NO: 28394 - DNA, 15 bp, Homo sapiens
aagatgcaaaagtaa

SEQ ID NO: 28395 - DNA, 15 bp, Homo sapiens
taagatgcaaaagta

SEQ ID NO: 28396 - DNA, 15 bp, Homo sapiens
ctaagatgcaaaagt

SEQ ID NO: 28397 - DNA, 15 bp, Homo sapiens
actaagatgcaaaag

SEQ ID NO: 28398 - DNA, 15 bp, Homo sapiens
gactaagatgcaaaa

SEQ ID NO: 28399 - DNA, 15 bp, Homo sapiens
agactaagatgcaaa

SEQ ID NO: 28400 - DNA, 15 bp, Homo sapiens
cagactaagatgcaa

SEQ ID NO: 28401 - DNA, 15 bp, Homo sapiens
acagactaagatgca

SEQ ID NO: 28402 - DNA, 15 bp, Homo sapiens
gacagactaagatgc

SEQ ID NO: 28403 - DNA, 15 bp, Homo sapiens
agacagactaagatg

SEQ ID NO: 28404 - DNA, 15 bp, Homo sapiens
gagacagactaagat

SEQ ID NO: 28405 - DNA, 15 bp, Homo sapiens
agagacagactaaga

SEQ ID NO: 28406 - DNA, 15 bp, Homo sapiens
gagagacagactaag

SEQ ID NO: 28407 - DNA, 15 bp, Homo sapiens
ggagagacagactaa

SEQ ID NO: 28408 - DNA, 15 bp, Homo sapiens
gggagagacagacta

SEQ ID NO: 28409 - DNA, 15 bp, Homo sapiens
tgggagagacagact

SEQ ID NO: 28410 - DNA, 15 bp, Homo sapiens
ttgggagagacagac

SEQ ID NO: 28411 - DNA, 15 bp, Homo sapiens
tttgggagagacaga

SEQ ID NO: 28412 - DNA, 15 bp, Homo sapiens
ttttgggagagacag

SEQ ID NO: 28413 - DNA, 15 bp, Homo sapiens
attttgggagagaca

SEQ ID NO: 28414 - DNA, 15 bp, Homo sapiens
tattttgggagagac

SEQ ID NO: 28415 - DNA, 15 bp, Homo sapiens
ctattttgggagaga

SEQ ID NO: 28416 - DNA, 15 bp, Homo sapiens
cctattttgggagag

SEQ ID NO: 28417 - DNA, 15 bp, Homo sapiens
ccctattttgggaga

SEQ ID NO: 28418 - DNA, 15 bp, Homo sapiens
cccctattttgggag

SEQ ID NO: 28419 - DNA, 15 bp, Homo sapiens
tcccctattttggga

SEQ ID NO: 28420 - DNA, 15 bp, Homo sapiens
gtcccctattttggg

SEQ ID NO: 28421 - DNA, 15 bp, Homo sapiens
tgtcccctattttgg

SEQ ID NO: 28422 - DNA, 15 bp, Homo sapiens
ttgtcccctattttg

SEQ ID NO: 28423 - DNA, 15 bp, Homo sapiens
cttgtcccctatttt

SEQ ID NO: 28424 - DNA, 15 bp, Homo sapiens
acttgtcccctattt

SEQ ID NO: 28425 - DNA, 15 bp, Homo sapiens
aacttgtcccctatt

SEQ ID NO: 28426 - DNA, 15 bp, Homo sapiens
aaacttgtcccctat

SEQ ID NO: 28427 - DNA, 15 bp, Homo sapiens
gaaacttgtccccta

SEQ ID NO: 28428 - DNA, 15 bp, Homo sapiens
tgaaacttgtcccct

SEQ ID NO: 28429 - DNA, 15 bp, Homo sapiens
atgaaacttgtcccc

SEQ ID NO: 28430 - DNA, 15 bp, Homo sapiens
catgaaacttgtccc

SEQ ID NO: 28431 - DNA, 15 bp, Homo sapiens
tcatgaaacttgtcc

SEQ ID NO: 28432 - DNA, 15 bp, Homo sapiens
ctcatgaaacttgtc

SEQ ID NO: 28433 - DNA, 15 bp, Homo sapiens
cctcatgaaacttgt

SEQ ID NO: 28434 - DNA, 15 bp, Homo sapiens
ccctcatgaaacttg

SEQ ID NO: 28435 - DNA, 15 bp, Homo sapiens
gccctcatgaaactt

SEQ ID NO: 28436 - DNA, 15 bp, Homo sapiens
tgccctcatgaaact

SEQ ID NO: 28437 - DNA, 15 bp, Homo sapiens
ttgccctcatgaaac

SEQ ID NO: 28438 - DNA, 15 bp, Homo sapiens
tttgccctcatgaaa

SEQ ID NO: 28439 - DNA, 15 bp, Homo sapiens
ttttgccctcatgaa

SEQ ID NO: 28440 - DNA, 15 bp, Homo sapiens
tttttgccctcatga

SEQ ID NO: 28441 - DNA, 15 bp, Homo sapiens
gtttttgccctcatg

SEQ ID NO: 28442 - DNA, 15 bp, Homo sapiens
ggtttttgccctcat

SEQ ID NO: 28443 - DNA, 15 bp, Homo sapiens
aggtttttgccctca

SEQ ID NO: 28444 - DNA, 15 bp, Homo sapiens
caggtttttgccctc

SEQ ID NO: 28445 - DNA, 15 bp, Homo sapiens
acaggtttttgccct

SEQ ID NO: 28446 - DNA, 15 bp, Homo sapiens
gacaggtttttgccc

SEQ ID NO: 28447 - DNA, 15 bp, Homo sapiens
agacaggtttttgcc

SEQ ID NO: 28448 - DNA, 15 bp, Homo sapiens
cagacaggtttttgc

SEQ ID NO: 28449 - DNA, 15 bp, Homo sapiens
acagacaggtttttg

SEQ ID NO: 28450 - DNA, 15 bp, Homo sapiens
aacagacaggttttt

SEQ ID NO: 28451 - DNA, 15 bp, Homo sapiens
aaacagacaggtttt

SEQ ID NO: 28452 - DNA, 15 bp, Homo sapiens
aaaacagacaggttt

SEQ ID NO: 28453 - DNA, 15 bp, Homo sapiens
caaaacagacaggtt

SEQ ID NO: 28454 - DNA, 15 bp, Homo sapiens
acaaaacagacaggt

SEQ ID NO: 28455 - DNA, 15 bp, Homo sapiens
aacaaaacagacagg

SEQ ID NO: 28456 - DNA, 15 bp, Homo sapiens
aaacaaaacagacag

SEQ ID NO: 28457 - DNA, 15 bp, Homo sapiens
taaacaaaacagaca

SEQ ID NO: 28458 - DNA, 15 bp, Homo sapiens
ataaacaaaacagac

SEQ ID NO: 28459 - DNA, 15 bp, Homo sapiens
aataaacaaaacaga

SEQ ID NO: 28460 - DNA, 15 bp, Homo sapiens
caataaacaaaacag

SEQ ID NO: 28461 - DNA, 15 bp, Homo sapiens
gcaataaacaaaaca

SEQ ID NO: 28462 - DNA, 15 bp, Homo sapiens
agcaataaacaaaac

SEQ ID NO: 28463 - DNA, 15 bp, Homo sapiens
tagcaataaacaaaa

SEQ ID NO: 28464 - DNA, 15 bp, Homo sapiens
atagcaataaacaaa

SEQ ID NO: 28465 - DNA, 15 bp, Homo sapiens
tatagcaataaacaa

SEQ ID NO: 28466 - DNA, 15 bp, Homo sapiens
atatagcaataaaca

SEQ ID NO: 28467 - DNA, 15 bp, Homo sapiens
aatatagcaataaac

SEQ ID NO: 28468 - DNA, 15 bp, Homo sapiens
gaatatagcaataaa

SEQ ID NO: 28469 - DNA, 15 bp, Homo sapiens
ggaatatagcaataa

SEQ ID NO: 28470 - DNA, 15 bp, Homo sapiens
aggaatatagcaata

SEQ ID NO: 28471 - DNA, 15 bp, Homo sapiens
taggaatatagcaat

SEQ ID NO: 28472 - DNA, 15 bp, Homo sapiens
ctaggaatatagcaa

SEQ ID NO: 28473 - DNA, 15 bp, Homo sapiens
gctaggaatatagca

SEQ ID NO: 28474 - DNA, 15 bp, Homo sapiens
tgctaggaatatagc

SEQ ID NO: 28475 - DNA, 15 bp, Homo sapiens
atgctaggaatatag

SEQ ID NO: 28476 - DNA, 15 bp, Homo sapiens
gatgctaggaatata

SEQ ID NO: 28477 - DNA, 15 bp, Homo sapiens
agatgctaggaatat

SEQ ID NO: 28478 - DNA, 15 bp, Homo sapiens
cagatgctaggaata

SEQ ID NO: 28479 - DNA, 15 bp, Homo sapiens
acagatgctaggaat

SEQ ID NO: 28480 - DNA, 15 bp, Homo sapiens
gacagatgctaggaa

SEQ ID NO: 28481 - DNA, 15 bp, Homo sapiens
tgacagatgctagga

SEQ ID NO: 28482 - DNA, 15 bp, Homo sapiens
atgacagatgctagg

SEQ ID NO: 28483 - DNA, 15 bp, Homo sapiens
catgacagatgctag

SEQ ID NO: 28484 - DNA, 15 bp, Homo sapiens
acatgacagatgcta

SEQ ID NO: 28485 - DNA, 15 bp, Homo sapiens
tacatgacagatgct

SEQ ID NO: 28486 - DNA, 15 bp, Homo sapiens
ttacatgacagatgc

SEQ ID NO: 28487 - DNA, 15 bp, Homo sapiens
attacatgacagatg

SEQ ID NO: 28488 - DNA, 15 bp, Homo sapiens
tattacatgacagat

SEQ ID NO: 28489 - DNA, 15 bp, Homo sapiens
ctattacatgacaga

SEQ ID NO: 28490 - DNA, 15 bp, Homo sapiens
cctattacatgacag

SEQ ID NO: 28491 - DNA, 15 bp, Homo sapiens
acctattacatgaca

SEQ ID NO: 28492 - DNA, 15 bp, Homo sapiens
cacctattacatgac

SEQ ID NO: 28493 - DNA, 15 bp, Homo sapiens
acacctattacatga

SEQ ID NO: 28494 - DNA, 15 bp, Homo sapiens
cacacctattacatg

SEQ ID NO: 28495 - DNA, 15 bp, Homo sapiens
gcacacctattacat

SEQ ID NO: 28496 - DNA, 15 bp, Homo sapiens
agcacacctattaca

SEQ ID NO: 28497 - DNA, 15 bp, Homo sapiens
aagcacacctattac

SEQ ID NO: 28498 - DNA, 15 bp, Homo sapiens
taagcacacctatta

SEQ ID NO: 28499 - DNA, 15 bp, Homo sapiens
gtaagcacacctatt

SEQ ID NO: 28500 - DNA, 15 bp, Homo sapiens
agtaagcacacctat

SEQ ID NO: 28501 - DNA, 15 bp, Homo sapiens
cagtaagcacaccta

SEQ ID NO: 28502 - DNA, 15 bp, Homo sapiens
gcagtaagcacacct

SEQ ID NO: 28503 - DNA, 15 bp, Homo sapiens
agcagtaagcacacc

SEQ ID NO: 28504 - DNA, 15 bp, Homo sapiens
aagcagtaagcacac

SEQ ID NO: 28505 - DNA, 15 bp, Homo sapiens
caagcagtaagcaca

SEQ ID NO: 28506 - DNA, 15 bp, Homo sapiens
acaagcagtaagcac

SEQ ID NO: 28507 - DNA, 15 bp, Homo sapiens
aacaagcagtaagca

SEQ ID NO: 28508 - DNA, 15 bp, Homo sapiens
taacaagcagtaagc

SEQ ID NO: 28509 - DNA, 15 bp, Homo sapiens
ctaacaagcagtaag

SEQ ID NO: 28510 - DNA, 15 bp, Homo sapiens
cctaacaagcagtaa

SEQ ID NO: 28511 - DNA, 15 bp, Homo sapiens
acctaacaagcagta

SEQ ID NO: 28512 - DNA, 15 bp, Homo sapiens
tacctaacaagcagt

SEQ ID NO: 28513 - DNA, 15 bp, Homo sapiens
ttacctaacaagcag

SEQ ID NO: 28514 - DNA, 15 bp, Homo sapiens
tttacctaacaagca

SEQ ID NO: 28515 - DNA, 15 bp, Homo sapiens
ttttacctaacaagc

SEQ ID NO: 28516 - DNA, 15 bp, Homo sapiens
tttttacctaacaag

SEQ ID NO: 28517 - DNA, 15 bp, Homo sapiens
ttttttacctaacaa

SEQ ID NO: 28518 - DNA, 15 bp, Homo sapiens
cttttttacctaaca

SEQ ID NO: 28519 - DNA, 15 bp, Homo sapiens
acttttttacctaac

SEQ ID NO: 28520 - DNA, 15 bp, Homo sapiens
aacttttttacctaa

SEQ ID NO: 28521 - DNA, 15 bp, Homo sapiens
gaacttttttaccta

SEQ ID NO: 28522 - DNA, 15 bp, Homo sapiens
tgaacttttttacct

SEQ ID NO: 28523 - DNA, 15 bp, Homo sapiens
ctgaacttttttacc

SEQ ID NO: 28524 - DNA, 15 bp, Homo sapiens
tctgaacttttttac

SEQ ID NO: 28525 - DNA, 15 bp, Homo sapiens
ttctgaactttttta

SEQ ID NO: 28526 - DNA, 15 bp, Homo sapiens
tttctgaactttttt

SEQ ID NO: 28527 - DNA, 15 bp, Homo sapiens
atttctgaacttttt

SEQ ID NO: 28528 - DNA, 15 bp, Homo sapiens
aatttctgaactttt

SEQ ID NO: 28529 - DNA, 15 bp, Homo sapiens
caatttctgaacttt

SEQ ID NO: 28530 - DNA, 15 bp, Homo sapiens
gcaatttctgaactt

SEQ ID NO: 28531 - DNA, 15 bp, Homo sapiens
ggcaatttctgaact

SEQ ID NO: 28532 - DNA, 15 bp, Homo sapiens
tggcaatttctgaac

SEQ ID NO: 28533 - DNA, 15 bp, Homo sapiens
gtggcaatttctgaa

SEQ ID NO: 28534 - DNA, 15 bp, Homo sapiens
ggtggcaatttctga

SEQ ID NO: 28535 - DNA, 15 bp, Homo sapiens
gggtggcaatttctg

SEQ ID NO: 28536 - DNA, 15 bp, Homo sapiens
tgggtggcaatttct

SEQ ID NO: 28537 - DNA, 15 bp, Homo sapiens
ctgggtggcaatttc

SEQ ID NO: 28538 - DNA, 15 bp, Homo sapiens
actgggtggcaattt

SEQ ID NO: 28539 - DNA, 15 bp, Homo sapiens
tactgggtggcaatt

SEQ ID NO: 28540 - DNA, 15 bp, Homo sapiens
ctactgggtggcaat

SEQ ID NO: 28541 - DNA, 15 bp, Homo sapiens
actactgggtggcaa

SEQ ID NO: 28542 - DNA, 15 bp, Homo sapiens
tactactgggtggca

SEQ ID NO: 28543 - DNA, 15 bp, Homo sapiens
atactactgggtggc

SEQ ID NO: 28544 - DNA, 15 bp, Homo sapiens
gatactactgggtgg

SEQ ID NO: 28545 - DNA, 15 bp, Homo sapiens
ggatactactgggtg

SEQ ID NO: 28546 - DNA, 15 bp, Homo sapiens
tggatactactgggt

SEQ ID NO: 28547 - DNA, 15 bp, Homo sapiens
atggatactactggg

SEQ ID NO: 28548 - DNA, 15 bp, Homo sapiens
tatggatactactgg

SEQ ID NO: 28549 - DNA, 15 bp, Homo sapiens
atatggatactactg

SEQ ID NO: 28550 - DNA, 15 bp, Homo sapiens
aatatggatactact

SEQ ID NO: 28551 - DNA, 15 bp, Homo sapiens
aaatatggatactac

SEQ ID NO: 28552 - DNA, 15 bp, Homo sapiens
caaatatggatacta

SEQ ID NO: 28553 - DNA, 15 bp, Homo sapiens
acaaatatggatact

SEQ ID NO: 28554 - DNA, 15 bp, Homo sapiens
aacaaatatggatac

SEQ ID NO: 28555 - DNA, 15 bp, Homo sapiens
gaacaaatatggata

SEQ ID NO: 28556 - DNA, 15 bp, Homo sapiens
ggaacaaatatggat

SEQ ID NO: 28557 - DNA, 15 bp, Homo sapiens
gggaacaaatatgga

SEQ ID NO: 28558 - DNA, 15 bp, Homo sapiens
agggaacaaatatgg

SEQ ID NO: 28559 - DNA, 15 bp, Homo sapiens
aagggaacaaatatg

SEQ ID NO: 28560 - DNA, 15 bp, Homo sapiens
aaagggaacaaatat

SEQ ID NO: 28561 - DNA, 15 bp, Homo sapiens
caaagggaacaaata

SEQ ID NO: 28562 - DNA, 15 bp, Homo sapiens
acaaagggaacaaat

SEQ ID NO: 28563 - DNA, 15 bp, Homo sapiens
tacaaagggaacaaa

SEQ ID NO: 28564 - DNA, 15 bp, Homo sapiens
ctacaaagggaacaa

SEQ ID NO: 28565 - DNA, 15 bp, Homo sapiens
cctacaaagggaaca

SEQ ID NO: 28566 - DNA, 15 bp, Homo sapiens
acctacaaagggaac

SEQ ID NO: 28567 - DNA, 15 bp, Homo sapiens
gacctacaaagggaa

SEQ ID NO: 28568 - DNA, 15 bp, Homo sapiens
tgacctacaaaggga

SEQ ID NO: 28569 - DNA, 15 bp, Homo sapiens
atgacctacaaaggg

SEQ ID NO: 28570 - DNA, 15 bp, Homo sapiens
aatgacctacaaagg

SEQ ID NO: 28571 - DNA, 15 bp, Homo sapiens
taatgacctacaaag

SEQ ID NO: 28572 - DNA, 15 bp, Homo sapiens
ttaatgacctacaaa

SEQ ID NO: 28573 - DNA, 15 bp, Homo sapiens
tttaatgacctacaa

SEQ ID NO: 28574 - DNA, 15 bp, Homo sapiens
gtttaatgacctaca

SEQ ID NO: 28575 - DNA, 15 bp, Homo sapiens
tgtttaatgacctac

SEQ ID NO: 28576 - DNA, 15 bp, Homo sapiens
ctgtttaatgaccta

SEQ ID NO: 28577 - DNA, 15 bp, Homo sapiens
gctgtttaatgacct

SEQ ID NO: 28578 - DNA, 15 bp, Homo sapiens
agctgtttaatgacc

SEQ ID NO: 28579 - DNA, 15 bp, Homo sapiens
cagctgtttaatgac

SEQ ID NO: 28580 - DNA, 15 bp, Homo sapiens
tcagctgtttaatga

SEQ ID NO: 28581 - DNA, 15 bp, Homo sapiens
atcagctgtttaatg

SEQ ID NO: 28582 - DNA, 15 bp, Homo sapiens
catcagctgtttaat

SEQ ID NO: 28583 - DNA, 15 bp, Homo sapiens
tcatcagctgtttaa

SEQ ID NO: 28584 - DNA, 15 bp, Homo sapiens
ttcatcagctgttta

SEQ ID NO: 28585 - DNA, 15 bp, Homo sapiens
tttcatcagctgttt

SEQ ID NO: 28586 - DNA, 15 bp, Homo sapiens
ttttcatcagctgtt

SEQ ID NO: 28587 - DNA, 15 bp, Homo sapiens
tttttcatcagctgt

SEQ ID NO: 28588 - DNA, 15 bp, Homo sapiens
ctttttcatcagctg

SEQ ID NO: 28589 - DNA, 15 bp, Homo sapiens
cctttttcatcagct

SEQ ID NO: 28590 - DNA, 15 bp, Homo sapiens
tcctttttcatcagc

SEQ ID NO: 28591 - DNA, 15 bp, Homo sapiens
ttcctttttcatcag

SEQ ID NO: 28592 - DNA, 15 bp, Homo sapiens
attcctttttcatca

SEQ ID NO: 28593 - DNA, 15 bp, Homo sapiens
aattcctttttcatc

SEQ ID NO: 28594 - DNA, 15 bp, Homo sapiens
gaattcctttttcat

SEQ ID NO: 28595 - DNA, 15 bp, Homo sapiens
tgaattcctttttca

SEQ ID NO: 28596 - DNA, 15 bp, Homo sapiens
gtgaattcctttttc

SEQ ID NO: 28597 - DNA, 15 bp, Homo sapiens
agtgaattccttttt

SEQ ID NO: 28598 - DNA, 15 bp, Homo sapiens
gagtgaattcctttt

SEQ ID NO: 28599 - DNA, 15 bp, Homo sapiens
agagtgaattccttt

SEQ ID NO: 28600 - DNA, 15 bp, Homo sapiens
tagagtgaattcctt

SEQ ID NO: 28601 - DNA, 15 bp, Homo sapiens
ctagagtgaattcct

SEQ ID NO: 28602 - DNA, 15 bp, Homo sapiens
tctagagtgaattcc

SEQ ID NO: 28603 - DNA, 15 bp, Homo sapiens
ctctagagtgaattc

SEQ ID NO: 28604 - DNA, 15 bp, Homo sapiens
actctagagtgaatt

SEQ ID NO: 28605 - DNA, 15 bp, Homo sapiens
aactctagagtgaat

SEQ ID NO: 28606 - DNA, 15 bp, Homo sapiens
aaactctagagtgaa

SEQ ID NO: 28607 - DNA, 15 bp, Homo sapiens
aaaactctagagtga

SEQ ID NO: 28608 - DNA, 15 bp, Homo sapiens
gaaaactctagagtg

SEQ ID NO: 28609 - DNA, 15 bp, Homo sapiens
tgaaaactctagagt

SEQ ID NO: 28610 - DNA, 15 bp, Homo sapiens
gtgaaaactctagag

SEQ ID NO: 28611 - DNA, 15 bp, Homo sapiens
cgtgaaaactctaga

SEQ ID NO: 28612 - DNA, 15 bp, Homo sapiens
acgtgaaaactctag

SEQ ID NO: 28613 - DNA, 15 bp, Homo sapiens
cacgtgaaaactcta

SEQ ID NO: 28614 - DNA, 15 bp, Homo sapiens
tcacgtgaaaactct

SEQ ID NO: 28615 - DNA, 15 bp, Homo sapiens
gtcacgtgaaaactc

SEQ ID NO: 28616 - DNA, 15 bp, Homo sapiens
tgtcacgtgaaaact

SEQ ID NO: 28617 - DNA, 15 bp, Homo sapiens
ctgtcacgtgaaaac

SEQ ID NO: 28618 - DNA, 15 bp, Homo sapiens
tctgtcacgtgaaaa

SEQ ID NO: 28619 - DNA, 15 bp, Homo sapiens
ttctgtcacgtgaaa

SEQ ID NO: 28620 - DNA, 15 bp, Homo sapiens
tttctgtcacgtgaa

SEQ ID NO: 28621 - DNA, 15 bp, Homo sapiens
ctttctgtcacgtga

SEQ ID NO: 28622 - DNA, 15 bp, Homo sapiens
actttctgtcacgtg

SEQ ID NO: 28623 - DNA, 15 bp, Homo sapiens
gactttctgtcacgt

SEQ ID NO: 28624 - DNA, 15 bp, Homo sapiens
tgactttctgtcacg

SEQ ID NO: 28625 - DNA, 15 bp, Homo sapiens
ttgactttctgtcac

SEQ ID NO: 28626 - DNA, 15 bp, Homo sapiens
attgactttctgtca

SEQ ID NO: 28627 - DNA, 15 bp, Homo sapiens
cattgactttctgtc

SEQ ID NO: 28628 - DNA, 15 bp, Homo sapiens
acattgactttctgt

SEQ ID NO: 28629 - DNA, 15 bp, Homo sapiens
gacattgactttctg

SEQ ID NO: 28630 - DNA, 15 bp, Homo sapiens
cgacattgactttct

SEQ ID NO: 28631 - DNA, 15 bp, Homo sapiens
ccgacattgactttc

SEQ ID NO: 28632 - DNA, 15 bp, Homo sapiens
accgacattgacttt

SEQ ID NO: 28633 - DNA, 15 bp, Homo sapiens
aaccgacattgactt

SEQ ID NO: 28634 - DNA, 15 bp, Homo sapiens
aaaccgacattgact

SEQ ID NO: 28635 - DNA, 15 bp, Homo sapiens
taaaccgacattgac

SEQ ID NO: 28636 - DNA, 15 bp, Homo sapiens
gtaaaccgacattga

SEQ ID NO: 28637 - DNA, 15 bp, Homo sapiens
agtaaaccgacattg

SEQ ID NO: 28638 - DNA, 15 bp, Homo sapiens
cagtaaaccgacatt

SEQ ID NO: 28639 - DNA, 15 bp, Homo sapiens
acagtaaaccgacat

SEQ ID NO: 28640 - DNA, 15 bp, Homo sapiens
tacagtaaaccgaca

SEQ ID NO: 28641 - DNA, 15 bp, Homo sapiens
gtacagtaaaccgac

SEQ ID NO: 28642 - DNA, 15 bp, Homo sapiens
tgtacagtaaaccga

SEQ ID NO: 28643 - DNA, 15 bp, Homo sapiens
gtgtacagtaaaccg

SEQ ID NO: 28644 - DNA, 15 bp, Homo sapiens
ggtgtacagtaaacc

SEQ ID NO: 28645 - DNA, 15 bp, Homo sapiens
tggtgtacagtaaac

SEQ ID NO: 28646 - DNA, 15 bp, Homo sapiens
ttggtgtacagtaaa

SEQ ID NO: 28647 - DNA, 15 bp, Homo sapiens
tttggtgtacagtaa

SEQ ID NO: 28648 - DNA, 15 bp, Homo sapiens
atttggtgtacagta

SEQ ID NO: 28649 - DNA, 15 bp, Homo sapiens
tatttggtgtacagt

SEQ ID NO: 28650 - DNA, 15 bp, Homo sapiens
ttatttggtgtacag

SEQ ID NO: 28651 - DNA, 15 bp, Homo sapiens
tttatttggtgtaca

SEQ ID NO: 28652 - DNA, 15 bp, Homo sapiens
gtttatttggtgtac

SEQ ID NO: 28653 - DNA, 15 bp, Homo sapiens
ggtttatttggtgta

SEQ ID NO: 28654 - DNA, 15 bp, Homo sapiens
tggtttatttggtgt

SEQ ID NO: 28655 - DNA, 15 bp, Homo sapiens
ttggtttatttggtg

SEQ ID NO: 28656 - DNA, 15 bp, Homo sapiens
cttggtttatttggt

SEQ ID NO: 28657 - DNA, 15 bp, Homo sapiens
gcttggtttatttgg

SEQ ID NO: 28658 - DNA, 15 bp, Homo sapiens
tgcttggtttatttg

SEQ ID NO: 28659 - DNA, 15 bp, Homo sapiens
ctgcttggtttattt

SEQ ID NO: 28660 - DNA, 15 bp, Homo sapiens
cctgcttggtttatt

SEQ ID NO: 28661 - DNA, 15 bp, Homo sapiens
tcctgcttggtttat

SEQ ID NO: 28662 - DNA, 15 bp, Homo sapiens
gtcctgcttggttta

SEQ ID NO: 28663 - DNA, 15 bp, Homo sapiens
tgtcctgcttggttt

SEQ ID NO: 28664 - DNA, 15 bp, Homo sapiens
atgtcctgcttggtt

SEQ ID NO: 28665 - DNA, 15 bp, Homo sapiens
gatgtcctgcttggt

SEQ ID NO: 28666 - DNA, 15 bp, Homo sapiens
tgatgtcctgcttgg

SEQ ID NO: 28667 - DNA, 15 bp, Homo sapiens
ttgatgtcctgcttg

SEQ ID NO: 28668 - DNA, 15 bp, Homo sapiens
attgatgtcctgctt

SEQ ID NO: 28669 - DNA, 15 bp, Homo sapiens
cattgatgtcctgct

SEQ ID NO: 28670 - DNA, 15 bp, Homo sapiens
tcattgatgtcctgc

SEQ ID NO: 28671 - DNA, 15 bp, Homo sapiens
ctcattgatgtcctg

SEQ ID NO: 28672 - DNA, 15 bp, Homo sapiens
gctcattgatgtcct

SEQ ID NO: 28673 - DNA, 15 bp, Homo sapiens
tgctcattgatgtcc

SEQ ID NO: 28674 - DNA, 15 bp, Homo sapiens
ttgctcattgatgtc

SEQ ID NO: 28675 - DNA, 15 bp, Homo sapiens
cttgctcattgatgt

SEQ ID NO: 28676 - DNA, 15 bp, Homo sapiens
tcttgctcattgatg

SEQ ID NO: 28677 - DNA, 15 bp, Homo sapiens
atcttgctcattgat

SEQ ID NO: 28678 - DNA, 15 bp, Homo sapiens
catcttgctcattga

SEQ ID NO: 28679 - DNA, 15 bp, Homo sapiens
acatcttgctcattg

SEQ ID NO: 28680 - DNA, 15 bp, Homo sapiens
aacatcttgctcatt

SEQ ID NO: 28681 - DNA, 15 bp, Homo sapiens
aaacatcttgctcat

SEQ ID NO: 28682 - DNA, 15 bp, Homo sapiens
caaacatcttgctca

SEQ ID NO: 28683 - DNA, 15 bp, Homo sapiens
acaaacatcttgctc

SEQ ID NO: 28684 - DNA, 15 bp, Homo sapiens
cacaaacatcttgct

SEQ ID NO: 28685 - DNA, 15 bp, Homo sapiens
tcacaaacatcttgc

SEQ ID NO: 28686 - DNA, 15 bp, Homo sapiens
ttcacaaacatcttg

SEQ ID NO: 28687 - DNA, 15 bp, Homo sapiens
cttcacaaacatctt

SEQ ID NO: 28688 - DNA, 15 bp, Homo sapiens
ccttcacaaacatct

SEQ ID NO: 28689 - DNA, 15 bp, Homo sapiens
gccttcacaaacatc

SEQ ID NO: 28690 - DNA, 15 bp, Homo sapiens
tgccttcacaaacat

SEQ ID NO: 28691 - DNA, 15 bp, Homo sapiens
ttgccttcacaaaca

SEQ ID NO: 28692 - DNA, 15 bp, Homo sapiens
cttgccttcacaaac

SEQ ID NO: 28693 - DNA, 15 bp, Homo sapiens
acttgccttcacaaa

SEQ ID NO: 28694 - DNA, 15 bp, Homo sapiens
tacttgccttcacaa

SEQ ID NO: 28695 - DNA, 15 bp, Homo sapiens
atacttgccttcaca

SEQ ID NO: 28696 - DNA, 15 bp, Homo sapiens
catacttgccttcac

SEQ ID NO: 28697 - DNA, 15 bp, Homo sapiens
ccatacttgccttca

SEQ ID NO: 28698 - DNA, 15 bp, Homo sapiens
gccatacttgccttc

SEQ ID NO: 28699 - DNA, 15 bp, Homo sapiens
tgccatacttgcctt

SEQ ID NO: 28700 - DNA, 15 bp, Homo sapiens
ctgccatacttgcct

SEQ ID NO: 28701 - DNA, 15 bp, Homo sapiens
tctgccatacttgcc

SEQ ID NO: 28702 - DNA, 15 bp, Homo sapiens
atctgccatacttgc

SEQ ID NO: 28703 - DNA, 15 bp, Homo sapiens
aatctgccatacttg

SEQ ID NO: 28704 - DNA, 15 bp, Homo sapiens
caatctgccatactt

SEQ ID NO: 28705 - DNA, 15 bp, Homo sapiens
gcaatctgccatact

SEQ ID NO: 28706 - DNA, 15 bp, Homo sapiens
tgcaatctgccatac

SEQ ID NO: 28707 - DNA, 15 bp, Homo sapiens
ttgcaatctgccata

SEQ ID NO: 28708 - DNA, 15 bp, Homo sapiens
attgcaatctgccat

SEQ ID NO: 28709 - DNA, 15 bp, Homo sapiens
aattgcaatctgcca

SEQ ID NO: 28710 - DNA, 15 bp, Homo sapiens
caattgcaatctgcc

SEQ ID NO: 28711 - DNA, 15 bp, Homo sapiens
tcaattgcaatctgc

SEQ ID NO: 28712 - DNA, 15 bp, Homo sapiens
ctcaattgcaatctg

SEQ ID NO: 28713 - DNA, 15 bp, Homo sapiens
tctcaattgcaatct

SEQ ID NO: 28714 - DNA, 15 bp, Homo sapiens
atctcaattgcaatc

SEQ ID NO: 28715 - DNA, 15 bp, Homo sapiens
catctcaattgcaat

SEQ ID NO: 28716 - DNA, 15 bp, Homo sapiens
acatctcaattgcaa

SEQ ID NO: 28717 - DNA, 15 bp, Homo sapiens
aacatctcaattgca

SEQ ID NO: 28718 - DNA, 15 bp, Homo sapiens
gaacatctcaattgc

SEQ ID NO: 28719 - DNA, 15 bp, Homo sapiens
agaacatctcaattg

SEQ ID NO: 28720 - DNA, 15 bp, Homo sapiens
aagaacatctcaatt

SEQ ID NO: 28721 - DNA, 15 bp, Homo sapiens
caagaacatctcaat

SEQ ID NO: 28722 - DNA, 15 bp, Homo sapiens
gcaagaacatctcaa

SEQ ID NO: 28723 - DNA, 15 bp, Homo sapiens
ggcaagaacatctca

SEQ ID NO: 28724 - DNA, 15 bp, Homo sapiens
tggcaagaacatctc

SEQ ID NO: 28725 - DNA, 15 bp, Homo sapiens
ctggcaagaacatct

SEQ ID NO: 28726 - DNA, 15 bp, Homo sapiens
cctggcaagaacatc

SEQ ID NO: 28727 - DNA, 15 bp, Homo sapiens
ccctggcaagaacat

SEQ ID NO: 28728 - DNA, 15 bp, Homo sapiens
accctggcaagaaca

SEQ ID NO: 28729 - DNA, 15 bp, Homo sapiens
aaccctggcaagaac

SEQ ID NO: 28730 - DNA, 15 bp, Homo sapiens
taaccctggcaagaa

SEQ ID NO: 28731 - DNA, 15 bp, Homo sapiens
ttaaccctggcaaga

SEQ ID NO: 28732 - DNA, 15 bp, Homo sapiens
cttaaccctggcaag

SEQ ID NO: 28733 - DNA, 15 bp, Homo sapiens
tcttaaccctggcaa

SEQ ID NO: 28734 - DNA, 15 bp, Homo sapiens
atcttaaccctggca

SEQ ID NO: 28735 - DNA, 15 bp, Homo sapiens
gatcttaaccctggc

SEQ ID NO: 28736 - DNA, 15 bp, Homo sapiens
ggatcttaaccctgg

SEQ ID NO: 28737 - DNA, 15 bp, Homo sapiens
gggatcttaaccctg

SEQ ID NO: 28738 - DNA, 15 bp, Homo sapiens
cgggatcttaaccct

SEQ ID NO: 28739 - DNA, 15 bp, Homo sapiens
ccgggatcttaaccc

SEQ ID NO: 28740 - DNA, 15 bp, Homo sapiens
accgggatcttaacc

SEQ ID NO: 28741 - DNA, 15 bp, Homo sapiens
caccgggatcttaac

SEQ ID NO: 28742 - DNA, 15 bp, Homo sapiens
tcaccgggatcttaa

SEQ ID NO: 28743 - DNA, 15 bp, Homo sapiens
ttcaccgggatctta

SEQ ID NO: 28744 - DNA, 15 bp, Homo sapiens
gttcaccgggatctt

SEQ ID NO: 28745 - DNA, 15 bp, Homo sapiens
ggttcaccgggatct

SEQ ID NO: 28746 - DNA, 15 bp, Homo sapiens
tggttcaccgggatc

SEQ ID NO: 28747 - DNA, 15 bp, Homo sapiens
ttggttcaccgggat

SEQ ID NO: 28748 - DNA, 15 bp, Homo sapiens
attggttcaccggga

SEQ ID NO: 28749 - DNA, 15 bp, Homo sapiens
tattggttcaccggg

SEQ ID NO: 28750 - DNA, 15 bp, Homo sapiens
ttattggttcaccgg

SEQ ID NO: 28751 - DNA, 15 bp, Homo sapiens
tttattggttcaccg

SEQ ID NO: 28752 - DNA, 15 bp, Homo sapiens
ttttattggttcacc

SEQ ID NO: 28753 - DNA, 15 bp, Homo sapiens
gttttattggttcac

SEQ ID NO: 28754 - DNA, 15 bp, Homo sapiens
tgttttattggttca

SEQ ID NO: 28755 - DNA, 15 bp, Homo sapiens
ttgttttattggttc

SEQ ID NO: 28756 - DNA, 15 bp, Homo sapiens
tttgttttattggtt

SEQ ID NO: 28757 - DNA, 15 bp, Homo sapiens
ttttgttttattggt

SEQ ID NO: 28758 - DNA, 15 bp, Homo sapiens
attttgttttattgg

SEQ ID NO: 28759 - DNA, 15 bp, Homo sapiens
aattttgttttattg

SEQ ID NO: 28760 - DNA, 15 bp, Homo sapiens
caattttgttttatt

SEQ ID NO: 28761 - DNA, 15 bp, Homo sapiens
acaattttgttttat

SEQ ID NO: 28762 - DNA, 15 bp, Homo sapiens
aacaattttgtttta

SEQ ID NO: 28763 - DNA, 15 bp, Homo sapiens
aaacaattttgtttt

SEQ ID NO: 28764 - DNA, 15 bp, Homo sapiens
taaacaattttgttt

SEQ ID NO: 28765 - DNA, 15 bp, Homo sapiens
ataaacaattttgtt

SEQ ID NO: 28766 - DNA, 15 bp, Homo sapiens
gataaacaattttgt

SEQ ID NO: 28767 - DNA, 15 bp, Homo sapiens
agataaacaattttg

SEQ ID NO: 28768 - DNA, 15 bp, Homo sapiens
tagataaacaatttt

SEQ ID NO: 28769 - DNA, 15 bp, Homo sapiens
ttagataaacaattt

SEQ ID NO: 28770 - DNA, 15 bp, Homo sapiens
tttagataaacaatt

SEQ ID NO: 28771 - DNA, 15 bp, Homo sapiens
atttagataaacaat

SEQ ID NO: 28772 - DNA, 15 bp, Homo sapiens
gatttagataaacaa

SEQ ID NO: 28773 - DNA, 15 bp, Homo sapiens
agatttagataaaca

SEQ ID NO: 28774 - DNA, 15 bp, Homo sapiens
cagatttagataaac

SEQ ID NO: 28775 - DNA, 15 bp, Homo sapiens
acagatttagataaa

SEQ ID NO: 28776 - DNA, 15 bp, Homo sapiens
tacagatttagataa

SEQ ID NO: 28777 - DNA, 15 bp, Homo sapiens
ttacagatttagata

SEQ ID NO: 28778 - DNA, 15 bp, Homo sapiens
gttacagatttagat

SEQ ID NO: 28779 - DNA, 15 bp, Homo sapiens
tgttacagatttaga

SEQ ID NO: 28780 - DNA, 15 bp, Homo sapiens
atgttacagatttag

SEQ ID NO: 28781 - DNA, 15 bp, Homo sapiens
aatgttacagattta

SEQ ID NO: 28782 - DNA, 15 bp, Homo sapiens
aaatgttacagattt

SEQ ID NO: 28783 - DNA, 15 bp, Homo sapiens
gaaatgttacagatt

SEQ ID NO: 28784 - DNA, 15 bp, Homo sapiens
ggaaatgttacagat

SEQ ID NO: 28785 - DNA, 15 bp, Homo sapiens
tggaaatgttacaga

SEQ ID NO: 28786 - DNA, 15 bp, Homo sapiens
ctggaaatgttacag

SEQ ID NO: 28787 - DNA, 15 bp, Homo sapiens
cctggaaatgttaca

SEQ ID NO: 28788 - DNA, 15 bp, Homo sapiens
ccctggaaatgttac

SEQ ID NO: 28789 - DNA, 15 bp, Homo sapiens
accctggaaatgtta

SEQ ID NO: 28790 - DNA, 15 bp, Homo sapiens
caccctggaaatgtt

SEQ ID NO: 28791 - DNA, 15 bp, Homo sapiens
gcaccctggaaatgt

SEQ ID NO: 28792 - DNA, 15 bp, Homo sapiens
agcaccctggaaatg

SEQ ID NO: 28793 - DNA, 15 bp, Homo sapiens
gagcaccctggaaat

SEQ ID NO: 28794 - DNA, 15 bp, Homo sapiens
ggagcaccctggaaa

SEQ ID NO: 28795 - DNA, 15 bp, Homo sapiens
aggagcaccctggaa

SEQ ID NO: 28796 - DNA, 15 bp, Homo sapiens
caggagcaccctgga

SEQ ID NO: 28797 - DNA, 15 bp, Homo sapiens
tcaggagcaccctgg

SEQ ID NO: 28798 - DNA, 15 bp, Homo sapiens
ttcaggagcaccctg

SEQ ID NO: 28799 - DNA, 15 bp, Homo sapiens
cttcaggagcaccct

SEQ ID NO: 28800 - DNA, 15 bp, Homo sapiens
ccttcaggagcaccc

SEQ ID NO: 28801 - DNA, 15 bp, Homo sapiens
accttcaggagcacc

SEQ ID NO: 28802 - DNA, 15 bp, Homo sapiens
caccttcaggagcac

SEQ ID NO: 28803 - DNA, 15 bp, Homo sapiens
acaccttcaggagca

SEQ ID NO: 28804 - DNA, 15 bp, Homo sapiens
gacaccttcaggagc

SEQ ID NO: 28805 - DNA, 15 bp, Homo sapiens
tgacaccttcaggag

SEQ ID NO: 28806 - DNA, 15 bp, Homo sapiens
atgacaccttcagga

SEQ ID NO: 28807 - DNA, 15 bp, Homo sapiens
aatgacaccttcagg

SEQ ID NO: 28808 - DNA, 15 bp, Homo sapiens
caatgacaccttcag

SEQ ID NO: 28809 - DNA, 15 bp, Homo sapiens
tcaatgacaccttca

SEQ ID NO: 28810 - DNA, 15 bp, Homo sapiens
gtcaatgacaccttc

SEQ ID NO: 28811 - DNA, 15 bp, Homo sapiens
tgtcaatgacacctt

SEQ ID NO: 28812 - DNA, 15 bp, Homo sapiens
ctgtcaatgacacct

SEQ ID NO: 28813 - DNA, 15 bp, Homo sapiens
cctgtcaatgacacc

SEQ ID NO: 28814 - DNA, 15 bp, Homo sapiens
acctgtcaatgacac

SEQ ID NO: 28815 - DNA, 15 bp, Homo sapiens
cacctgtcaatgaca

SEQ ID NO: 28816 - DNA, 15 bp, Homo sapiens
gcacctgtcaatgac

SEQ ID NO: 28817 - DNA, 15 bp, Homo sapiens
tgcacctgtcaatga

SEQ ID NO: 28818 - DNA, 15 bp, Homo sapiens
gtgcacctgtcaatg

SEQ ID NO: 28819 - DNA, 15 bp, Homo sapiens
ggtgcacctgtcaat

SEQ ID NO: 28820 - DNA, 15 bp, Homo sapiens
gggtgcacctgtcaa

SEQ ID NO: 28821 - DNA, 15 bp, Homo sapiens
tgggtgcacctgtca

SEQ ID NO: 28822 - DNA, 15 bp, Homo sapiens
gtgggtgcacctgtc

SEQ ID NO: 28823 - DNA, 15 bp, Homo sapiens
tgtgggtgcacctgt

SEQ ID NO: 28824 - DNA, 15 bp, Homo sapiens
atgtgggtgcacctg

SEQ ID NO: 28825 - DNA, 15 bp, Homo sapiens
aatgtgggtgcacct

SEQ ID NO: 28826 - DNA, 15 bp, Homo sapiens
gaatgtgggtgcacc

SEQ ID NO: 28827 - DNA, 15 bp, Homo sapiens
cgaatgtgggtgcac

SEQ ID NO: 28828 - DNA, 15 bp, Homo sapiens
tcgaatgtgggtgca

SEQ ID NO: 28829 - DNA, 15 bp, Homo sapiens
ctcgaatgtgggtgc

SEQ ID NO: 28830 - DNA, 15 bp, Homo sapiens
actcgaatgtgggtg

SEQ ID NO: 28831 - DNA, 15 bp, Homo sapiens
aactcgaatgtgggt

SEQ ID NO: 28832 - DNA, 15 bp, Homo sapiens
caactcgaatgtggg

SEQ ID NO: 28833 - DNA, 15 bp, Homo sapiens
ccaactcgaatgtgg

SEQ ID NO: 28834 - DNA, 15 bp, Homo sapiens
tccaactcgaatgtg

SEQ ID NO: 28835 - DNA, 15 bp, Homo sapiens
ttccaactcgaatgt

SEQ ID NO: 28836 - DNA, 15 bp, Homo sapiens
cttccaactcgaatg

SEQ ID NO: 28837 - DNA, 15 bp, Homo sapiens
acttccaactcgaat

SEQ ID NO: 28838 - DNA, 15 bp, Homo sapiens
tacttccaactcgaa

SEQ ID NO: 28839 - DNA, 15 bp, Homo sapiens
gtacttccaactcga

SEQ ID NO: 28840 - DNA, 15 bp, Homo sapiens
agtacttccaactcg

SEQ ID NO: 28841 - DNA, 15 bp, Homo sapiens
tagtacttccaactc

SEQ ID NO: 28842 - DNA, 15 bp, Homo sapiens
ttagtacttccaact

SEQ ID NO: 28843 - DNA, 15 bp, Homo sapiens
cttagtacttccaac

SEQ ID NO: 28844 - DNA, 15 bp, Homo sapiens
ccttagtacttccaa

SEQ ID NO: 28845 - DNA, 15 bp, Homo sapiens
accttagtacttcca

SEQ ID NO: 28846 - DNA, 15 bp, Homo sapiens
aaccttagtacttcc

SEQ ID NO: 28847 - DNA, 15 bp, Homo sapiens
gaaccttagtacttc

SEQ ID NO: 28848 - DNA, 15 bp, Homo sapiens
ggaaccttagtactt

SEQ ID NO: 28849 - DNA, 15 bp, Homo sapiens
aggaaccttagtact

SEQ ID NO: 28850 - DNA, 15 bp, Homo sapiens
taggaaccttagtac

SEQ ID NO: 28851 - DNA, 15 bp, Homo sapiens
ataggaaccttagta

SEQ ID NO: 28852 - DNA, 15 bp, Homo sapiens
cataggaaccttagt

SEQ ID NO: 28853 - DNA, 15 bp, Homo sapiens
tcataggaaccttag

SEQ ID NO: 28854 - DNA, 15 bp, Homo sapiens
gtcataggaacctta

SEQ ID NO: 28855 - DNA, 15 bp, Homo sapiens
ggtcataggaacctt

SEQ ID NO: 28856 - DNA, 15 bp, Homo sapiens
aggtcataggaacct

SEQ ID NO: 28857 - DNA, 15 bp, Homo sapiens
gaggtcataggaacc

SEQ ID NO: 28858 - DNA, 15 bp, Homo sapiens
agaggtcataggaac

SEQ ID NO: 28859 - DNA, 15 bp, Homo sapiens
cagaggtcataggaa

SEQ ID NO: 28860 - DNA, 15 bp, Homo sapiens
ccagaggtcatagga

SEQ ID NO: 28861 - DNA, 15 bp, Homo sapiens
tccagaggtcatagg

SEQ ID NO: 28862 - DNA, 15 bp, Homo sapiens
ctccagaggtcatag

SEQ ID NO: 28863 - DNA, 15 bp, Homo sapiens
actccagaggtcata

SEQ ID NO: 28864 - DNA, 15 bp, Homo sapiens
gactccagaggtcat

SEQ ID NO: 28865 - DNA, 15 bp, Homo sapiens
tgactccagaggtca

SEQ ID NO: 28866 - DNA, 15 bp, Homo sapiens
ttgactccagaggtc

SEQ ID NO: 28867 - DNA, 15 bp, Homo sapiens
tttgactccagaggt

SEQ ID NO: 28868 - DNA, 15 bp, Homo sapiens
gtttgactccagagg

SEQ ID NO: 28869 - DNA, 15 bp, Homo sapiens
tgtttgactccagag

SEQ ID NO: 28870 - DNA, 15 bp, Homo sapiens
ctgtttgactccaga

SEQ ID NO: 28871 - DNA, 15 bp, Homo sapiens
tctgtttgactccag

SEQ ID NO: 28872 - DNA, 15 bp, Homo sapiens
ttctgtttgactcca

SEQ ID NO: 28873 - DNA, 15 bp, Homo sapiens
cttctgtttgactcc

SEQ ID NO: 28874 - DNA, 15 bp, Homo sapiens
tcttctgtttgactc

SEQ ID NO: 28875 - DNA, 15 bp, Homo sapiens
atcttctgtttgact

SEQ ID NO: 28876 - DNA, 15 bp, Homo sapiens
gatcttctgtttgac

SEQ ID NO: 28877 - DNA, 15 bp, Homo sapiens
tgatcttctgtttga

SEQ ID NO: 28878 - DNA, 15 bp, Homo sapiens
atgatcttctgtttg

SEQ ID NO: 28879 - DNA, 15 bp, Homo sapiens
catgatcttctgttt

SEQ ID NO: 28880 - DNA, 15 bp, Homo sapiens
acatgatcttctgtt

SEQ ID NO: 28881 - DNA, 15 bp, Homo sapiens
gacatgatcttctgt

SEQ ID NO: 28882 - DNA, 15 bp, Homo sapiens
agacatgatcttctg

SEQ ID NO: 28883 - DNA, 15 bp, Homo sapiens
cagacatgatcttct

SEQ ID NO: 28884 - DNA, 15 bp, Homo sapiens
acagacatgatcttc

SEQ ID NO: 28885 - DNA, 15 bp, Homo sapiens
gacagacatgatctt

SEQ ID NO: 28886 - DNA, 15 bp, Homo sapiens
tgacagacatgatct

SEQ ID NO: 28887 - DNA, 15 bp, Homo sapiens
atgacagacatgatc

SEQ ID NO: 28888 - DNA, 15 bp, Homo sapiens
aatgacagacatgat

SEQ ID NO: 28889 - DNA, 15 bp, Homo sapiens
gaatgacagacatga

SEQ ID NO: 28890 - DNA, 15 bp, Homo sapiens
cgaatgacagacatg

SEQ ID NO: 28891 - DNA, 15 bp, Homo sapiens
tcgaatgacagacat

SEQ ID NO: 28892 - DNA, 15 bp, Homo sapiens
ctcgaatgacagaca

SEQ ID NO: 28893 - DNA, 15 bp, Homo sapiens
tctcgaatgacagac

SEQ ID NO: 28894 - DNA, 15 bp, Homo sapiens
ctctcgaatgacaga

SEQ ID NO: 28895 - DNA, 15 bp, Homo sapiens
actctcgaatgacag

SEQ ID NO: 28896 - DNA, 15 bp, Homo sapiens
cactctcgaatgaca

SEQ ID NO: 28897 - DNA, 15 bp, Homo sapiens
ccactctcgaatgac

SEQ ID NO: 28898 - DNA, 15 bp, Homo sapiens
cccactctcgaatga

SEQ ID NO: 28899 - DNA, 15 bp, Homo sapiens
ccccactctcgaatg

SEQ ID NO: 28900 - DNA, 15 bp, Homo sapiens
accccactctcgaat

SEQ ID NO: 28901 - DNA, 15 bp, Homo sapiens
taccccactctcgaa

SEQ ID NO: 28902 - DNA, 15 bp, Homo sapiens
ctaccccactctcga

SEQ ID NO: 28903 - DNA, 15 bp, Homo sapiens
actaccccactctcg

SEQ ID NO: 28904 - DNA, 15 bp, Homo sapiens
cactaccccactctc

SEQ ID NO: 28905 - DNA, 15 bp, Homo sapiens
ccactaccccactct

SEQ ID NO: 28906 - DNA, 15 bp, Homo sapiens
gccactaccccactc

SEQ ID NO: 28907 - DNA, 15 bp, Homo sapiens
tgccactaccccact

SEQ ID NO: 28908 - DNA, 15 bp, Homo sapiens
ctgccactaccccac

SEQ ID NO: 28909 - DNA, 15 bp, Homo sapiens
gctgccactacccca

SEQ ID NO: 28910 - DNA, 15 bp, Homo sapiens
cgctgccactacccc

SEQ ID NO: 28911 - DNA, 15 bp, Homo sapiens
tcgctgccactaccc

SEQ ID NO: 28912 - DNA, 15 bp, Homo sapiens
gtcgctgccactacc

SEQ ID NO: 28913 - DNA, 15 bp, Homo sapiens
tgtcgctgccactac

SEQ ID NO: 28914 - DNA, 15 bp, Homo sapiens
gtgtcgctgccacta

SEQ ID NO: 28915 - DNA, 15 bp, Homo sapiens
tgtgtcgctgccact

SEQ ID NO: 28916 - DNA, 15 bp, Homo sapiens
gtgtgtcgctgccac

SEQ ID NO: 28917 - DNA, 15 bp, Homo sapiens
agtgtgtcgctgcca

SEQ ID NO: 28918 - DNA, 15 bp, Homo sapiens
cagtgtgtcgctgcc

SEQ ID NO: 28919 - DNA, 15 bp, Homo sapiens
gcagtgtgtcgctgc

SEQ ID NO: 28920 - DNA, 15 bp, Homo sapiens
cgcagtgtgtcgctg

SEQ ID NO: 28921 - DNA, 15 bp, Homo sapiens
tcgcagtgtgtcgct

SEQ ID NO: 28922 - DNA, 15 bp, Homo sapiens
atcgcagtgtgtcgc

SEQ ID NO: 28923 - DNA, 15 bp, Homo sapiens
catcgcagtgtgtcg

SEQ ID NO: 28924 - DNA, 15 bp, Homo sapiens
gcatcgcagtgtgtc

SEQ ID NO: 28925 - DNA, 15 bp, Homo sapiens
ggcatcgcagtgtgt

SEQ ID NO: 28926 - DNA, 15 bp, Homo sapiens
aggcatcgcagtgtg

SEQ ID NO: 28927 - DNA, 15 bp, Homo sapiens
caggcatcgcagtgt

SEQ ID NO: 28928 - DNA, 15 bp, Homo sapiens
ccaggcatcgcagtg

SEQ ID NO: 28929 - DNA, 15 bp, Homo sapiens
gccaggcatcgcagt

SEQ ID NO: 28930 - DNA, 15 bp, Homo sapiens
ggccaggcatcgcag

SEQ ID NO: 28931 - DNA, 15 bp, Homo sapiens
gggccaggcatcgca

SEQ ID NO: 28932 - DNA, 15 bp, Homo sapiens
agggccaggcatcgc

SEQ ID NO: 28933 - DNA, 15 bp, Homo sapiens
cagggccaggcatcg

SEQ ID NO: 28934 - DNA, 15 bp, Homo sapiens
ccagggccaggcatc

SEQ ID NO: 28935 - DNA, 15 bp, Homo sapiens
gccagggccaggcat

SEQ ID NO: 28936 - DNA, 15 bp, Homo sapiens
ggccagggccaggca

SEQ ID NO: 28937 - DNA, 15 bp, Homo sapiens
tggccagggccaggc

SEQ ID NO: 28938 - DNA, 15 bp, Homo sapiens
gtggccagggccagg

SEQ ID NO: 28939 - DNA, 15 bp, Homo sapiens
agtggccagggccag

SEQ ID NO: 28940 - DNA, 15 bp, Homo sapiens
gagtggccagggcca

SEQ ID NO: 28941 - DNA, 15 bp, Homo sapiens
tgagtggccagggcc

SEQ ID NO: 28942 - DNA, 15 bp, Homo sapiens
atgagtggccagggc

SEQ ID NO: 28943 - DNA, 15 bp, Homo sapiens
catgagtggccaggg

SEQ ID NO: 28944 - DNA, 15 bp, Homo sapiens
tcatgagtggccagg

SEQ ID NO: 28945 - DNA, 15 bp, Homo sapiens
gtcatgagtggccag

SEQ ID NO: 28946 - DNA, 15 bp, Homo sapiens
tgtcatgagtggcca

SEQ ID NO: 28947 - DNA, 15 bp, Homo sapiens
ttgtcatgagtggcc

SEQ ID NO: 28948 - DNA, 15 bp, Homo sapiens
gttgtcatgagtggc

SEQ ID NO: 28949 - DNA, 15 bp, Homo sapiens
ggttgtcatgagtgg

SEQ ID NO: 28950 - DNA, 15 bp, Homo sapiens
gggttgtcatgagtg

SEQ ID NO: 28951 - DNA, 15 bp, Homo sapiens
tgggttgtcatgagt

SEQ ID NO: 28952 - DNA, 15 bp, Homo sapiens
gtgggttgtcatgag

SEQ ID NO: 28953 - DNA, 15 bp, Homo sapiens
agtgggttgtcatga

SEQ ID NO: 28954 - DNA, 15 bp, Homo sapiens
cagtgggttgtcatg

SEQ ID NO: 28955 - DNA, 15 bp, Homo sapiens
tcagtgggttgtcat

SEQ ID NO: 28956 - DNA, 15 bp, Homo sapiens
ctcagtgggttgtca

SEQ ID NO: 28957 - DNA, 15 bp, Homo sapiens
tctcagtgggttgtc

SEQ ID NO: 28958 - DNA, 15 bp, Homo sapiens
ttctcagtgggttgt

SEQ ID NO: 28959 - DNA, 15 bp, Homo sapiens
cttctcagtgggttg

SEQ ID NO: 28960 - DNA, 15 bp, Homo sapiens
tcttctcagtgggtt

SEQ ID NO: 28961 - DNA, 15 bp, Homo sapiens
ctcttctcagtgggt

SEQ ID NO: 28962 - DNA, 15 bp, Homo sapiens
tctcttctcagtggg

SEQ ID NO: 28963 - DNA, 15 bp, Homo sapiens
ttctcttctcagtgg

SEQ ID NO: 28964 - DNA, 15 bp, Homo sapiens
cttctcttctcagtg

SEQ ID NO: 28965 - DNA, 15 bp, Homo sapiens
tcttctcttctcagt

SEQ ID NO: 28966 - DNA, 15 bp, Homo sapiens
ttcttctcttctcag

SEQ ID NO: 28967 - DNA, 15 bp, Homo sapiens
tttcttctcttctca

SEQ ID NO: 28968 - DNA, 15 bp, Homo sapiens
atttcttctcttctc

SEQ ID NO: 28969 - DNA, 15 bp, Homo sapiens
catttcttctcttct

SEQ ID NO: 28970 - DNA, 15 bp, Homo sapiens
gcatttcttctcttc

SEQ ID NO: 28971 - DNA, 15 bp, Homo sapiens
tgcatttcttctctt

SEQ ID NO: 28972 - DNA, 15 bp, Homo sapiens
gtgcatttcttctct

SEQ ID NO: 28973 - DNA, 15 bp, Homo sapiens
ggtgcatttcttctc

SEQ ID NO: 28974 - DNA, 15 bp, Homo sapiens
aggtgcatttcttct

SEQ ID NO: 28975 - DNA, 15 bp, Homo sapiens
aaggtgcatttcttc

SEQ ID NO: 28976 - DNA, 15 bp, Homo sapiens
caaggtgcatttctt

SEQ ID NO: 28977 - DNA, 15 bp, Homo sapiens
tcaaggtgcatttct

SEQ ID NO: 28978 - DNA, 15 bp, Homo sapiens
ctcaaggtgcatttc

SEQ ID NO: 28979 - DNA, 15 bp, Homo sapiens
cctcaaggtgcattt

SEQ ID NO: 28980 - DNA, 15 bp, Homo sapiens
tcctcaaggtgcatt

SEQ ID NO: 28981 - DNA, 15 bp, Homo sapiens
gtcctcaaggtgcat

SEQ ID NO: 28982 - DNA, 15 bp, Homo sapiens
agtcctcaaggtgca

SEQ ID NO: 28983 - DNA, 15 bp, Homo sapiens
gagtcctcaaggtgc

SEQ ID NO: 28984 - DNA, 15 bp, Homo sapiens
agagtcctcaaggtg

SEQ ID NO: 28985 - DNA, 15 bp, Homo sapiens
cagagtcctcaaggt

SEQ ID NO: 28986 - DNA, 15 bp, Homo sapiens
gcagagtcctcaagg

SEQ ID NO: 28987 - DNA, 15 bp, Homo sapiens
ggcagagtcctcaag

SEQ ID NO: 28988 - DNA, 15 bp, Homo sapiens
tggcagagtcctcaa

SEQ ID NO: 28989 - DNA, 15 bp, Homo sapiens
ttggcagagtcctca

SEQ ID NO: 28990 - DNA, 15 bp, Homo sapiens
gttggcagagtcctc

SEQ ID NO: 28991 - DNA, 15 bp, Homo sapiens
agttggcagagtcct

SEQ ID NO: 28992 - DNA, 15 bp, Homo sapiens
aagttggcagagtcc

SEQ ID NO: 28993 - DNA, 15 bp, Homo sapiens
aaagttggcagagtc

SEQ ID NO: 28994 - DNA, 15 bp, Homo sapiens
taaagttggcagagt

SEQ ID NO: 28995 - DNA, 15 bp, Homo sapiens
ataaagttggcagag

SEQ ID NO: 28996 - DNA, 15 bp, Homo sapiens
aataaagttggcaga

SEQ ID NO: 28997 - DNA, 15 bp, Homo sapiens
taataaagttggcag

SEQ ID NO: 28998 - DNA, 15 bp, Homo sapiens
ttaataaagttggca

SEQ ID NO: 28999 - DNA, 15 bp, Homo sapiens
tttaataaagttggc

SEQ ID NO: 29000 - DNA, 15 bp, Homo sapiens
atttaataaagttgg

SEQ ID NO: 29001 - DNA, 15 bp, Homo sapiens
tatttaataaagttg

SEQ ID NO: 29002 - DNA, 15 bp, Homo sapiens
atatttaataaagtt

SEQ ID NO: 29003 - DNA, 15 bp, Homo sapiens
catatttaataaagt

SEQ ID NO: 29004 - DNA, 15 bp, Homo sapiens
tcatatttaataaag

SEQ ID NO: 29005 - DNA, 15 bp, Homo sapiens
ctcatatttaataaa

SEQ ID NO: 29006 - DNA, 15 bp, Homo sapiens
cctcatatttaataa

SEQ ID NO: 29007 - DNA, 15 bp, Homo sapiens
acctcatatttaata

SEQ ID NO: 29008 - DNA, 15 bp, Homo sapiens
aacctcatatttaat

SEQ ID NO: 29009 - DNA, 15 bp, Homo sapiens
taacctcatatttaa

SEQ ID NO: 29010 - DNA, 15 bp, Homo sapiens
ctaacctcatattta

SEQ ID NO: 29011 - DNA, 15 bp, Homo sapiens
gctaacctcatattt

SEQ ID NO: 29012 - DNA, 15 bp, Homo sapiens
agctaacctcatatt

SEQ ID NO: 29013 - DNA, 15 bp, Homo sapiens
tagctaacctcatat

SEQ ID NO: 29014 - DNA, 15 bp, Homo sapiens
ttagctaacctcata

SEQ ID NO: 29015 - DNA, 15 bp, Homo sapiens
attagctaacctcat

SEQ ID NO: 29016 - DNA, 15 bp, Homo sapiens
cattagctaacctca

SEQ ID NO: 29017 - DNA, 15 bp, Homo sapiens
tcattagctaacctc

SEQ ID NO: 29018 - DNA, 15 bp, Homo sapiens
ttcattagctaacct

SEQ ID NO: 29019 - DNA, 15 bp, Homo sapiens
tttcattagctaacc

SEQ ID NO: 29020 - DNA, 15 bp, Homo sapiens
ttttcattagctaac

SEQ ID NO: 29021 - DNA, 15 bp, Homo sapiens
cttttcattagctaa

SEQ ID NO: 29022 - DNA, 15 bp, Homo sapiens
acttttcattagcta

SEQ ID NO: 29023 - DNA, 15 bp, Homo sapiens
aacttttcattagct

SEQ ID NO: 29024 - DNA, 15 bp, Homo sapiens
aaacttttcattagc

SEQ ID NO: 29025 - DNA, 15 bp, Homo sapiens
gaaacttttcattag

SEQ ID NO: 29026 - DNA, 15 bp, Homo sapiens
agaaacttttcatta

SEQ ID NO: 29027 - DNA, 15 bp, Homo sapiens
aagaaacttttcatt

SEQ ID NO: 29028 - DNA, 15 bp, Homo sapiens
aaagaaacttttcat

SEQ ID NO: 29029 - DNA, 15 bp, Homo sapiens
caaagaaacttttca

SEQ ID NO: 29030 - DNA, 15 bp, Homo sapiens
acaaagaaacttttc

SEQ ID NO: 29031 - DNA, 15 bp, Homo sapiens
gacaaagaaactttt

SEQ ID NO: 29032 - DNA, 15 bp, Homo sapiens
ggacaaagaaacttt

SEQ ID NO: 29033 - DNA, 15 bp, Homo sapiens
tggacaaagaaactt

SEQ ID NO: 29034 - DNA, 15 bp, Homo sapiens
gtggacaaagaaact

SEQ ID NO: 29035 - DNA, 15 bp, Homo sapiens
tgtggacaaagaaac

SEQ ID NO: 29036 - DNA, 15 bp, Homo sapiens
gtgtggacaaagaaa

SEQ ID NO: 29037 - DNA, 15 bp, Homo sapiens
ggtgtggacaaagaa

SEQ ID NO: 29038 - DNA, 15 bp, Homo sapiens
gggtgtggacaaaga

SEQ ID NO: 29039 - DNA, 15 bp, Homo sapiens
agggtgtggacaaag

SEQ ID NO: 29040 - DNA, 15 bp, Homo sapiens
cagggtgtggacaaa

SEQ ID NO: 29041 - DNA, 15 bp, Homo sapiens
gcagggtgtggacaa

SEQ ID NO: 29042 - DNA, 15 bp, Homo sapiens
tgcagggtgtggaca

SEQ ID NO: 29043 - DNA, 15 bp, Homo sapiens
gtgcagggtgtggac

SEQ ID NO: 29044 - DNA, 15 bp, Homo sapiens
cgtgcagggtgtgga

SEQ ID NO: 29045 - DNA, 15 bp, Homo sapiens
tcgtgcagggtgtgg

SEQ ID NO: 29046 - DNA, 15 bp, Homo sapiens
atcgtgcagggtgtg

SEQ ID NO: 29047 - DNA, 15 bp, Homo sapiens
aatcgtgcagggtgt

SEQ ID NO: 29048 - DNA, 15 bp, Homo sapiens
gaatcgtgcagggtg

SEQ ID NO: 29049 - DNA, 15 bp, Homo sapiens
tgaatcgtgcagggt

SEQ ID NO: 29050 - DNA, 15 bp, Homo sapiens
atgaatcgtgcaggg

SEQ ID NO: 29051 - DNA, 15 bp, Homo sapiens
aatgaatcgtgcagg

SEQ ID NO: 29052 - DNA, 15 bp, Homo sapiens
caatgaatcgtgcag

SEQ ID NO: 29053 - DNA, 15 bp, Homo sapiens
acaatgaatcgtgca

SEQ ID NO: 29054 - DNA, 15 bp, Homo sapiens
cacaatgaatcgtgc

SEQ ID NO: 29055 - DNA, 15 bp, Homo sapiens
acacaatgaatcgtg

SEQ ID NO: 29056 - DNA, 15 bp, Homo sapiens
aacacaatgaatcgt

SEQ ID NO: 29057 - DNA, 15 bp, Homo sapiens
aaacacaatgaatcg

SEQ ID NO: 29058 - DNA, 15 bp, Homo sapiens
taaacacaatgaatc

SEQ ID NO: 29059 - DNA, 15 bp, Homo sapiens
ttaaacacaatgaat

SEQ ID NO: 29060 - DNA, 15 bp, Homo sapiens
tttaaacacaatgaa

SEQ ID NO: 29061 - DNA, 15 bp, Homo sapiens
gtttaaacacaatga

SEQ ID NO: 29062 - DNA, 15 bp, Homo sapiens
tgtttaaacacaatg

SEQ ID NO: 29063 - DNA, 15 bp, Homo sapiens
ctgtttaaacacaat

SEQ ID NO: 29064 - DNA, 15 bp, Homo sapiens
actgtttaaacacaa

SEQ ID NO: 29065 - DNA, 15 bp, Homo sapiens
tactgtttaaacaca

SEQ ID NO: 29066 - DNA, 15 bp, Homo sapiens
gtactgtttaaacac

SEQ ID NO: 29067 - DNA, 15 bp, Homo sapiens
agtactgtttaaaca

SEQ ID NO: 29068 - DNA, 15 bp, Homo sapiens
gagtactgtttaaac

SEQ ID NO: 29069 - DNA, 15 bp, Homo sapiens
ggagtactgtttaaa

SEQ ID NO: 29070 - DNA, 15 bp, Homo sapiens
aggagtactgtttaa

SEQ ID NO: 29071 - DNA, 15 bp, Homo sapiens
aaggagtactgttta

SEQ ID NO: 29072 - DNA, 15 bp, Homo sapiens
gaaggagtactgttt

SEQ ID NO: 29073 - DNA, 15 bp, Homo sapiens
tgaaggagtactgtt

SEQ ID NO: 29074 - DNA, 15 bp, Homo sapiens
ttgaaggagtactgt

SEQ ID NO: 29075 - DNA, 15 bp, Homo sapiens
cttgaaggagtactg

SEQ ID NO: 29076 - DNA, 15 bp, Homo sapiens
gcttgaaggagtact

SEQ ID NO: 29077 - DNA, 15 bp, Homo sapiens
tgcttgaaggagtac

SEQ ID NO: 29078 - DNA, 15 bp, Homo sapiens
ttgcttgaaggagta

SEQ ID NO: 29079 - DNA, 15 bp, Homo sapiens
tttgcttgaaggagt

SEQ ID NO: 29080 - DNA, 15 bp, Homo sapiens
ttttgcttgaaggag

SEQ ID NO: 29081 - DNA, 15 bp, Homo sapiens
cttttgcttgaagga

SEQ ID NO: 29082 - DNA, 15 bp, Homo sapiens
ccttttgcttgaagg

SEQ ID NO: 29083 - DNA, 15 bp, Homo sapiens
accttttgcttgaag

SEQ ID NO: 29084 - DNA, 15 bp, Homo sapiens
gaccttttgcttgaa

SEQ ID NO: 29085 - DNA, 15 bp, Homo sapiens
tgaccttttgcttga

SEQ ID NO: 29086 - DNA, 15 bp, Homo sapiens
ttgaccttttgcttg

SEQ ID NO: 29087 - DNA, 15 bp, Homo sapiens
tttgaccttttgctt

SEQ ID NO: 29088 - DNA, 15 bp, Homo sapiens
gtttgaccttttgct

SEQ ID NO: 29089 - DNA, 15 bp, Homo sapiens
tgtttgaccttttgc

SEQ ID NO: 29090 - DNA, 15 bp, Homo sapiens
ctgtttgaccttttg

SEQ ID NO: 29091 - DNA, 15 bp, Homo sapiens
actgtttgacctttt

SEQ ID NO: 29092 - DNA, 15 bp, Homo sapiens
aactgtttgaccttt

SEQ ID NO: 29093 - DNA, 15 bp, Homo sapiens
gaactgtttgacctt

SEQ ID NO: 29094 - DNA, 15 bp, Homo sapiens
agaactgtttgacct

SEQ ID NO: 29095 - DNA, 15 bp, Homo sapiens
gagaactgtttgacc

SEQ ID NO: 29096 - DNA, 15 bp, Homo sapiens
tgagaactgtttgac

SEQ ID NO: 29097 - DNA, 15 bp, Homo sapiens
gtgagaactgtttga

SEQ ID NO: 29098 - DNA, 15 bp, Homo sapiens
agtgagaactgtttg

SEQ ID NO: 29099 - DNA, 15 bp, Homo sapiens
aagtgagaactgttt

SEQ ID NO: 29100 - DNA, 15 bp, Homo sapiens
aaagtgagaactgtt

SEQ ID NO: 29101 - DNA, 15 bp, Homo sapiens
aaaagtgagaactgt

SEQ ID NO: 29102 - DNA, 15 bp, Homo sapiens
caaaagtgagaactg

SEQ ID NO: 29103 - DNA, 15 bp, Homo sapiens
gcaaaagtgagaact

SEQ ID NO: 29104 - DNA, 15 bp, Homo sapiens
ggcaaaagtgagaac

SEQ ID NO: 29105 - DNA, 15 bp, Homo sapiens
tggcaaaagtgagaa

SEQ ID NO: 29106 - DNA, 15 bp, Homo sapiens
ttggcaaaagtgaga

SEQ ID NO: 29107 - DNA, 15 bp, Homo sapiens
cttggcaaaagtgag

SEQ ID NO: 29108 - DNA, 15 bp, Homo sapiens
tcttggcaaaagtga

SEQ ID NO: 29109 - DNA, 15 bp, Homo sapiens
ttcttggcaaaagtg

SEQ ID NO: 29110 - DNA, 15 bp, Homo sapiens
tttcttggcaaaagt

SEQ ID NO: 29111 - DNA, 15 bp, Homo sapiens
ctttcttggcaaaag

SEQ ID NO: 29112 - DNA, 15 bp, Homo sapiens
tctttcttggcaaaa

SEQ ID NO: 29113 - DNA, 15 bp, Homo sapiens
ctctttcttggcaaa

SEQ ID NO: 29114 - DNA, 15 bp, Homo sapiens
cctctttcttggcaa

SEQ ID NO: 29115 - DNA, 15 bp, Homo sapiens
acctctttcttggca

SEQ ID NO: 29116 - DNA, 15 bp, Homo sapiens
cacctctttcttggc

SEQ ID NO: 29117 - DNA, 15 bp, Homo sapiens
acacctctttcttgg

SEQ ID NO: 29118 - DNA, 15 bp, Homo sapiens
cacacctctttcttg

SEQ ID NO: 29119 - DNA, 15 bp, Homo sapiens
ccacacctctttctt

SEQ ID NO: 29120 - DNA, 15 bp, Homo sapiens
accacacctctttct

SEQ ID NO: 29121 - DNA, 15 bp, Homo sapiens
aaccacacctctttc

SEQ ID NO: 29122 - DNA, 15 bp, Homo sapiens
taaccacacctcttt

SEQ ID NO: 29123 - DNA, 15 bp, Homo sapiens
ataaccacacctctt

SEQ ID NO: 29124 - DNA, 15 bp, Homo sapiens
aataaccacacctct

SEQ ID NO: 29125 - DNA, 15 bp, Homo sapiens
aaataaccacacctc

SEQ ID NO: 29126 - DNA, 15 bp, Homo sapiens
caaataaccacacct

SEQ ID NO: 29127 - DNA, 15 bp, Homo sapiens
acaaataaccacacc

SEQ ID NO: 29128 - DNA, 15 bp, Homo sapiens
aacaaataaccacac

SEQ ID NO: 29129 - DNA, 15 bp, Homo sapiens
aaacaaataaccaca

SEQ ID NO: 29130 - DNA, 15 bp, Homo sapiens
aaaacaaataaccac

SEQ ID NO: 29131 - DNA, 15 bp, Homo sapiens
aaaaacaaataacca

SEQ ID NO: 29132 - DNA, 15 bp, Homo sapiens
gaaaaacaaataacc

SEQ ID NO: 29133 - DNA, 15 bp, Homo sapiens
agaaaaacaaataac

SEQ ID NO: 29134 - DNA, 15 bp, Homo sapiens
cagaaaaacaaataa

SEQ ID NO: 29135 - DNA, 15 bp, Homo sapiens
gcagaaaaacaaata

SEQ ID NO: 29136 - DNA, 15 bp, Homo sapiens
ggcagaaaaacaaat

SEQ ID NO: 29137 - DNA, 15 bp, Homo sapiens
aggcagaaaaacaaa

SEQ ID NO: 29138 - DNA, 15 bp, Homo sapiens
caggcagaaaaacaa

SEQ ID NO: 29139 - DNA, 15 bp, Homo sapiens
gcaggcagaaaaaca

SEQ ID NO: 29140 - DNA, 15 bp, Homo sapiens
ggcaggcagaaaaac

SEQ ID NO: 29141 - DNA, 15 bp, Homo sapiens
tggcaggcagaaaaa

SEQ ID NO: 29142 - DNA, 15 bp, Homo sapiens
ctggcaggcagaaaa

SEQ ID NO: 29143 - DNA, 15 bp, Homo sapiens
gctggcaggcagaaa

SEQ ID NO: 29144 - DNA, 15 bp, Homo sapiens
agctggcaggcagaa

SEQ ID NO: 29145 - DNA, 15 bp, Homo sapiens
cagctggcaggcaga

SEQ ID NO: 29146 - DNA, 15 bp, Homo sapiens
acagctggcaggcag

SEQ ID NO: 29147 - DNA, 15 bp, Homo sapiens
cacagctggcaggca

SEQ ID NO: 29148 - DNA, 15 bp, Homo sapiens
acacagctggcaggc

SEQ ID NO: 29149 - DNA, 15 bp, Homo sapiens
gacacagctggcagg

SEQ ID NO: 29150 - DNA, 15 bp, Homo sapiens
tgacacagctggcag

SEQ ID NO: 29151 - DNA, 15 bp, Homo sapiens
gtgacacagctggca

SEQ ID NO: 29152 - DNA, 15 bp, Homo sapiens
ggtgacacagctggc

SEQ ID NO: 29153 - DNA, 15 bp, Homo sapiens
gggtgacacagctgg

SEQ ID NO: 29154 - DNA, 15 bp, Homo sapiens
agggtgacacagctg

SEQ ID NO: 29155 - DNA, 15 bp, Homo sapiens
aagggtgacacagct

SEQ ID NO: 29156 - DNA, 15 bp, Homo sapiens
taagggtgacacagc

SEQ ID NO: 29157 - DNA, 15 bp, Homo sapiens
ttaagggtgacacag

SEQ ID NO: 29158 - DNA, 15 bp, Homo sapiens
tttaagggtgacaca

SEQ ID NO: 29159 - DNA, 15 bp, Homo sapiens
ttttaagggtgacac

SEQ ID NO: 29160 - DNA, 15 bp, Homo sapiens
attttaagggtgaca

SEQ ID NO: 29161 - DNA, 15 bp, Homo sapiens
aattttaagggtgac

SEQ ID NO: 29162 - DNA, 15 bp, Homo sapiens
aaattttaagggtga

SEQ ID NO: 29163 - DNA, 15 bp, Homo sapiens
caaattttaagggtg

SEQ ID NO: 29164 - DNA, 15 bp, Homo sapiens
gcaaattttaagggt

SEQ ID NO: 29165 - DNA, 15 bp, Homo sapiens
agcaaattttaaggg

SEQ ID NO: 29166 - DNA, 15 bp, Homo sapiens
cagcaaattttaagg

SEQ ID NO: 29167 - DNA, 15 bp, Homo sapiens
gcagcaaattttaag

SEQ ID NO: 29168 - DNA, 15 bp, Homo sapiens
agcagcaaattttaa

SEQ ID NO: 29169 - DNA, 15 bp, Homo sapiens
aagcagcaaatttta

SEQ ID NO: 29170 - DNA, 15 bp, Homo sapiens
gaagcagcaaatttt

SEQ ID NO: 29171 - DNA, 15 bp, Homo sapiens
tgaagcagcaaattt

SEQ ID NO: 29172 - DNA, 15 bp, Homo sapiens
ttgaagcagcaaatt

SEQ ID NO: 29173 - DNA, 15 bp, Homo sapiens
tttgaagcagcaaat

SEQ ID NO: 29174 - DNA, 15 bp, Homo sapiens
gtttgaagcagcaaa

SEQ ID NO: 29175 - DNA, 15 bp, Homo sapiens
tgtttgaagcagcaa

SEQ ID NO: 29176 - DNA, 15 bp, Homo sapiens
atgtttgaagcagca

SEQ ID NO: 29177 - DNA, 15 bp, Homo sapiens
tatgtttgaagcagc

SEQ ID NO: 29178 - DNA, 15 bp, Homo sapiens
gtatgtttgaagcag

SEQ ID NO: 29179 - DNA, 15 bp, Homo sapiens
tgtatgtttgaagca

SEQ ID NO: 29180 - DNA, 15 bp, Homo sapiens
atgtatgtttgaagc

SEQ ID NO: 29181 - DNA, 15 bp, Homo sapiens
tatgtatgtttgaag

SEQ ID NO: 29182 - DNA, 15 bp, Homo sapiens
ctatgtatgtttgaa

SEQ ID NO: 29183 - DNA, 15 bp, Homo sapiens
actatgtatgtttga

SEQ ID NO: 29184 - DNA, 15 bp, Homo sapiens
aactatgtatgtttg

SEQ ID NO: 29185 - DNA, 15 bp, Homo sapiens
taactatgtatgttt

SEQ ID NO: 29186 - DNA, 15 bp, Homo sapiens
ttaactatgtatgtt

SEQ ID NO: 29187 - DNA, 15 bp, Homo sapiens
attaactatgtatgt

SEQ ID NO: 29188 - DNA, 15 bp, Homo sapiens
tattaactatgtatg

SEQ ID NO: 29189 - DNA, 15 bp, Homo sapiens
ttattaactatgtat

SEQ ID NO: 29190 - DNA, 15 bp, Homo sapiens
attattaactatgta

SEQ ID NO: 29191 - DNA, 15 bp, Homo sapiens
aattattaactatgt

SEQ ID NO: 29192 - DNA, 15 bp, Homo sapiens
aaattattaactatg

SEQ ID NO: 29193 - DNA, 15 bp, Homo sapiens
gaaattattaactat

SEQ ID NO: 29194 - DNA, 15 bp, Homo sapiens
tgaaattattaacta

SEQ ID NO: 29195 - DNA, 15 bp, Homo sapiens
atgaaattattaact

SEQ ID NO: 29196 - DNA, 15 bp, Homo sapiens
tatgaaattattaac

SEQ ID NO: 29197 - DNA, 15 bp, Homo sapiens
ttatgaaattattaa

SEQ ID NO: 29198 - DNA, 15 bp, Homo sapiens
tttatgaaattatta

SEQ ID NO: 29199 - DNA, 15 bp, Homo sapiens
ttttatgaaattatt

SEQ ID NO: 29200 - DNA, 15 bp, Homo sapiens
cttttatgaaattat

SEQ ID NO: 29201 - DNA, 15 bp, Homo sapiens
acttttatgaaatta

SEQ ID NO: 29202 - DNA, 15 bp, Homo sapiens
cacttttatgaaatt

SEQ ID NO: 29203 - DNA, 15 bp, Homo sapiens
acacttttatgaaat

SEQ ID NO: 29204 - DNA, 15 bp, Homo sapiens
aacacttttatgaaa

SEQ ID NO: 29205 - DNA, 15 bp, Homo sapiens
taacacttttatgaa

SEQ ID NO: 29206 - DNA, 15 bp, Homo sapiens
ataacacttttatga

SEQ ID NO: 29207 - DNA, 15 bp, Homo sapiens
aataacacttttatg

SEQ ID NO: 29208 - DNA, 15 bp, Homo sapiens
aaataacacttttat

SEQ ID NO: 29209 - DNA, 15 bp, Homo sapiens
aaaataacactttta

SEQ ID NO: 29210 - DNA, 15 bp, Homo sapiens
gaaaataacactttt

SEQ ID NO: 29211 - DNA, 15 bp, Homo sapiens
tgaaaataacacttt

SEQ ID NO: 29212 - DNA, 15 bp, Homo sapiens
ttgaaaataacactt

SEQ ID NO: 29213 - DNA, 15 bp, Homo sapiens
tttgaaaataacact

SEQ ID NO: 29214 - DNA, 15 bp, Homo sapiens
ctttgaaaataacac

SEQ ID NO: 29215 - DNA, 15 bp, Homo sapiens
actttgaaaataaca

SEQ ID NO: 29216 - DNA, 15 bp, Homo sapiens
tactttgaaaataac

SEQ ID NO: 29217 - DNA, 15 bp, Homo sapiens
ctactttgaaaataa

SEQ ID NO: 29218 - DNA, 15 bp, Homo sapiens
tctactttgaaaata

SEQ ID NO: 29219 - DNA, 15 bp, Homo sapiens
ttctactttgaaaat

SEQ ID NO: 29220 - DNA, 15 bp, Homo sapiens
attctactttgaaaa

SEQ ID NO: 29221 - DNA, 15 bp, Homo sapiens
tattctactttgaaa

SEQ ID NO: 29222 - DNA, 15 bp, Homo sapiens
atattctactttgaa

SEQ ID NO: 29223 - DNA, 15 bp, Homo sapiens
aatattctactttga

SEQ ID NO: 29224 - DNA, 15 bp, Homo sapiens
aaatattctactttg

SEQ ID NO: 29225 - DNA, 15 bp, Homo sapiens
aaaatattctacttt

SEQ ID NO: 29226 - DNA, 15 bp, Homo sapiens
gaaaatattctactt

SEQ ID NO: 29227 - DNA, 15 bp, Homo sapiens
tgaaaatattctact

SEQ ID NO: 29228 - DNA, 15 bp, Homo sapiens
ttgaaaatattctac

SEQ ID NO: 29229 - DNA, 15 bp, Homo sapiens
tttgaaaatattcta

SEQ ID NO: 29230 - DNA, 15 bp, Homo sapiens
ctttgaaaatattct

SEQ ID NO: 29231 - DNA, 15 bp, Homo sapiens
actttgaaaatattc

SEQ ID NO: 29232 - DNA, 15 bp, Homo sapiens
tactttgaaaatatt

SEQ ID NO: 29233 - DNA, 15 bp, Homo sapiens
ctactttgaaaatat

SEQ ID NO: 29234 - DNA, 15 bp, Homo sapiens
ttattctactttgaa

SEQ ID NO: 29235 - DNA, 15 bp, Homo sapiens
attattctactttga

SEQ ID NO: 29236 - DNA, 15 bp, Homo sapiens
gattattctactttg

SEQ ID NO: 29237 - DNA, 15 bp, Homo sapiens
tgattattctacttt

SEQ ID NO: 29238 - DNA, 15 bp, Homo sapiens
ttgattattctactt

SEQ ID NO: 29239 - DNA, 15 bp, Homo sapiens
cttgattattctact

SEQ ID NO: 29240 - DNA, 15 bp, Homo sapiens
tcttgattattctac

SEQ ID NO: 29241 - DNA, 15 bp, Homo sapiens
atcttgattattcta

SEQ ID NO: 29242 - DNA, 15 bp, Homo sapiens
catcttgattattct

SEQ ID NO: 29243 - DNA, 15 bp, Homo sapiens
tcatcttgattattc

SEQ ID NO: 29244 - DNA, 15 bp, Homo sapiens
ctcatcttgattatt

SEQ ID NO: 29245 - DNA, 15 bp, Homo sapiens
gctcatcttgattat

SEQ ID NO: 29246 - DNA, 15 bp, Homo sapiens
agctcatcttgatta

SEQ ID NO: 29247 - DNA, 15 bp, Homo sapiens
aagctcatcttgatt

SEQ ID NO: 29248 - DNA, 15 bp, Homo sapiens
taagctcatcttgat

SEQ ID NO: 29249 - DNA, 15 bp, Homo sapiens
ttaagctcatcttga

SEQ ID NO: 29250 - DNA, 15 bp, Homo sapiens
cttaagctcatcttg

SEQ ID NO: 29251 - DNA, 15 bp, Homo sapiens
gcttaagctcatctt

SEQ ID NO: 29252 - DNA, 15 bp, Homo sapiens
agcttaagctcatct

SEQ ID NO: 29253 - DNA, 15 bp, Homo sapiens
aagcttaagctcatc

SEQ ID NO: 29254 - DNA, 15 bp, Homo sapiens
caagcttaagctcat

SEQ ID NO: 29255 - DNA, 15 bp, Homo sapiens
acaagcttaagctca

SEQ ID NO: 29256 - DNA, 15 bp, Homo sapiens
tacaagcttaagctc

SEQ ID NO: 29257 - DNA, 15 bp, Homo sapiens
ttacaagcttaagct

SEQ ID NO: 29258 - DNA, 15 bp, Homo sapiens
tttacaagcttaagc

SEQ ID NO: 29259 - DNA, 15 bp, Homo sapiens
gtttacaagcttaag

SEQ ID NO: 29260 - DNA, 15 bp, Homo sapiens
ggtttacaagcttaa

SEQ ID NO: 29261 - DNA, 15 bp, Homo sapiens
gggtttacaagctta

SEQ ID NO: 29262 - DNA, 15 bp, Homo sapiens
ggggtttacaagctt

SEQ ID NO: 29263 - DNA, 15 bp, Homo sapiens
tggggtttacaagct

SEQ ID NO: 29264 - DNA, 15 bp, Homo sapiens
atggggtttacaagc

SEQ ID NO: 29265 - DNA, 15 bp, Homo sapiens
aatggggtttacaag

SEQ ID NO: 29266 - DNA, 15 bp, Homo sapiens
aaatggggtttacaa

SEQ ID NO: 29267 - DNA, 15 bp, Homo sapiens
aaaatggggtttaca

SEQ ID NO: 29268 - DNA, 15 bp, Homo sapiens
caaaatggggtttac

SEQ ID NO: 29269 - DNA, 15 bp, Homo sapiens
gcaaaatggggttta

SEQ ID NO: 29270 - DNA, 15 bp, Homo sapiens
ggcaaaatggggttt

SEQ ID NO: 29271 - DNA, 15 bp, Homo sapiens
aggcaaaatggggtt

SEQ ID NO: 29272 - DNA, 15 bp, Homo sapiens
gaggcaaaatggggt

SEQ ID NO: 29273 - DNA, 15 bp, Homo sapiens
agaggcaaaatgggg

SEQ ID NO: 29274 - DNA, 15 bp, Homo sapiens
gagaggcaaaatggg

SEQ ID NO: 29275 - DNA, 15 bp, Homo sapiens
tgagaggcaaaatgg

SEQ ID NO: 29276 - DNA, 15 bp, Homo sapiens
atgagaggcaaaatg

SEQ ID NO: 29277 - DNA, 15 bp, Homo sapiens
gatgagaggcaaaat

SEQ ID NO: 29278 - DNA, 15 bp, Homo sapiens
agatgagaggcaaaa

SEQ ID NO: 29279 - DNA, 15 bp, Homo sapiens
tagatgagaggcaaa

SEQ ID NO: 29280 - DNA, 15 bp, Homo sapiens
ttagatgagaggcaa

SEQ ID NO: 29281 - DNA, 15 bp, Homo sapiens
tttagatgagaggca

SEQ ID NO: 29282 - DNA, 15 bp, Homo sapiens
atttagatgagaggc

SEQ ID NO: 29283 - DNA, 15 bp, Homo sapiens
gatttagatgagagg

SEQ ID NO: 29284 - DNA, 15 bp, Homo sapiens
tgatttagatgagag

SEQ ID NO: 29285 - DNA, 15 bp, Homo sapiens
atgatttagatgaga

SEQ ID NO: 29286 - DNA, 15 bp, Homo sapiens
catgatttagatgag

SEQ ID NO: 29287 - DNA, 15 bp, Homo sapiens
tcatgatttagatga

SEQ ID NO: 29288 - DNA, 15 bp, Homo sapiens
atcatgatttagatg

SEQ ID NO: 29289 - DNA, 15 bp, Homo sapiens
aatcatgatttagat

SEQ ID NO: 29290 - DNA, 15 bp, Homo sapiens
aaatcatgatttaga

SEQ ID NO: 29291 - DNA, 15 bp, Homo sapiens
aaaatcatgatttag

SEQ ID NO: 29292 - DNA, 15 bp, Homo sapiens
aaaaatcatgattta

SEQ ID NO: 29293 - DNA, 15 bp, Homo sapiens
aaaaaatcatgattt

SEQ ID NO: 29294 - DNA, 15 bp, Homo sapiens
aaaaaaatcatgatt

SEQ ID NO: 29295 - DNA, 15 bp, Homo sapiens
aaaaaaaatcatgat

SEQ ID NO: 29296 - DNA, 15 bp, Homo sapiens
taaaaaaaatcatga

SEQ ID NO: 29297 - DNA, 15 bp, Homo sapiens
ttaaaaaaaatcatg

SEQ ID NO: 29298 - DNA, 15 bp, Homo sapiens
tttaaaaaaaatcat

SEQ ID NO: 29299 - DNA, 15 bp, Homo sapiens
atttaaaaaaaatca

SEQ ID NO: 29300 - DNA, 15 bp, Homo sapiens
aatttaaaaaaaatc

SEQ ID NO: 29301 - DNA, 15 bp, Homo sapiens
caatttaaaaaaaat

SEQ ID NO: 29302 - DNA, 15 bp, Homo sapiens
ccaatttaaaaaaaa

SEQ ID NO: 29303 - DNA, 15 bp, Homo sapiens
accaatttaaaaaaa

SEQ ID NO: 29304 - DNA, 15 bp, Homo sapiens
caccaatttaaaaaa

SEQ ID NO: 29305 - DNA, 15 bp, Homo sapiens
tcaccaatttaaaaa

SEQ ID NO: 29306 - DNA, 15 bp, Homo sapiens
gtcaccaatttaaaa

SEQ ID NO: 29307 - DNA, 15 bp, Homo sapiens
tgtcaccaatttaaa

SEQ ID NO: 29308 - DNA, 15 bp, Homo sapiens
atgtcaccaatttaa

SEQ ID NO: 29309 - DNA, 15 bp, Homo sapiens
aatgtcaccaattta

SEQ ID NO: 29310 - DNA, 15 bp, Homo sapiens
aaatgtcaccaattt

SEQ ID NO: 29311 - DNA, 15 bp, Homo sapiens
gaaatgtcaccaatt

SEQ ID NO: 29312 - DNA, 15 bp, Homo sapiens
agaaatgtcaccaat

SEQ ID NO: 29313 - DNA, 15 bp, Homo sapiens
tagaaatgtcaccaa

SEQ ID NO: 29314 - DNA, 15 bp, Homo sapiens
ctagaaatgtcacca

SEQ ID NO: 29315 - DNA, 15 bp, Homo sapiens
tctagaaatgtcacc

SEQ ID NO: 29316 - DNA, 15 bp, Homo sapiens
ttctagaaatgtcac

SEQ ID NO: 29317 - DNA, 15 bp, Homo sapiens
attctagaaatgtca

SEQ ID NO: 29318 - DNA, 15 bp, Homo sapiens
tattctagaaatgtc

SEQ ID NO: 29319 - DNA, 15 bp, Homo sapiens
atattctagaaatgt

SEQ ID NO: 29320 - DNA, 15 bp, Homo sapiens
aatattctagaaatg

SEQ ID NO: 29321 - DNA, 15 bp, Homo sapiens
gaatattctagaaat

SEQ ID NO: 29322 - DNA, 15 bp, Homo sapiens
tgaatattctagaaa

SEQ ID NO: 29323 - DNA, 15 bp, Homo sapiens
atgaatattctagaa

SEQ ID NO: 29324 - DNA, 15 bp, Homo sapiens
aatgaatattctaga

SEQ ID NO: 29325 - DNA, 15 bp, Homo sapiens
taatgaatattctag

SEQ ID NO: 29326 - DNA, 15 bp, Homo sapiens
ctaatgaatattcta

SEQ ID NO: 29327 - DNA, 15 bp, Homo sapiens
actaatgaatattct

SEQ ID NO: 29328 - DNA, 15 bp, Homo sapiens
aactaatgaatattc

SEQ ID NO: 29329 - DNA, 15 bp, Homo sapiens
taactaatgaatatt

SEQ ID NO: 29330 - DNA, 15 bp, Homo sapiens
gtaactaatgaatat

SEQ ID NO: 29331 - DNA, 15 bp, Homo sapiens
agtaactaatgaata

SEQ ID NO: 29332 - DNA, 15 bp, Homo sapiens
cagtaactaatgaat

SEQ ID NO: 29333 - DNA, 15 bp, Homo sapiens
tcagtaactaatgaa

SEQ ID NO: 29334 - DNA, 15 bp, Homo sapiens
ttcagtaactaatga

SEQ ID NO: 29335 - DNA, 15 bp, Homo sapiens
cttcagtaactaatg

SEQ ID NO: 29336 - DNA, 15 bp, Homo sapiens
ccttcagtaactaat

SEQ ID NO: 29337 - DNA, 15 bp, Homo sapiens
accttcagtaactaa

SEQ ID NO: 29338 - DNA, 15 bp, Homo sapiens
gaccttcagtaacta

SEQ ID NO: 29339 - DNA, 15 bp, Homo sapiens
tgaccttcagtaact

SEQ ID NO: 29340 - DNA, 15 bp, Homo sapiens
ttgaccttcagtaac

SEQ ID NO: 29341 - DNA, 15 bp, Homo sapiens
tttgaccttcagtaa

SEQ ID NO: 29342 - DNA, 15 bp, Homo sapiens
ttttgaccttcagta

SEQ ID NO: 29343 - DNA, 15 bp, Homo sapiens
cttttgaccttcagt

SEQ ID NO: 29344 - DNA, 15 bp, Homo sapiens
tcttttgaccttcag

SEQ ID NO: 29345 - DNA, 15 bp, Homo sapiens
atcttttgaccttca

SEQ ID NO: 29346 - DNA, 15 bp, Homo sapiens
gatcttttgaccttc

SEQ ID NO: 29347 - DNA, 15 bp, Homo sapiens
ggatcttttgacctt

SEQ ID NO: 29348 - DNA, 15 bp, Homo sapiens
tggatcttttgacct

SEQ ID NO: 29349 - DNA, 15 bp, Homo sapiens
ttggatcttttgacc

SEQ ID NO: 29350 - DNA, 15 bp, Homo sapiens
cttggatcttttgac

SEQ ID NO: 29351 - DNA, 15 bp, Homo sapiens
acttggatcttttga

SEQ ID NO: 29352 - DNA, 15 bp, Homo sapiens
aacttggatcttttg

SEQ ID NO: 29353 - DNA, 15 bp, Homo sapiens
caacttggatctttt

SEQ ID NO: 29354 - DNA, 15 bp, Homo sapiens
ccaacttggatcttt

SEQ ID NO: 29355 - DNA, 15 bp, Homo sapiens
tccaacttggatctt

SEQ ID NO: 29356 - DNA, 15 bp, Homo sapiens
ctccaacttggatct

SEQ ID NO: 29357 - DNA, 15 bp, Homo sapiens
tctccaacttggatc

SEQ ID NO: 29358 - DNA, 15 bp, Homo sapiens
atctccaacttggat

SEQ ID NO: 29359 - DNA, 15 bp, Homo sapiens
aatctccaacttgga

SEQ ID NO: 29360 - DNA, 15 bp, Homo sapiens
taatctccaacttgg

SEQ ID NO: 29361 - DNA, 15 bp, Homo sapiens
gtaatctccaacttg

SEQ ID NO: 29362 - DNA, 15 bp, Homo sapiens
agtaatctccaactt

SEQ ID NO: 29363 - DNA, 15 bp, Homo sapiens
aagtaatctccaact

SEQ ID NO: 29364 - DNA, 15 bp, Homo sapiens
gaagtaatctccaac

SEQ ID NO: 29365 - DNA, 15 bp, Homo sapiens
ggaagtaatctccaa

SEQ ID NO: 29366 - DNA, 15 bp, Homo sapiens
tggaagtaatctcca

SEQ ID NO: 29367 - DNA, 15 bp, Homo sapiens
gtggaagtaatctcc

SEQ ID NO: 29368 - DNA, 15 bp, Homo sapiens
agtggaagtaatctc

SEQ ID NO: 29369 - DNA, 15 bp, Homo sapiens
aagtggaagtaatct

SEQ ID NO: 29370 - DNA, 15 bp, Homo sapiens
aaagtggaagtaatc

SEQ ID NO: 29371 - DNA, 15 bp, Homo sapiens
aaaagtggaagtaat

SEQ ID NO: 29372 - DNA, 15 bp, Homo sapiens
gaaaagtggaagtaa

SEQ ID NO: 29373 - DNA, 15 bp, Homo sapiens
agaaaagtggaagta

SEQ ID NO: 29374 - DNA, 15 bp, Homo sapiens
tagaaaagtggaagt

SEQ ID NO: 29375 - DNA, 15 bp, Homo sapiens
gtagaaaagtggaag

SEQ ID NO: 29376 - DNA, 15 bp, Homo sapiens
agtagaaaagtggaa

SEQ ID NO: 29377 - DNA, 15 bp, Homo sapiens
gagtagaaaagtgga

SEQ ID NO: 29378 - DNA, 15 bp, Homo sapiens
tgagtagaaaagtgg

SEQ ID NO: 29379 - DNA, 15 bp, Homo sapiens
ctgagtagaaaagtg

SEQ ID NO: 29380 - DNA, 15 bp, Homo sapiens
tctgagtagaaaagt

SEQ ID NO: 29381 - DNA, 15 bp, Homo sapiens
ctctgagtagaaaag

SEQ ID NO: 29382 - DNA, 15 bp, Homo sapiens
actctgagtagaaaa

SEQ ID NO: 29383 - DNA, 15 bp, Homo sapiens
tactctgagtagaaa

SEQ ID NO: 29384 - DNA, 15 bp, Homo sapiens
ctactctgagtagaa

SEQ ID NO: 29385 - DNA, 15 bp, Homo sapiens
tctactctgagtaga

SEQ ID NO: 29386 - DNA, 15 bp, Homo sapiens
ttctactctgagtag

SEQ ID NO: 29387 - DNA, 15 bp, Homo sapiens
attctactctgagta

SEQ ID NO: 29388 - DNA, 15 bp, Homo sapiens
aattctactctgagt

SEQ ID NO: 29389 - DNA, 15 bp, Homo sapiens
gaattctactctgag

SEQ ID NO: 29390 - DNA, 15 bp, Homo sapiens
agaattctactctga

SEQ ID NO: 29391 - DNA, 15 bp, Homo sapiens
aagaattctactctg

SEQ ID NO: 29392 - DNA, 15 bp, Homo sapiens
aaagaattctactct

SEQ ID NO: 29393 - DNA, 15 bp, Homo sapiens
aaaagaattctactc

SEQ ID NO: 29394 - DNA, 15 bp, Homo sapiens
taaaagaattctact

SEQ ID NO: 29395 - DNA, 15 bp, Homo sapiens
ataaaagaattctac

SEQ ID NO: 29396 - DNA, 15 bp, Homo sapiens
tataaaagaattcta

SEQ ID NO: 29397 - DNA, 15 bp, Homo sapiens
atataaaagaattct

SEQ ID NO: 29398 - DNA, 15 bp, Homo sapiens
gatataaaagaattc

SEQ ID NO: 29399 - DNA, 15 bp, Homo sapiens
tgatataaaagaatt

SEQ ID NO: 29400 - DNA, 15 bp, Homo sapiens
ttgatataaaagaat

SEQ ID NO: 29401 - DNA, 15 bp, Homo sapiens
cttgatataaaagaa

SEQ ID NO: 29402 - DNA, 15 bp, Homo sapiens
ccttgatataaaaga

SEQ ID NO: 29403 - DNA, 15 bp, Homo sapiens
tccttgatataaaag

SEQ ID NO: 29404 - DNA, 15 bp, Homo sapiens
atccttgatataaaa

SEQ ID NO: 29405 - DNA, 15 bp, Homo sapiens
catccttgatataaa

SEQ ID NO: 29406 - DNA, 15 bp, Homo sapiens
acatccttgatataa

SEQ ID NO: 29407 - DNA, 15 bp, Homo sapiens
cacatccttgatata

SEQ ID NO: 29408 - DNA, 15 bp, Homo sapiens
tcacatccttgatat

SEQ ID NO: 29409 - DNA, 15 bp, Homo sapiens
gtcacatccttgata

SEQ ID NO: 29410 - DNA, 15 bp, Homo sapiens
tgtcacatccttgat

SEQ ID NO: 29411 - DNA, 15 bp, Homo sapiens
atgtcacatccttga

SEQ ID NO: 29412 - DNA, 15 bp, Homo sapiens
gatgtcacatccttg

SEQ ID NO: 29413 - DNA, 15 bp, Homo sapiens
ggatgtcacatcctt

SEQ ID NO: 29414 - DNA, 15 bp, Homo sapiens
aggatgtcacatcct

SEQ ID NO: 29415 - DNA, 15 bp, Homo sapiens
taggatgtcacatcc

SEQ ID NO: 29416 - DNA, 15 bp, Homo sapiens
ttaggatgtcacatc

SEQ ID NO: 29417 - DNA, 15 bp, Homo sapiens
tttaggatgtcacat

SEQ ID NO: 29418 - DNA, 15 bp, Homo sapiens
ctttaggatgtcaca

SEQ ID NO: 29419 - DNA, 15 bp, Homo sapiens
gctttaggatgtcac

SEQ ID NO: 29420 - DNA, 15 bp, Homo sapiens
agctttaggatgtca

SEQ ID NO: 29421 - DNA, 15 bp, Homo sapiens
tagctttaggatgtc

SEQ ID NO: 29422 - DNA, 15 bp, Homo sapiens
atagctttaggatgt

SEQ ID NO: 29423 - DNA, 15 bp, Homo sapiens
catagctttaggatg

SEQ ID NO: 29424 - DNA, 15 bp, Homo sapiens
tcatagctttaggat

SEQ ID NO: 29425 - DNA, 15 bp, Homo sapiens
ttcatagctttagga

SEQ ID NO: 29426 - DNA, 15 bp, Homo sapiens
gttcatagctttagg

SEQ ID NO: 29427 - DNA, 15 bp, Homo sapiens
tgttcatagctttag

SEQ ID NO: 29428 - DNA, 15 bp, Homo sapiens
ttgttcatagcttta

SEQ ID NO: 29429 - DNA, 15 bp, Homo sapiens
tttgttcatagcttt

SEQ ID NO: 29430 - DNA, 15 bp, Homo sapiens
ttttgttcatagctt

SEQ ID NO: 29431 - DNA, 15 bp, Homo sapiens
attttgttcatagct

SEQ ID NO: 29432 - DNA, 15 bp, Homo sapiens
cattttgttcatagc

SEQ ID NO: 29433 - DNA, 15 bp, Homo sapiens
tcattttgttcatag

SEQ ID NO: 29434 - DNA, 15 bp, Homo sapiens
ttcattttgttcata

SEQ ID NO: 29435 - DNA, 15 bp, Homo sapiens
cttcattttgttcat

SEQ ID NO: 29436 - DNA, 15 bp, Homo sapiens
tcttcattttgttca

SEQ ID NO: 29437 - DNA, 15 bp, Homo sapiens
ttcttcattttgttc

SEQ ID NO: 29438 - DNA, 15 bp, Homo sapiens
cttcttcattttgtt

SEQ ID NO: 29439 - DNA, 15 bp, Homo sapiens
gcttcttcattttgt

SEQ ID NO: 29440 - DNA, 15 bp, Homo sapiens
agcttcttcattttg

SEQ ID NO: 29441 - DNA, 15 bp, Homo sapiens
aagcttcttcatttt

SEQ ID NO: 29442 - DNA, 15 bp, Homo sapiens
aaagcttcttcattt

SEQ ID NO: 29443 - DNA, 15 bp, Homo sapiens
caaagcttcttcatt

SEQ ID NO: 29444 - DNA, 15 bp, Homo sapiens
ccaaagcttcttcat

SEQ ID NO: 29445 - DNA, 15 bp, Homo sapiens
accaaagcttcttca

SEQ ID NO: 29446 - DNA, 15 bp, Homo sapiens
taccaaagcttcttc

SEQ ID NO: 29447 - DNA, 15 bp, Homo sapiens
gtaccaaagcttctt

SEQ ID NO: 29448 - DNA, 15 bp, Homo sapiens
agtaccaaagcttct

SEQ ID NO: 29449 - DNA, 15 bp, Homo sapiens
cagtaccaaagcttc

SEQ ID NO: 29450 - DNA, 15 bp, Homo sapiens
acagtaccaaagctt

SEQ ID NO: 29451 - DNA, 15 bp, Homo sapiens
cacagtaccaaagct

SEQ ID NO: 29452 - DNA, 15 bp, Homo sapiens
ccacagtaccaaagc

SEQ ID NO: 29453 - DNA, 15 bp, Homo sapiens
cccacagtaccaaag

SEQ ID NO: 29454 - DNA, 15 bp, Homo sapiens
gcccacagtaccaaa

SEQ ID NO: 29455 - DNA, 15 bp, Homo sapiens
agcccacagtaccaa

SEQ ID NO: 29456 - DNA, 15 bp, Homo sapiens
gagcccacagtacca

SEQ ID NO: 29457 - DNA, 15 bp, Homo sapiens
tgagcccacagtacc

SEQ ID NO: 29458 - DNA, 15 bp, Homo sapiens
ctgagcccacagtac

SEQ ID NO: 29459 - DNA, 15 bp, Homo sapiens
tctgagcccacagta

SEQ ID NO: 29460 - DNA, 15 bp, Homo sapiens
ttctgagcccacagt

SEQ ID NO: 29461 - DNA, 15 bp, Homo sapiens
attctgagcccacag

SEQ ID NO: 29462 - DNA, 15 bp, Homo sapiens
tattctgagcccaca

SEQ ID NO: 29463 - DNA, 15 bp, Homo sapiens
ctattctgagcccac

SEQ ID NO: 29464 - DNA, 15 bp, Homo sapiens
gctattctgagccca

SEQ ID NO: 29465 - DNA, 15 bp, Homo sapiens
tgctattctgagccc

SEQ ID NO: 29466 - DNA, 15 bp, Homo sapiens
gtgctattctgagcc

SEQ ID NO: 29467 - DNA, 15 bp, Homo sapiens
tgtgctattctgagc

SEQ ID NO: 29468 - DNA, 15 bp, Homo sapiens
ttgtgctattctgag

SEQ ID NO: 29469 - DNA, 15 bp, Homo sapiens
cttgtgctattctga

SEQ ID NO: 29470 - DNA, 15 bp, Homo sapiens
tcttgtgctattctg

SEQ ID NO: 29471 - DNA, 15 bp, Homo sapiens
ctcttgtgctattct

SEQ ID NO: 29472 - DNA, 15 bp, Homo sapiens
actcttgtgctattc

SEQ ID NO: 29473 - DNA, 15 bp, Homo sapiens
aactcttgtgctatt

SEQ ID NO: 29474 - DNA, 15 bp, Homo sapiens
taactcttgtgctat

SEQ ID NO: 29475 - DNA, 15 bp, Homo sapiens
ttaactcttgtgcta

SEQ ID NO: 29476 - DNA, 15 bp, Homo sapiens
tttaactcttgtgct

SEQ ID NO: 29477 - DNA, 15 bp, Homo sapiens
ctttaactcttgtgc

SEQ ID NO: 29478 - DNA, 15 bp, Homo sapiens
tctttaactcttgtg

SEQ ID NO: 29479 - DNA, 15 bp, Homo sapiens
ttctttaactcttgt

SEQ ID NO: 29480 - DNA, 15 bp, Homo sapiens
attctttaactcttg

SEQ ID NO: 29481 - DNA, 15 bp, Homo sapiens
cattctttaactctt

SEQ ID NO: 29482 - DNA, 15 bp, Homo sapiens
ccattctttaactct

SEQ ID NO: 29483 - DNA, 15 bp, Homo sapiens
accattctttaactc

SEQ ID NO: 29484 - DNA, 15 bp, Homo sapiens
aaccattctttaact

SEQ ID NO: 29485 - DNA, 15 bp, Homo sapiens
aaaccattctttaac

SEQ ID NO: 29486 - DNA, 15 bp, Homo sapiens
caaaccattctttaa

SEQ ID NO: 29487 - DNA, 15 bp, Homo sapiens
tcaaaccattcttta

SEQ ID NO: 29488 - DNA, 15 bp, Homo sapiens
atcaaaccattcttt

SEQ ID NO: 29489 - DNA, 15 bp, Homo sapiens
tatcaaaccattctt

SEQ ID NO: 29490 - DNA, 15 bp, Homo sapiens
ttatcaaaccattct

SEQ ID NO: 29491 - DNA, 15 bp, Homo sapiens
gttatcaaaccattc

SEQ ID NO: 29492 - DNA, 15 bp, Homo sapiens
cgttatcaaaccatt

SEQ ID NO: 29493 - DNA, 15 bp, Homo sapiens
ccgttatcaaaccat

SEQ ID NO: 29494 - DNA, 15 bp, Homo sapiens
cccgttatcaaacca

SEQ ID NO: 29495 - DNA, 15 bp, Homo sapiens
acccgttatcaaacc

SEQ ID NO: 29496 - DNA, 15 bp, Homo sapiens
cacccgttatcaaac

SEQ ID NO: 29497 - DNA, 15 bp, Homo sapiens
acacccgttatcaaa

SEQ ID NO: 29498 - DNA, 15 bp, Homo sapiens
tacacccgttatcaa

SEQ ID NO: 29499 - DNA, 15 bp, Homo sapiens
ctacacccgttatca

SEQ ID NO: 29500 - DNA, 15 bp, Homo sapiens
actacacccgttatc

SEQ ID NO: 29501 - DNA, 15 bp, Homo sapiens
cactacacccgttat

SEQ ID NO: 29502 - DNA, 15 bp, Homo sapiens
ccactacacccgtta

SEQ ID NO: 29503 - DNA, 15 bp, Homo sapiens
accactacacccgtt

SEQ ID NO: 29504 - DNA, 15 bp, Homo sapiens
taccactacacccgt

SEQ ID NO: 29505 - DNA, 15 bp, Homo sapiens
ataccactacacccg

SEQ ID NO: 29506 - DNA, 15 bp, Homo sapiens
aataccactacaccc

SEQ ID NO: 29507 - DNA, 15 bp, Homo sapiens
aaataccactacacc

SEQ ID NO: 29508 - DNA, 15 bp, Homo sapiens
aaaataccactacac

SEQ ID NO: 29509 - DNA, 15 bp, Homo sapiens
aaaaataccactaca

SEQ ID NO: 29510 - DNA, 15 bp, Homo sapiens
aaaaaataccactac

SEQ ID NO: 29511 - DNA, 15 bp, Homo sapiens
aaaaaaataccacta

SEQ ID NO: 29512 - DNA, 15 bp, Homo sapiens
aaaaaaaataccact

SEQ ID NO: 29513 - DNA, 15 bp, Homo sapiens
aaaaaaaaataccac

SEQ ID NO: 29514 - DNA, 15 bp, Homo sapiens
gaaaaaaaaatacca

SEQ ID NO: 29515 - DNA, 15 bp, Homo sapiens
agaaaaaaaaatacc

SEQ ID NO: 29516 - DNA, 15 bp, Homo sapiens
gagaaaaaaaaatac

SEQ ID NO: 29517 - DNA, 15 bp, Homo sapiens
tgagaaaaaaaaata

SEQ ID NO: 29518 - DNA, 15 bp, Homo sapiens
atgagaaaaaaaaat

SEQ ID NO: 29519 - DNA, 15 bp, Homo sapiens
tatgagaaaaaaaaa

SEQ ID NO: 29520 - DNA, 15 bp, Homo sapiens
ttatgagaaaaaaaa

SEQ ID NO: 29521 - DNA, 15 bp, Homo sapiens
cttatgagaaaaaaa

SEQ ID NO: 29522 - DNA, 15 bp, Homo sapiens
tcttatgagaaaaaa

SEQ ID NO: 29523 - DNA, 15 bp, Homo sapiens
ttcttatgagaaaaa

SEQ ID NO: 29524 - DNA, 15 bp, Homo sapiens
tttcttatgagaaaa

SEQ ID NO: 29525 - DNA, 15 bp, Homo sapiens
ttttcttatgagaaa

SEQ ID NO: 29526 - DNA, 15 bp, Homo sapiens
attttcttatgagaa

SEQ ID NO: 29527 - DNA, 15 bp, Homo sapiens
cattttcttatgaga

SEQ ID NO: 29528 - DNA, 15 bp, Homo sapiens
gcattttcttatgag

SEQ ID NO: 29529 - DNA, 15 bp, Homo sapiens
tgcattttcttatga

SEQ ID NO: 29530 - DNA, 15 bp, Homo sapiens
ttgcattttcttatg

SEQ ID NO: 29531 - DNA, 15 bp, Homo sapiens
tttgcattttcttat

SEQ ID NO: 29532 - DNA, 15 bp, Homo sapiens
ttttgcattttctta

SEQ ID NO: 29533 - DNA, 15 bp, Homo sapiens
tttttgcattttctt

SEQ ID NO: 29534 - DNA, 15 bp, Homo sapiens
gtttttgcattttct

SEQ ID NO: 29535 - DNA, 15 bp, Homo sapiens
ggtttttgcattttc

SEQ ID NO: 29536 - DNA, 15 bp, Homo sapiens
cggtttttgcatttt

SEQ ID NO: 29537 - DNA, 15 bp, Homo sapiens
gcggtttttgcattt

SEQ ID NO: 29538 - DNA, 15 bp, Homo sapiens
ggcggtttttgcatt

SEQ ID NO: 29539 - DNA, 15 bp, Homo sapiens
tggcggtttttgcat

SEQ ID NO: 29540 - DNA, 15 bp, Homo sapiens
ctggcggtttttgca

SEQ ID NO: 29541 - DNA, 15 bp, Homo sapiens
cctggcggtttttgc

SEQ ID NO: 29542 - DNA, 15 bp, Homo sapiens
gcctggcggtttttg

SEQ ID NO: 29543 - DNA, 15 bp, Homo sapiens
tgcctggcggttttt

SEQ ID NO: 29544 - DNA, 15 bp, Homo sapiens
gtgcctggcggtttt

SEQ ID NO: 29545 - DNA, 15 bp, Homo sapiens
cgtgcctggcggttt

SEQ ID NO: 29546 - DNA, 15 bp, Homo sapiens
ccgtgcctggcggtt

SEQ ID NO: 29547 - DNA, 15 bp, Homo sapiens
accgtgcctggcggt

SEQ ID NO: 29548 - DNA, 15 bp, Homo sapiens
caccgtgcctggcgg

SEQ ID NO: 29549 - DNA, 15 bp, Homo sapiens
ccaccgtgcctggcg

SEQ ID NO: 29550 - DNA, 15 bp, Homo sapiens
gccaccgtgcctggc

SEQ ID NO: 29551 - DNA, 15 bp, Homo sapiens
agccaccgtgcctgg

SEQ ID NO: 29552 - DNA, 15 bp, Homo sapiens
gagccaccgtgcctg

SEQ ID NO: 29553 - DNA, 15 bp, Homo sapiens
tgagccaccgtgcct

SEQ ID NO: 29554 - DNA, 15 bp, Homo sapiens
ttgagccaccgtgcc

SEQ ID NO: 29555 - DNA, 15 bp, Homo sapiens
tttgagccaccgtgc

SEQ ID NO: 29556 - DNA, 15 bp, Homo sapiens
atttgagccaccgtg

SEQ ID NO: 29557 - DNA, 15 bp, Homo sapiens
catttgagccaccgt

SEQ ID NO: 29558 - DNA, 15 bp, Homo sapiens
gcatttgagccaccg

SEQ ID NO: 29559 - DNA, 15 bp, Homo sapiens
ggcatttgagccacc

SEQ ID NO: 29560 - DNA, 15 bp, Homo sapiens
aggcatttgagccac

SEQ ID NO: 29561 - DNA, 15 bp, Homo sapiens
caggcatttgagcca

SEQ ID NO: 29562 - DNA, 15 bp, Homo sapiens
acaggcatttgagcc

SEQ ID NO: 29563 - DNA, 15 bp, Homo sapiens
tacaggcatttgagc

SEQ ID NO: 29564 - DNA, 15 bp, Homo sapiens
ttacaggcatttgag

SEQ ID NO: 29565 - DNA, 15 bp, Homo sapiens
attacaggcatttga

SEQ ID NO: 29566 - DNA, 15 bp, Homo sapiens
gattacaggcatttg

SEQ ID NO: 29567 - DNA, 15 bp, Homo sapiens
agattacaggcattt

SEQ ID NO: 29568 - DNA, 15 bp, Homo sapiens
gagattacaggcatt

SEQ ID NO: 29569 - DNA, 15 bp, Homo sapiens
caaagtgctgagatt

SEQ ID NO: 29570 - DNA, 15 bp, Homo sapiens
ccaaagtgctgagat

SEQ ID NO: 29571 - DNA, 15 bp, Homo sapiens
cccaaagtgctgaga

SEQ ID NO: 29572 - DNA, 15 bp, Homo sapiens
tcccaaagtgctgag

SEQ ID NO: 29573 - DNA, 15 bp, Homo sapiens
agcctcggcctccca

SEQ ID NO: 29574 - DNA, 15 bp, Homo sapiens
cagcctcggcctccc

SEQ ID NO: 29575 - DNA, 15 bp, Homo sapiens
ccagcctcggcctcc

SEQ ID NO: 29576 - DNA, 15 bp, Homo sapiens
gccagcctcggcctc

SEQ ID NO: 29577 - DNA, 15 bp, Homo sapiens
tgccagcctcggcct

SEQ ID NO: 29578 - DNA, 15 bp, Homo sapiens
ctgccagcctcggcc

SEQ ID NO: 29579 - DNA, 15 bp, Homo sapiens
tctgccagcctcggc

SEQ ID NO: 29580 - DNA, 15 bp, Homo sapiens
atctgccagcctcgg

SEQ ID NO: 29581 - DNA, 15 bp, Homo sapiens
gatctgccagcctcg

SEQ ID NO: 29582 - DNA, 15 bp, Homo sapiens
tgatctgccagcctc

SEQ ID NO: 29583 - DNA, 15 bp, Homo sapiens
gtgatctgccagcct

SEQ ID NO: 29584 - DNA, 15 bp, Homo sapiens
ggtgatctgccagcc

SEQ ID NO: 29585 - DNA, 15 bp, Homo sapiens
aggtgatctgccagc

SEQ ID NO: 29586 - DNA, 15 bp, Homo sapiens
caggtgatctgccag

SEQ ID NO: 29587 - DNA, 15 bp, Homo sapiens
ccaggtgatctgcca

SEQ ID NO: 29588 - DNA, 15 bp, Homo sapiens
cccaggtgatctgcc

SEQ ID NO: 29589 - DNA, 15 bp, Homo sapiens
ccccaggtgatctgc

SEQ ID NO: 29590 - DNA, 15 bp, Homo sapiens
accccaggtgatctg

SEQ ID NO: 29591 - DNA, 15 bp, Homo sapiens
aaccccaggtgatct

SEQ ID NO: 29592 - DNA, 15 bp, Homo sapiens
caaccccaggtgatc

SEQ ID NO: 29593 - DNA, 15 bp, Homo sapiens
ccaaccccaggtgat

SEQ ID NO: 29594 - DNA, 15 bp, Homo sapiens
cccaaccccaggtga

SEQ ID NO: 29595 - DNA, 15 bp, Homo sapiens
ccccaaccccaggtg

SEQ ID NO: 29596 - DNA, 15 bp, Homo sapiens
cccccaaccccaggt

SEQ ID NO: 29597 - DNA, 15 bp, Homo sapiens
acccccaaccccagg

SEQ ID NO: 29598 - DNA, 15 bp, Homo sapiens
aacccccaaccccag

SEQ ID NO: 29599 - DNA, 15 bp, Homo sapiens
aaacccccaacccca

SEQ ID NO: 29600 - DNA, 15 bp, Homo sapiens
caaacccccaacccc

SEQ ID NO: 29601 - DNA, 15 bp, Homo sapiens
tcaaacccccaaccc

SEQ ID NO: 29602 - DNA, 15 bp, Homo sapiens
ctcaaacccccaacc

SEQ ID NO: 29603 - DNA, 15 bp, Homo sapiens
tctcaaacccccaac

SEQ ID NO: 29604 - DNA, 15 bp, Homo sapiens
gtctcaaacccccaa

SEQ ID NO: 29605 - DNA, 15 bp, Homo sapiens
ggtctcaaaccccca

SEQ ID NO: 29606 - DNA, 15 bp, Homo sapiens
tggtctcaaaccccc

SEQ ID NO: 29607 - DNA, 15 bp, Homo sapiens
ctggtctcaaacccc

SEQ ID NO: 29608 - DNA, 15 bp, Homo sapiens
gctggtctcaaaccc

SEQ ID NO: 29609 - DNA, 15 bp, Homo sapiens
ggctggtctcaaacc

SEQ ID NO: 29610 - DNA, 15 bp, Homo sapiens
tcaggctggtctcaa

SEQ ID NO: 29611 - DNA, 15 bp, Homo sapiens
gtcaggctggtctca

SEQ ID NO: 29612 - DNA, 15 bp, Homo sapiens
ggtcaggctggtctc

SEQ ID NO: 29613 - DNA, 15 bp, Homo sapiens
tggtcaggctggtct

SEQ ID NO: 29614 - DNA, 15 bp, Homo sapiens
ttggtcaggctggtc

SEQ ID NO: 29615 - DNA, 15 bp, Homo sapiens
gttggtcaggctggt

SEQ ID NO: 29616 - DNA, 15 bp, Homo sapiens
tgttggtcaggctgg

SEQ ID NO: 29617 - DNA, 15 bp, Homo sapiens
atgttggtcaggctg

SEQ ID NO: 29618 - DNA, 15 bp, Homo sapiens
ggtttctccatgttg

SEQ ID NO: 29619 - DNA, 15 bp, Homo sapiens
tggtttctccatgtt

SEQ ID NO: 29620 - DNA, 15 bp, Homo sapiens
gtggtttctccatgt

SEQ ID NO: 29621 - DNA, 15 bp, Homo sapiens
tgtggtttctccatg

SEQ ID NO: 29622 - DNA, 15 bp, Homo sapiens
atgtggtttctccat

SEQ ID NO: 29623 - DNA, 15 bp, Homo sapiens
gatgtggtttctcca

SEQ ID NO: 29624 - DNA, 15 bp, Homo sapiens
agatgtggtttctcc

SEQ ID NO: 29625 - DNA, 15 bp, Homo sapiens
gagatgtggtttctc

SEQ ID NO: 29626 - DNA, 15 bp, Homo sapiens
agagatgtggtttct

SEQ ID NO: 29627 - DNA, 15 bp, Homo sapiens
tagagatgtggtttc

SEQ ID NO: 29628 - DNA, 15 bp, Homo sapiens
gtagagatgtggttt

SEQ ID NO: 29629 - DNA, 15 bp, Homo sapiens
agtagagatgtggtt

SEQ ID NO: 29630 - DNA, 15 bp, Homo sapiens
tagtagagatgtggt

SEQ ID NO: 29631 - DNA, 15 bp, Homo sapiens
ttagtagagatgtgg

SEQ ID NO: 29632 - DNA, 15 bp, Homo sapiens
tttagtagagatgtg

SEQ ID NO: 29633 - DNA, 15 bp, Homo sapiens
ttttagtagagatgt

SEQ ID NO: 29634 - DNA, 15 bp, Homo sapiens
attttgtatttttag

SEQ ID NO: 29635 - DNA, 15 bp, Homo sapiens
aattttgtattttta

SEQ ID NO: 29636 - DNA, 15 bp, Homo sapiens
taattttgtattttt

SEQ ID NO: 29637 - DNA, 15 bp, Homo sapiens
ctaattttgtatttt

SEQ ID NO: 29638 - DNA, 15 bp, Homo sapiens
gctaattttgtattt

SEQ ID NO: 29639 - DNA, 15 bp, Homo sapiens
ggctaattttgtatt

SEQ ID NO: 29640 - DNA, 15 bp, Homo sapiens
tggctaattttgtat

SEQ ID NO: 29641 - DNA, 15 bp, Homo sapiens
ctggctaattttgta

SEQ ID NO: 29642 - DNA, 15 bp, Homo sapiens
cctggctaattttgt

SEQ ID NO: 29643 - DNA, 15 bp, Homo sapiens
acctggctaattttg

SEQ ID NO: 29644 - DNA, 15 bp, Homo sapiens
cacctggctaatttt

SEQ ID NO: 29645 - DNA, 15 bp, Homo sapiens
acacctggctaattt

SEQ ID NO: 29646 - DNA, 15 bp, Homo sapiens
cacacctggctaatt

SEQ ID NO: 29647 - DNA, 15 bp, Homo sapiens
ccacacctggctaat

SEQ ID NO: 29648 - DNA, 15 bp, Homo sapiens
accacacctggctaa

SEQ ID NO: 29649 - DNA, 15 bp, Homo sapiens
caccacacctggcta

SEQ ID NO: 29650 - DNA, 15 bp, Homo sapiens
ccaccacacctggct

SEQ ID NO: 29651 - DNA, 15 bp, Homo sapiens
gccaccacacctggc

SEQ ID NO: 29652 - DNA, 15 bp, Homo sapiens
cgccaccacacctgg

SEQ ID NO: 29653 - DNA, 15 bp, Homo sapiens
gcgccaccacacctg

SEQ ID NO: 29654 - DNA, 15 bp, Homo sapiens
tgcgccaccacacct

SEQ ID NO: 29655 - DNA, 15 bp, Homo sapiens
atgcgccaccacacc

SEQ ID NO: 29656 - DNA, 15 bp, Homo sapiens
tatgcgccaccacac

SEQ ID NO: 29657 - DNA, 15 bp, Homo sapiens
gtatgcgccaccaca

SEQ ID NO: 29658 - DNA, 15 bp, Homo sapiens
ggtatgcgccaccac

SEQ ID NO: 29659 - DNA, 15 bp, Homo sapiens
aggtatgcgccacca

SEQ ID NO: 29660 - DNA, 15 bp, Homo sapiens
caggtatgcgccacc

SEQ ID NO: 29661 - DNA, 15 bp, Homo sapiens
acaggtatgcgccac

SEQ ID NO: 29662 - DNA, 15 bp, Homo sapiens
tacaggtatgcgcca

SEQ ID NO: 29663 - DNA, 15 bp, Homo sapiens
ctacaggtatgcgcc

SEQ ID NO: 29664 - DNA, 15 bp, Homo sapiens
actacaggtatgcgc

SEQ ID NO: 29665 - DNA, 15 bp, Homo sapiens
gactacaggtatgcg

SEQ ID NO: 29666 - DNA, 15 bp, Homo sapiens
ggactacaggtatgc

SEQ ID NO: 29667 - DNA, 15 bp, Homo sapiens
gggactacaggtatg

SEQ ID NO: 29668 - DNA, 15 bp, Homo sapiens
tgggactacaggtat

SEQ ID NO: 29669 - DNA, 15 bp, Homo sapiens
ctgggactacaggta

SEQ ID NO: 29670 - DNA, 15 bp, Homo sapiens
ggtagctgggactac

SEQ ID NO: 29671 - DNA, 15 bp, Homo sapiens
gggtagctgggacta

SEQ ID NO: 29672 - DNA, 15 bp, Homo sapiens
agggtagctgggact

SEQ ID NO: 29673 - DNA, 15 bp, Homo sapiens
cagggtagctgggac

SEQ ID NO: 29674 - DNA, 15 bp, Homo sapiens
ccagggtagctggga

SEQ ID NO: 29675 - DNA, 15 bp, Homo sapiens
tccagggtagctggg

SEQ ID NO: 29676 - DNA, 15 bp, Homo sapiens
ctccagggtagctgg

SEQ ID NO: 29677 - DNA, 15 bp, Homo sapiens
cctccagggtagctg

SEQ ID NO: 29678 - DNA, 15 bp, Homo sapiens
gcctccagggtagct

SEQ ID NO: 29679 - DNA, 15 bp, Homo sapiens
agcctccagggtagc

SEQ ID NO: 29680 - DNA, 15 bp, Homo sapiens
cagcctccagggtag

SEQ ID NO: 29681 - DNA, 15 bp, Homo sapiens
tcagcctccagggta

SEQ ID NO: 29682 - DNA, 15 bp, Homo sapiens
ctcagcctccagggt

SEQ ID NO: 29683 - DNA, 15 bp, Homo sapiens
cctcagcctccaggg

SEQ ID NO: 29684 - DNA, 15 bp, Homo sapiens
gcctcagcctccagg

SEQ ID NO: 29685 - DNA, 15 bp, Homo sapiens
tgcctcagcctccag

SEQ ID NO: 29686 - DNA, 15 bp, Homo sapiens
ctgcctcagcctcca

SEQ ID NO: 29687 - DNA, 15 bp, Homo sapiens
tctgcctcagcctcc

SEQ ID NO: 29688 - DNA, 15 bp, Homo sapiens
ttctgcctcagcctc

SEQ ID NO: 29689 - DNA, 15 bp, Homo sapiens
cttctgcctcagcct

SEQ ID NO: 29690 - DNA, 15 bp, Homo sapiens
tcttctgcctcagcc

SEQ ID NO: 29691 - DNA, 15 bp, Homo sapiens
ctcttctgcctcagc

SEQ ID NO: 29692 - DNA, 15 bp, Homo sapiens
actcttctgcctcag

SEQ ID NO: 29693 - DNA, 15 bp, Homo sapiens
gactcttctgcctca

SEQ ID NO: 29694 - DNA, 15 bp, Homo sapiens
agactcttctgcctc

SEQ ID NO: 29695 - DNA, 15 bp, Homo sapiens
gagactcttctgcct

SEQ ID NO: 29696 - DNA, 15 bp, Homo sapiens
agagactcttctgcc

SEQ ID NO: 29697 - DNA, 15 bp, Homo sapiens
aagagactcttctgc

SEQ ID NO: 29698 - DNA, 15 bp, Homo sapiens
caagagactcttctg

SEQ ID NO: 29699 - DNA, 15 bp, Homo sapiens
tcaagagactcttct

SEQ ID NO: 29700 - DNA, 15 bp, Homo sapiens
ttcaagagactcttc

SEQ ID NO: 29701 - DNA, 15 bp, Homo sapiens
gttcaagagactctt

SEQ ID NO: 29702 - DNA, 15 bp, Homo sapiens
ggttcaagagactct

SEQ ID NO: 29703 - DNA, 15 bp, Homo sapiens
aggttcaagagactc

SEQ ID NO: 29704 - DNA, 15 bp, Homo sapiens
caggttcaagagact

SEQ ID NO: 29705 - DNA, 15 bp, Homo sapiens
ccaggttcaagagac

SEQ ID NO: 29706 - DNA, 15 bp, Homo sapiens
cccaggttcaagaga

SEQ ID NO: 29707 - DNA, 15 bp, Homo sapiens
tcccaggttcaagag

SEQ ID NO: 29708 - DNA, 15 bp, Homo sapiens
ctcccaggttcaaga

SEQ ID NO: 29709 - DNA, 15 bp, Homo sapiens
gacctccgcctccca

SEQ ID NO: 29710 - DNA, 15 bp, Homo sapiens
cgacctccgcctccc

SEQ ID NO: 29711 - DNA, 15 bp, Homo sapiens
gcgacctccgcctcc

SEQ ID NO: 29712 - DNA, 15 bp, Homo sapiens
tgcgacctccgcctc

SEQ ID NO: 29713 - DNA, 15 bp, Homo sapiens
ctgcgacctccgcct

SEQ ID NO: 29714 - DNA, 15 bp, Homo sapiens
actgcgacctccgcc

SEQ ID NO: 29715 - DNA, 15 bp, Homo sapiens
cactgcgacctccgc

SEQ ID NO: 29716 - DNA, 15 bp, Homo sapiens
tcactgcgacctccg

SEQ ID NO: 29717 - DNA, 15 bp, Homo sapiens
ctcactgcgacctcc

SEQ ID NO: 29718 - DNA, 15 bp, Homo sapiens
gctcactgcgacctc

SEQ ID NO: 29719 - DNA, 15 bp, Homo sapiens
agctcactgcgacct

SEQ ID NO: 29720 - DNA, 15 bp, Homo sapiens
cagctcactgcgacc

SEQ ID NO: 29721 - DNA, 15 bp, Homo sapiens
tcagctcactgcgac

SEQ ID NO: 29722 - DNA, 15 bp, Homo sapiens
ctcagctcactgcga

SEQ ID NO: 29723 - DNA, 15 bp, Homo sapiens
tctcagctcactgcg

SEQ ID NO: 29724 - DNA, 15 bp, Homo sapiens
aatctcagctcactg

SEQ ID NO: 29725 - DNA, 15 bp, Homo sapiens
caatctcagctcact

SEQ ID NO: 29726 - DNA, 15 bp, Homo sapiens
gcaatctcagctcac

SEQ ID NO: 29727 - DNA, 15 bp, Homo sapiens
cgcaatctcagctca

SEQ ID NO: 29728 - DNA, 15 bp, Homo sapiens
gcgcaatctcagctc

SEQ ID NO: 29729 - DNA, 15 bp, Homo sapiens
ggcgcaatctcagct

SEQ ID NO: 29730 - DNA, 15 bp, Homo sapiens
tggcgcaatctcagc

SEQ ID NO: 29731 - DNA, 15 bp, Homo sapiens
atggcgcaatctcag

SEQ ID NO: 29732 - DNA, 15 bp, Homo sapiens
catggcgcaatctca

SEQ ID NO: 29733 - DNA, 15 bp, Homo sapiens
ccatggcgcaatctc

SEQ ID NO: 29734 - DNA, 15 bp, Homo sapiens
gccatggcgcaatct

SEQ ID NO: 29735 - DNA, 15 bp, Homo sapiens
tgccatggcgcaatc

SEQ ID NO: 29736 - DNA, 15 bp, Homo sapiens
gtgccatggcgcaat

SEQ ID NO: 29737 - DNA, 15 bp, Homo sapiens
agtgccatggcgcaa

SEQ ID NO: 29738 - DNA, 15 bp, Homo sapiens
gagtgccatggcgca

SEQ ID NO: 29739 - DNA, 15 bp, Homo sapiens
ctggagtgccatggc

SEQ ID NO: 29740 - DNA, 15 bp, Homo sapiens
gctggagtgccatgg

SEQ ID NO: 29741 - DNA, 15 bp, Homo sapiens
ggctggagtgccatg

SEQ ID NO: 29742 - DNA, 15 bp, Homo sapiens
aggctggagtgccat

SEQ ID NO: 29743 - DNA, 15 bp, Homo sapiens
caggctggagtgcca

SEQ ID NO: 29744 - DNA, 15 bp, Homo sapiens
ccaggctggagtgcc

SEQ ID NO: 29745 - DNA, 15 bp, Homo sapiens
cttgttgcccaggct

SEQ ID NO: 29746 - DNA, 15 bp, Homo sapiens
tcttgttgcccaggc

SEQ ID NO: 29747 - DNA, 15 bp, Homo sapiens
ctcttgttgcccagg

SEQ ID NO: 29748 - DNA, 15 bp, Homo sapiens
gctcttgttgcccag

SEQ ID NO: 29749 - DNA, 15 bp, Homo sapiens
cgctcttgttgccca

SEQ ID NO: 29750 - DNA, 15 bp, Homo sapiens
tcgctcttgttgccc

SEQ ID NO: 29751 - DNA, 15 bp, Homo sapiens
ttcgctcttgttgcc

SEQ ID NO: 29752 - DNA, 15 bp, Homo sapiens
tttcgctcttgttgc

SEQ ID NO: 29753 - DNA, 15 bp, Homo sapiens
gtttcgctcttgttg

SEQ ID NO: 29754 - DNA, 15 bp, Homo sapiens
agtttcgctcttgtt

SEQ ID NO: 29755 - DNA, 15 bp, Homo sapiens
gagtttcgctcttgt

SEQ ID NO: 29756 - DNA, 15 bp, Homo sapiens
ggagtttcgctcttg

SEQ ID NO: 29757 - DNA, 15 bp, Homo sapiens
cggagtttcgctctt

SEQ ID NO: 29758 - DNA, 15 bp, Homo sapiens
gcggagtttcgctct

SEQ ID NO: 29759 - DNA, 15 bp, Homo sapiens
ggcggagtttcgctc

SEQ ID NO: 29760 - DNA, 15 bp, Homo sapiens
aggcggagtttcgct

SEQ ID NO: 29761 - DNA, 15 bp, Homo sapiens
gaggcggagtttcgc

SEQ ID NO: 29762 - DNA, 15 bp, Homo sapiens
tgaggcggagtttcg

SEQ ID NO: 29763 - DNA, 15 bp, Homo sapiens
ttgaggcggagtttc

SEQ ID NO: 29764 - DNA, 15 bp, Homo sapiens
tttgaggcggagttt

SEQ ID NO: 29765 - DNA, 15 bp, Homo sapiens
ttttgaggcggagtt

SEQ ID NO: 29766 - DNA, 15 bp, Homo sapiens
ttttttttttgaggc

SEQ ID NO: 29767 - DNA, 15 bp, Homo sapiens
ctttttttttttttg

SEQ ID NO: 29768 - DNA, 15 bp, Homo sapiens
tttttcttttttttt

SEQ ID NO: 29769 - DNA, 15 bp, Homo sapiens
ttttttctttttttt

SEQ ID NO: 29770 - DNA, 15 bp, Homo sapiens
attttttttcttttt

SEQ ID NO: 29771 - DNA, 15 bp, Homo sapiens
cattttttttctttt

SEQ ID NO: 29772 - DNA, 15 bp, Homo sapiens
gcattttttttcttt

SEQ ID NO: 29773 - DNA, 15 bp, Homo sapiens
tgcattttttttctt

SEQ ID NO: 29774 - DNA, 15 bp, Homo sapiens
ctgcattttttttct

SEQ ID NO: 29775 - DNA, 15 bp, Homo sapiens
tctgcattttttttc

SEQ ID NO: 29776 - DNA, 15 bp, Homo sapiens
ttctgcatttttttt

SEQ ID NO: 29777 - DNA, 15 bp, Homo sapiens
tttctgcattttttt

SEQ ID NO: 29778 - DNA, 15 bp, Homo sapiens
gtttctgcatttttt

SEQ ID NO: 29779 - DNA, 15 bp, Homo sapiens
ggtttctgcattttt

SEQ ID NO: 29780 - DNA, 15 bp, Homo sapiens
aggtttctgcatttt

SEQ ID NO: 29781 - DNA, 15 bp, Homo sapiens
caggtttctgcattt

SEQ ID NO: 29782 - DNA, 15 bp, Homo sapiens
acaggtttctgcatt

SEQ ID NO: 29783 - DNA, 15 bp, Homo sapiens
gacaggtttctgcat

SEQ ID NO: 29784 - DNA, 15 bp, Homo sapiens
agacaggtttctgca

SEQ ID NO: 29785 - DNA, 15 bp, Homo sapiens
gagacaggtttctgc

SEQ ID NO: 29786 - DNA, 15 bp, Homo sapiens
tgagacaggtttctg

SEQ ID NO: 29787 - DNA, 15 bp, Homo sapiens
ttgagacaggtttct

SEQ ID NO: 29788 - DNA, 15 bp, Homo sapiens
attgagacaggtttc

SEQ ID NO: 29789 - DNA, 15 bp, Homo sapiens
cattgagacaggttt

SEQ ID NO: 29790 - DNA, 15 bp, Homo sapiens
acattgagacaggtt

SEQ ID NO: 29791 - DNA, 15 bp, Homo sapiens
aacattgagacaggt

SEQ ID NO: 29792 - DNA, 15 bp, Homo sapiens
aaacattgagacagg

SEQ ID NO: 29793 - DNA, 15 bp, Homo sapiens
taaacattgagacag

SEQ ID NO: 29794 - DNA, 15 bp, Homo sapiens
ttaaacattgagaca

SEQ ID NO: 29795 - DNA, 15 bp, Homo sapiens
gttaaacattgagac

SEQ ID NO: 29796 - DNA, 15 bp, Homo sapiens
agttaaacattgaga

SEQ ID NO: 29797 - DNA, 15 bp, Homo sapiens
cagttaaacattgag

SEQ ID NO: 29798 - DNA, 15 bp, Homo sapiens
ccagttaaacattga

SEQ ID NO: 29799 - DNA, 15 bp, Homo sapiens
cccagttaaacattg

SEQ ID NO: 29800 - DNA, 15 bp, Homo sapiens
gcccagttaaacatt

SEQ ID NO: 29801 - DNA, 15 bp, Homo sapiens
tgcccagttaaacat

SEQ ID NO: 29802 - DNA, 15 bp, Homo sapiens
atgcccagttaaaca

SEQ ID NO: 29803 - DNA, 15 bp, Homo sapiens
aatgcccagttaaac

SEQ ID NO: 29804 - DNA, 15 bp, Homo sapiens
aaatgcccagttaaa

SEQ ID NO: 29805 - DNA, 15 bp, Homo sapiens
aaaatgcccagttaa

SEQ ID NO: 29806 - DNA, 15 bp, Homo sapiens
aaaaatgcccagtta

SEQ ID NO: 29807 - DNA, 15 bp, Homo sapiens
gaaaaatgcccagtt

SEQ ID NO: 29808 - DNA, 15 bp, Homo sapiens
tgaaaaatgcccagt

SEQ ID NO: 29809 - DNA, 15 bp, Homo sapiens
ttgaaaaatgcccag

SEQ ID NO: 29810 - DNA, 15 bp, Homo sapiens
tttgaaaaatgccca

SEQ ID NO: 29811 - DNA, 15 bp, Homo sapiens
gtttgaaaaatgccc

SEQ ID NO: 29812 - DNA, 15 bp, Homo sapiens
agtttgaaaaatgcc

SEQ ID NO: 29813 - DNA, 15 bp, Homo sapiens
tagtttgaaaaatgc

SEQ ID NO: 29814 - DNA, 15 bp, Homo sapiens
ctagtttgaaaaatg

SEQ ID NO: 29815 - DNA, 15 bp, Homo sapiens
cctagtttgaaaaat

SEQ ID NO: 29816 - DNA, 15 bp, Homo sapiens
ccctagtttgaaaaa

SEQ ID NO: 29817 - DNA, 15 bp, Homo sapiens
cccctagtttgaaaa

SEQ ID NO: 29818 - DNA, 15 bp, Homo sapiens
tcccctagtttgaaa

SEQ ID NO: 29819 - DNA, 15 bp, Homo sapiens
gtcccctagtttgaa

SEQ ID NO: 29820 - DNA, 15 bp, Homo sapiens
tgtcccctagtttga

SEQ ID NO: 29821 - DNA, 15 bp, Homo sapiens
ttgtcccctagtttg

SEQ ID NO: 29822 - DNA, 15 bp, Homo sapiens
tttgtcccctagttt

SEQ ID NO: 29823 - DNA, 15 bp, Homo sapiens
ttttgtcccctagtt

SEQ ID NO: 29824 - DNA, 15 bp, Homo sapiens
tttttgtcccctagt

SEQ ID NO: 29825 - DNA, 15 bp, Homo sapiens
gtttttgtcccctag

SEQ ID NO: 29826 - DNA, 15 bp, Homo sapiens
agtttttgtccccta

SEQ ID NO: 29827 - DNA, 15 bp, Homo sapiens
tagtttttgtcccct

SEQ ID NO: 29828 - DNA, 15 bp, Homo sapiens
ctagtttttgtcccc

SEQ ID NO: 29829 - DNA, 15 bp, Homo sapiens
tctagtttttgtccc

SEQ ID NO: 29830 - DNA, 15 bp, Homo sapiens
ttctagtttttgtcc

SEQ ID NO: 29831 - DNA, 15 bp, Homo sapiens
gttctagtttttgtc

SEQ ID NO: 29832 - DNA, 15 bp, Homo sapiens
agttctagtttttgt

SEQ ID NO: 29833 - DNA, 15 bp, Homo sapiens
aagttctagtttttg

SEQ ID NO: 29834 - DNA, 15 bp, Homo sapiens
caagttctagttttt

SEQ ID NO: 29835 - DNA, 15 bp, Homo sapiens
gcaagttctagtttt

SEQ ID NO: 29836 - DNA, 15 bp, Homo sapiens
ggcaagttctagttt

SEQ ID NO: 29837 - DNA, 15 bp, Homo sapiens
tggcaagttctagtt

SEQ ID NO: 29838 - DNA, 15 bp, Homo sapiens
gtggcaagttctagt

SEQ ID NO: 29839 - DNA, 15 bp, Homo sapiens
agtggcaagttctag

SEQ ID NO: 29840 - DNA, 15 bp, Homo sapiens
aagtggcaagttcta

SEQ ID NO: 29841 - DNA, 15 bp, Homo sapiens
aaagtggcaagttct

SEQ ID NO: 29842 - DNA, 15 bp, Homo sapiens
aaaagtggcaagttc

SEQ ID NO: 29843 - DNA, 15 bp, Homo sapiens
taaaagtggcaagtt

SEQ ID NO: 29844 - DNA, 15 bp, Homo sapiens
ataaaagtggcaagt

SEQ ID NO: 29845 - DNA, 15 bp, Homo sapiens
aataaaagtggcaag

SEQ ID NO: 29846 - DNA, 15 bp, Homo sapiens
aaataaaagtggcaa

SEQ ID NO: 29847 - DNA, 15 bp, Homo sapiens
taaataaaagtggca

SEQ ID NO: 29848 - DNA, 15 bp, Homo sapiens
ttaaataaaagtggc

SEQ ID NO: 29849 - DNA, 15 bp, Homo sapiens
tttaaataaaagtgg

SEQ ID NO: 29850 - DNA, 15 bp, Homo sapiens
ctttaaataaaagtg

SEQ ID NO: 29851 - DNA, 15 bp, Homo sapiens
actttaaataaaagt

SEQ ID NO: 29852 - DNA, 15 bp, Homo sapiens
cactttaaataaaag

SEQ ID NO: 29853 - DNA, 15 bp, Homo sapiens
tcactttaaataaaa

SEQ ID NO: 29854 - DNA, 15 bp, Homo sapiens
atcactttaaataaa

SEQ ID NO: 29855 - DNA, 15 bp, Homo sapiens
catcactttaaataa

SEQ ID NO: 29856 - DNA, 15 bp, Homo sapiens
gcatcactttaaata

SEQ ID NO: 29857 - DNA, 15 bp, Homo sapiens
agcatcactttaaat

SEQ ID NO: 29858 - DNA, 15 bp, Homo sapiens
gagcatcactttaaa

SEQ ID NO: 29859 - DNA, 15 bp, Homo sapiens
agagcatcactttaa

SEQ ID NO: 29860 - DNA, 15 bp, Homo sapiens
aagagcatcacttta

SEQ ID NO: 29861 - DNA, 15 bp, Homo sapiens
taagagcatcacttt

SEQ ID NO: 29862 - DNA, 15 bp, Homo sapiens
ataagagcatcactt

SEQ ID NO: 29863 - DNA, 15 bp, Homo sapiens
aataagagcatcact

SEQ ID NO: 29864 - DNA, 15 bp, Homo sapiens
aaataagagcatcac

SEQ ID NO: 29865 - DNA, 15 bp, Homo sapiens
aaaataagagcatca

SEQ ID NO: 29866 - DNA, 15 bp, Homo sapiens
taaaataagagcatc

SEQ ID NO: 29867 - DNA, 15 bp, Homo sapiens
ctaaaataagagcat

SEQ ID NO: 29868 - DNA, 15 bp, Homo sapiens
tctaaaataagagca

SEQ ID NO: 29869 - DNA, 15 bp, Homo sapiens
gtctaaaataagagc

SEQ ID NO: 29870 - DNA, 15 bp, Homo sapiens
ggtctaaaataagag

SEQ ID NO: 29871 - DNA, 15 bp, Homo sapiens
tggtctaaaataaga

SEQ ID NO: 29872 - DNA, 15 bp, Homo sapiens
ttggtctaaaataag

SEQ ID NO: 29873 - DNA, 15 bp, Homo sapiens
attggtctaaaataa

SEQ ID NO: 29874 - DNA, 15 bp, Homo sapiens
gattggtctaaaata

SEQ ID NO: 29875 - DNA, 15 bp, Homo sapiens
agattggtctaaaat

SEQ ID NO: 29876 - DNA, 15 bp, Homo sapiens
cagattggtctaaaa

SEQ ID NO: 29877 - DNA, 15 bp, Homo sapiens
tcagattggtctaaa

SEQ ID NO: 29878 - DNA, 15 bp, Homo sapiens
gtcagattggtctaa

SEQ ID NO: 29879 - DNA, 15 bp, Homo sapiens
ggtcagattggtcta

SEQ ID NO: 29880 - DNA, 15 bp, Homo sapiens
aggtcagattggtct

SEQ ID NO: 29881 - DNA, 15 bp, Homo sapiens
aaggtcagattggtc

SEQ ID NO: 29882 - DNA, 15 bp, Homo sapiens
gaaggtcagattggt

SEQ ID NO: 29883 - DNA, 15 bp, Homo sapiens
cgaaggtcagattgg

SEQ ID NO: 29884 - DNA, 15 bp, Homo sapiens
acgaaggtcagattg

SEQ ID NO: 29885 - DNA, 15 bp, Homo sapiens
aacgaaggtcagatt

SEQ ID NO: 29886 - DNA, 15 bp, Homo sapiens
caacgaaggtcagat

SEQ ID NO: 29887 - DNA, 15 bp, Homo sapiens
ccaacgaaggtcaga

SEQ ID NO: 29888 - DNA, 15 bp, Homo sapiens
gccaacgaaggtcag

SEQ ID NO: 29889 - DNA, 15 bp, Homo sapiens
agccaacgaaggtca

SEQ ID NO: 29890 - DNA, 15 bp, Homo sapiens
cagccaacgaaggtc

SEQ ID NO: 29891 - DNA, 15 bp, Homo sapiens
gcagccaacgaaggt

SEQ ID NO: 29892 - DNA, 15 bp, Homo sapiens
cgcagccaacgaagg

SEQ ID NO: 29893 - DNA, 15 bp, Homo sapiens
acgcagccaacgaag

SEQ ID NO: 29894 - DNA, 15 bp, Homo sapiens
cacgcagccaacgaa

SEQ ID NO: 29895 - DNA, 15 bp, Homo sapiens
ccacgcagccaacga

SEQ ID NO: 29896 - DNA, 15 bp, Homo sapiens
cccacgcagccaacg

SEQ ID NO: 29897 - DNA, 15 bp, Homo sapiens
gcccacgcagccaac

SEQ ID NO: 29898 - DNA, 15 bp, Homo sapiens
tgcccacgcagccaa

SEQ ID NO: 29899 - DNA, 15 bp, Homo sapiens
atgcccacgcagcca

SEQ ID NO: 29900 - DNA, 15 bp, Homo sapiens
catgcccacgcagcc

SEQ ID NO: 29901 - DNA, 15 bp, Homo sapiens
gcatgcccacgcagc

SEQ ID NO: 29902 - DNA, 15 bp, Homo sapiens
agcatgcccacgcag

SEQ ID NO: 29903 - DNA, 15 bp, Homo sapiens
cagcatgcccacgca

SEQ ID NO: 29904 - DNA, 15 bp, Homo sapiens
ccagcatgcccacgc

SEQ ID NO: 29905 - DNA, 15 bp, Homo sapiens
tccagcatgcccacg

SEQ ID NO: 29906 - DNA, 15 bp, Homo sapiens
atccagcatgcccac

SEQ ID NO: 29907 - DNA, 15 bp, Homo sapiens
gatccagcatgccca

SEQ ID NO: 29908 - DNA, 15 bp, Homo sapiens
ggatccagcatgccc

SEQ ID NO: 29909 - DNA, 15 bp, Homo sapiens
aggatccagcatgcc

SEQ ID NO: 29910 - DNA, 15 bp, Homo sapiens
gaggatccagcatgc

SEQ ID NO: 29911 - DNA, 15 bp, Homo sapiens
ggaggatccagcatg

SEQ ID NO: 29912 - DNA, 15 bp, Homo sapiens
cggaggatccagcat

SEQ ID NO: 29913 - DNA, 15 bp, Homo sapiens
tcggaggatccagca

SEQ ID NO: 29914 - DNA, 15 bp, Homo sapiens
ctcggaggatccagc

SEQ ID NO: 29915 - DNA, 15 bp, Homo sapiens
tctcggaggatccag

SEQ ID NO: 29916 - DNA, 15 bp, Homo sapiens
ttctcggaggatcca

SEQ ID NO: 29917 - DNA, 15 bp, Homo sapiens
attctcggaggatcc

SEQ ID NO: 29918 - DNA, 15 bp, Homo sapiens
gattctcggaggatc

SEQ ID NO: 29919 - DNA, 15 bp, Homo sapiens
cgattctcggaggat

SEQ ID NO: 29920 - DNA, 15 bp, Homo sapiens
tcgattctcggagga

SEQ ID NO: 29921 - DNA, 15 bp, Homo sapiens
ctcgattctcggagg

SEQ ID NO: 29922 - DNA, 15 bp, Homo sapiens
cctcgattctcggag

SEQ ID NO: 29923 - DNA, 15 bp, Homo sapiens
acctcgattctcgga

SEQ ID NO: 29924 - DNA, 15 bp, Homo sapiens
cacctcgattctcgg

SEQ ID NO: 29925 - DNA, 15 bp, Homo sapiens
ccacctcgattctcg

SEQ ID NO: 29926 - DNA, 15 bp, Homo sapiens
gccacctcgattctc

SEQ ID NO: 29927 - DNA, 15 bp, Homo sapiens
ggccacctcgattct

SEQ ID NO: 29928 - DNA, 15 bp, Homo sapiens
aggccacctcgattc

SEQ ID NO: 29929 - DNA, 15 bp, Homo sapiens
gaggccacctcgatt

SEQ ID NO: 29930 - DNA, 15 bp, Homo sapiens
ggaggccacctcgat

SEQ ID NO: 29931 - DNA, 15 bp, Homo sapiens
aggaggccacctcga

SEQ ID NO: 29932 - DNA, 15 bp, Homo sapiens
gaggaggccacctcg

SEQ ID NO: 29933 - DNA, 15 bp, Homo sapiens
ggaggaggccacctc

SEQ ID NO: 29934 - DNA, 15 bp, Homo sapiens
cggaggaggccacct

SEQ ID NO: 29935 - DNA, 15 bp, Homo sapiens
acggaggaggccacc

SEQ ID NO: 29936 - DNA, 15 bp, Homo sapiens
cacggaggaggccac

SEQ ID NO: 29937 - DNA, 15 bp, Homo sapiens
tcacggaggaggcca

SEQ ID NO: 29938 - DNA, 15 bp, Homo sapiens
ttcacggaggaggcc

SEQ ID NO: 29939 - DNA, 15 bp, Homo sapiens
cttcacggaggaggc

SEQ ID NO: 29940 - DNA, 15 bp, Homo sapiens
gcttcacggaggagg

SEQ ID NO: 29941 - DNA, 15 bp, Homo sapiens
agcttcacggaggag

SEQ ID NO: 29942 - DNA, 15 bp, Homo sapiens
cagcttcacggagga

SEQ ID NO: 29943 - DNA, 15 bp, Homo sapiens
acagcttcacggagg

SEQ ID NO: 29944 - DNA, 15 bp, Homo sapiens
cacagcttcacggag

SEQ ID NO: 29945 - DNA, 15 bp, Homo sapiens
gcacagcttcacgga

SEQ ID NO: 29946 - DNA, 15 bp, Homo sapiens
ggcacagcttcacgg

SEQ ID NO: 29947 - DNA, 15 bp, Homo sapiens
cggcacagcttcacg

SEQ ID NO: 29948 - DNA, 15 bp, Homo sapiens
ccggcacagcttcac

SEQ ID NO: 29949 - DNA, 15 bp, Homo sapiens
gccggcacagcttca

SEQ ID NO: 29950 - DNA, 15 bp, Homo sapiens
tgccggcacagcttc

SEQ ID NO: 29951 - DNA, 15 bp, Homo sapiens
ttgccggcacagctt

SEQ ID NO: 29952 - DNA, 15 bp, Homo sapiens
cttgccggcacagct

SEQ ID NO: 29953 - DNA, 15 bp, Homo sapiens
gcttgccggcacagc

SEQ ID NO: 29954 - DNA, 15 bp, Homo sapiens
tgcttgccggcacag

SEQ ID NO: 29955 - DNA, 15 bp, Homo sapiens
ctgcttgccggcaca

SEQ ID NO: 29956 - DNA, 15 bp, Homo sapiens
cctgcttgccggcac

SEQ ID NO: 29957 - DNA, 15 bp, Homo sapiens
gcctgcttgccggca

SEQ ID NO: 29958 - DNA, 15 bp, Homo sapiens
tgcctgcttgccggc

SEQ ID NO: 29959 - DNA, 15 bp, Homo sapiens
atgcctgcttgccgg

SEQ ID NO: 29960 - DNA, 15 bp, Homo sapiens
gatgcctgcttgccg

SEQ ID NO: 29961 - DNA, 15 bp, Homo sapiens
ggatgcctgcttgcc

SEQ ID NO: 29962 - DNA, 15 bp, Homo sapiens
cggatgcctgcttgc

SEQ ID NO: 29963 - DNA, 15 bp, Homo sapiens
ccggatgcctgcttg

SEQ ID NO: 29964 - DNA, 15 bp, Homo sapiens
cccggatgcctgctt

SEQ ID NO: 29965 - DNA, 15 bp, Homo sapiens
acccggatgcctgct

SEQ ID NO: 29966 - DNA, 15 bp, Homo sapiens
gacccggatgcctgc

SEQ ID NO: 29967 - DNA, 15 bp, Homo sapiens
tgacccggatgcctg

SEQ ID NO: 29968 - DNA, 15 bp, Homo sapiens
atgacccggatgcct

SEQ ID NO: 29969 - DNA, 15 bp, Homo sapiens
gatgacccggatgcc

SEQ ID NO: 29970 - DNA, 15 bp, Homo sapiens
tgatgacccggatgc

SEQ ID NO: 29971 - DNA, 15 bp, Homo sapiens
atgatgacccggatg

SEQ ID NO: 29972 - DNA, 15 bp, Homo sapiens
catgatgacccggat

SEQ ID NO: 29973 - DNA, 15 bp, Homo sapiens
tcatgatgacccgga

SEQ ID NO: 29974 - DNA, 15 bp, Homo sapiens
atcatgatgacccgg

SEQ ID NO: 29975 - DNA, 15 bp, Homo sapiens
gatcatgatgacccg

SEQ ID NO: 29976 - DNA, 15 bp, Homo sapiens
tgatcatgatgaccc

SEQ ID NO: 29977 - DNA, 15 bp, Homo sapiens
gtgatcatgatgacc

SEQ ID NO: 29978 - DNA, 15 bp, Homo sapiens
agtgatcatgatgac

SEQ ID NO: 29979 - DNA, 15 bp, Homo sapiens
cagtgatcatgatga

SEQ ID NO: 29980 - DNA, 15 bp, Homo sapiens
ccagtgatcatgatg

SEQ ID NO: 29981 - DNA, 15 bp, Homo sapiens
cccagtgatcatgat

SEQ ID NO: 29982 - DNA, 15 bp, Homo sapiens
ccccagtgatcatga

SEQ ID NO: 29983 - DNA, 15 bp, Homo sapiens
tccccagtgatcatg

SEQ ID NO: 29984 - DNA, 15 bp, Homo sapiens
gtccccagtgatcat

SEQ ID NO: 29985 - DNA, 15 bp, Homo sapiens
tgtccccagtgatca

SEQ ID NO: 29986 - DNA, 15 bp, Homo sapiens
ttgtccccagtgatc

SEQ ID NO: 29987 - DNA, 15 bp, Homo sapiens
gttgtccccagtgat

SEQ ID NO: 29988 - DNA, 15 bp, Homo sapiens
tgttgtccccagtga

SEQ ID NO: 29989 - DNA, 15 bp, Homo sapiens
ttgttgtccccagtg

SEQ ID NO: 29990 - DNA, 15 bp, Homo sapiens
cttgttgtccccagt

SEQ ID NO: 29991 - DNA, 15 bp, Homo sapiens
ccttgttgtccccag

SEQ ID NO: 29992 - DNA, 15 bp, Homo sapiens
cccttgttgtcccca

SEQ ID NO: 29993 - DNA, 15 bp, Homo sapiens
gcccttgttgtcccc

SEQ ID NO: 29994 - DNA, 15 bp, Homo sapiens
tgcccttgttgtccc

SEQ ID NO: 29995 - DNA, 15 bp, Homo sapiens
gtgcccttgttgtcc

SEQ ID NO: 29996 - DNA, 15 bp, Homo sapiens
agtgcccttgttgtc

SEQ ID NO: 29997 - DNA, 15 bp, Homo sapiens
cagtgcccttgttgt

SEQ ID NO: 29998 - DNA, 15 bp, Homo sapiens
gcagtgcccttgttg

SEQ ID NO: 29999 - DNA, 15 bp, Homo sapiens
agcagtgcccttgtt

SEQ ID NO: 30000 - DNA, 15 bp, Homo sapiens
cagcagtgcccttgt

SEQ ID NO: 30001 - DNA, 15 bp, Homo sapiens
acagcagtgcccttg

SEQ ID NO: 30002 - DNA, 15 bp, Homo sapiens
cacagcagtgccctt

SEQ ID NO: 30003 - DNA, 15 bp, Homo sapiens
ccacagcagtgccct

SEQ ID NO: 30004 - DNA, 15 bp, Homo sapiens
gccacagcagtgccc

SEQ ID NO: 30005 - DNA, 15 bp, Homo sapiens
ggccacagcagtgcc

SEQ ID NO: 30006 - DNA, 15 bp, Homo sapiens
tggccacagcagtgc

SEQ ID NO: 30007 - DNA, 15 bp, Homo sapiens
atggccacagcagtg

SEQ ID NO: 30008 - DNA, 15 bp, Homo sapiens
gatggccacagcagt

SEQ ID NO: 30009 - DNA, 15 bp, Homo sapiens
agatggccacagcag

SEQ ID NO: 30010 - DNA, 15 bp, Homo sapiens
cagatggccacagca

SEQ ID NO: 30011 - DNA, 15 bp, Homo sapiens
acagatggccacagc

SEQ ID NO: 30012 - DNA, 15 bp, Homo sapiens
gacagatggccacag

SEQ ID NO: 30013 - DNA, 15 bp, Homo sapiens
cgacagatggccaca

SEQ ID NO: 30014 - DNA, 15 bp, Homo sapiens
gcgacagatggccac

SEQ ID NO: 30015 - DNA, 15 bp, Homo sapiens
ggcgacagatggcca

SEQ ID NO: 30016 - DNA, 15 bp, Homo sapiens
cggcgacagatggcc

SEQ ID NO: 30017 - DNA, 15 bp, Homo sapiens
gcggcgacagatggc

SEQ ID NO: 30018 - DNA, 15 bp, Homo sapiens
tgcggcgacagatgg

SEQ ID NO: 30019 - DNA, 15 bp, Homo sapiens
atgcggcgacagatg

SEQ ID NO: 30020 - DNA, 15 bp, Homo sapiens
gatgcggcgacagat

SEQ ID NO: 30021 - DNA, 15 bp, Homo sapiens
cgatgcggcgacaga

SEQ ID NO: 30022 - DNA, 15 bp, Homo sapiens
ccgatgcggcgacag

SEQ ID NO: 30023 - DNA, 15 bp, Homo sapiens
gccgatgcggcgaca

SEQ ID NO: 30024 - DNA, 15 bp, Homo sapiens
tgccgatgcggcgac

SEQ ID NO: 30025 - DNA, 15 bp, Homo sapiens
atgccgatgcggcga

SEQ ID NO: 30026 - DNA, 15 bp, Homo sapiens
gatgccgatgcggcg

SEQ ID NO: 30027 - DNA, 15 bp, Homo sapiens
agatgccgatgcggc

SEQ ID NO: 30028 - DNA, 15 bp, Homo sapiens
aagatgccgatgcgg

SEQ ID NO: 30029 - DNA, 15 bp, Homo sapiens
gaagatgccgatgcg

SEQ ID NO: 30030 - DNA, 15 bp, Homo sapiens
cgaagatgccgatgc

SEQ ID NO: 30031 - DNA, 15 bp, Homo sapiens
ccgaagatgccgatg

SEQ ID NO: 30032 - DNA, 15 bp, Homo sapiens
cccgaagatgccgat

SEQ ID NO: 30033 - DNA, 15 bp, Homo sapiens
gcccgaagatgccga

SEQ ID NO: 30034 - DNA, 15 bp, Homo sapiens
tgcccgaagatgccg

SEQ ID NO: 30035 - DNA, 15 bp, Homo sapiens
ctgcccgaagatgcc

SEQ ID NO: 30036 - DNA, 15 bp, Homo sapiens
cctgcccgaagatgc

SEQ ID NO: 30037 - DNA, 15 bp, Homo sapiens
tcctgcccgaagatg

SEQ ID NO: 30038 - DNA, 15 bp, Homo sapiens
atcctgcccgaagat

SEQ ID NO: 30039 - DNA, 15 bp, Homo sapiens
catcctgcccgaaga

SEQ ID NO: 30040 - DNA, 15 bp, Homo sapiens
tcatcctgcccgaag

SEQ ID NO: 30041 - DNA, 15 bp, Homo sapiens
ctcatcctgcccgaa

SEQ ID NO: 30042 - DNA, 15 bp, Homo sapiens
cctcatcctgcccga

SEQ ID NO: 30043 - DNA, 15 bp, Homo sapiens
tcctcatcctgcccg

SEQ ID NO: 30044 - DNA, 15 bp, Homo sapiens
gtcctcatcctgccc

SEQ ID NO: 30045 - DNA, 15 bp, Homo sapiens
cgtcctcatcctgcc

SEQ ID NO: 30046 - DNA, 15 bp, Homo sapiens
acgtcctcatcctgc

SEQ ID NO: 30047 - DNA, 15 bp, Homo sapiens
cacgtcctcatcctg

SEQ ID NO: 30048 - DNA, 15 bp, Homo sapiens
tcacgtcctcatcct

SEQ ID NO: 30049 - DNA, 15 bp, Homo sapiens
gtcacgtcctcatcc

SEQ ID NO: 30050 - DNA, 15 bp, Homo sapiens
cgtcacgtcctcatc

SEQ ID NO: 30051 - DNA, 15 bp, Homo sapiens
acgtcacgtcctcat

SEQ ID NO: 30052 - DNA, 15 bp, Homo sapiens
gacgtcacgtcctca

SEQ ID NO: 30053 - DNA, 15 bp, Homo sapiens
tgacgtcacgtcctc

SEQ ID NO: 30054 - DNA, 15 bp, Homo sapiens
ttgacgtcacgtcct

SEQ ID NO: 30055 - DNA, 15 bp, Homo sapiens
tttgacgtcacgtcc

SEQ ID NO: 30056 - DNA, 15 bp, Homo sapiens
ttttgacgtcacgtc

SEQ ID NO: 30057 - DNA, 15 bp, Homo sapiens
cttttgacgtcacgt

SEQ ID NO: 30058 - DNA, 15 bp, Homo sapiens
gcttttgacgtcacg

SEQ ID NO: 30059 - DNA, 15 bp, Homo sapiens
agcttttgacgtcac

SEQ ID NO: 30060 - DNA, 15 bp, Homo sapiens
aagcttttgacgtca

SEQ ID NO: 30061 - DNA, 15 bp, Homo sapiens
aaagcttttgacgtc

SEQ ID NO: 30062 - DNA, 15 bp, Homo sapiens
gaaagcttttgacgt

SEQ ID NO: 30063 - DNA, 15 bp, Homo sapiens
tgaaagcttttgacg

SEQ ID NO: 30064 - DNA, 15 bp, Homo sapiens
gtgaaagcttttgac

SEQ ID NO: 30065 - DNA, 15 bp, Homo sapiens
tgtgaaagcttttga

SEQ ID NO: 30066 - DNA, 15 bp, Homo sapiens
ctgtgaaagcttttg

SEQ ID NO: 30067 - DNA, 15 bp, Homo sapiens
cctgtgaaagctttt

SEQ ID NO: 30068 - DNA, 15 bp, Homo sapiens
gcctgtgaaagcttt

SEQ ID NO: 30069 - DNA, 15 bp, Homo sapiens
ggcctgtgaaagctt

SEQ ID NO: 30070 - DNA, 15 bp, Homo sapiens
cggcctgtgaaagct

SEQ ID NO: 30071 - DNA, 15 bp, Homo sapiens
ccggcctgtgaaagc

SEQ ID NO: 30072 - DNA, 15 bp, Homo sapiens
cccggcctgtgaaag

SEQ ID NO: 30073 - DNA, 15 bp, Homo sapiens
tcccggcctgtgaaa

SEQ ID NO: 30074 - DNA, 15 bp, Homo sapiens
ctcccggcctgtgaa

SEQ ID NO: 30075 - DNA, 15 bp, Homo sapiens
actcccggcctgtga

SEQ ID NO: 30076 - DNA, 15 bp, Homo sapiens
aactcccggcctgtg

SEQ ID NO: 30077 - DNA, 15 bp, Homo sapiens
aaactcccggcctgt

SEQ ID NO: 30078 - DNA, 15 bp, Homo sapiens
caaactcccggcctg

SEQ ID NO: 30079 - DNA, 15 bp, Homo sapiens
tcaaactcccggcct

SEQ ID NO: 30080 - DNA, 15 bp, Homo sapiens
atcaaactcccggcc

SEQ ID NO: 30081 - DNA, 15 bp, Homo sapiens
catcaaactcccggc

SEQ ID NO: 30082 - DNA, 15 bp, Homo sapiens
tcatcaaactcccgg

SEQ ID NO: 30083 - DNA, 15 bp, Homo sapiens
ttcatcaaactcccg

SEQ ID NO: 30084 - DNA, 15 bp, Homo sapiens
gttcatcaaactccc

SEQ ID NO: 30085 - DNA, 15 bp, Homo sapiens
agttcatcaaactcc

SEQ ID NO: 30086 - DNA, 15 bp, Homo sapiens
gagttcatcaaactc

SEQ ID NO: 30087 - DNA, 15 bp, Homo sapiens
tgagttcatcaaact

SEQ ID NO: 30088 - DNA, 15 bp, Homo sapiens
ttgagttcatcaaac

SEQ ID NO: 30089 - DNA, 15 bp, Homo sapiens
gttgagttcatcaaa

SEQ ID NO: 30090 - DNA, 15 bp, Homo sapiens
ggttgagttcatcaa

SEQ ID NO: 30091 - DNA, 15 bp, Homo sapiens
gggttgagttcatca

SEQ ID NO: 30092 - DNA, 15 bp, Homo sapiens
ggggttgagttcatc

SEQ ID NO: 30093 - DNA, 15 bp, Homo sapiens
aggggttgagttcat

SEQ ID NO: 30094 - DNA, 15 bp, Homo sapiens
gaggggttgagttca

SEQ ID NO: 30095 - DNA, 15 bp, Homo sapiens
ggaggggttgagttc

SEQ ID NO: 30096 - DNA, 15 bp, Homo sapiens
cggaggggttgagtt

SEQ ID NO: 30097 - DNA, 15 bp, Homo sapiens
gcggaggggttgagt

SEQ ID NO: 30098 - DNA, 15 bp, Homo sapiens
ggcggaggggttgag

SEQ ID NO: 30099 - DNA, 15 bp, Homo sapiens
gggcggaggggttga

SEQ ID NO: 30100 - DNA, 15 bp, Homo sapiens
tgggcggaggggttg

SEQ ID NO: 30101 - DNA, 15 bp, Homo sapiens
ctgggcggaggggtt

SEQ ID NO: 30102 - DNA, 15 bp, Homo sapiens
gctgggcggaggggt

SEQ ID NO: 30103 - DNA, 15 bp, Homo sapiens
cgctgggcggagggg

SEQ ID NO: 30104 - DNA, 15 bp, Homo sapiens
tcgctgggcggaggg

SEQ ID NO: 30105 - DNA, 15 bp, Homo sapiens
ctcgctgggcggagg

SEQ ID NO: 30106 - DNA, 15 bp, Homo sapiens
tctcgctgggcggag

SEQ ID NO: 30107 - DNA, 15 bp, Homo sapiens
gtctcgctgggcgga

SEQ ID NO: 30108 - DNA, 15 bp, Homo sapiens
cgtctcgctgggcgg

SEQ ID NO: 30109 - DNA, 15 bp, Homo sapiens
gcgtctcgctgggcg

SEQ ID NO: 30110 - DNA, 15 bp, Homo sapiens
ggcgtctcgctgggc

SEQ ID NO: 30111 - DNA, 15 bp, Homo sapiens
aggcgtctcgctggg

SEQ ID NO: 30112 - DNA, 15 bp, Homo sapiens
caggcgtctcgctgg

SEQ ID NO: 30113 - DNA, 15 bp, Homo sapiens
gcaggcgtctcgctg

SEQ ID NO: 30114 - DNA, 15 bp, Homo sapiens
ggcaggcgtctcgct

SEQ ID NO: 30115 - DNA, 15 bp, Homo sapiens
aggcaggcgtctcgc

SEQ ID NO: 30116 - DNA, 15 bp, Homo sapiens
caggcaggcgtctcg

SEQ ID NO: 30117 - DNA, 15 bp, Homo sapiens
tcaggcaggcgtctc

SEQ ID NO: 30118 - DNA, 15 bp, Homo sapiens
ttcaggcaggcgtct

SEQ ID NO: 30119 - DNA, 15 bp, Homo sapiens
gttcaggcaggcgtc

SEQ ID NO: 30120 - DNA, 15 bp, Homo sapiens
cgttcaggcaggcgt

SEQ ID NO: 30121 - DNA, 15 bp, Homo sapiens
gcgttcaggcaggcg

SEQ ID NO: 30122 - DNA, 15 bp, Homo sapiens
ggcgttcaggcaggc

SEQ ID NO: 30123 - DNA, 15 bp, Homo sapiens
gggcgttcaggcagg

SEQ ID NO: 30124 - DNA, 15 bp, Homo sapiens
cgggcgttcaggcag

SEQ ID NO: 30125 - DNA, 15 bp, Homo sapiens
gcgggcgttcaggca

SEQ ID NO: 30126 - DNA, 15 bp, Homo sapiens
agcgggcgttcaggc

SEQ ID NO: 30127 - DNA, 15 bp, Homo sapiens
cagcgggcgttcagg

SEQ ID NO: 30128 - DNA, 15 bp, Homo sapiens
acagcgggcgttcag

SEQ ID NO: 30129 - DNA, 15 bp, Homo sapiens
aacagcgggcgttca

SEQ ID NO: 30130 - DNA, 15 bp, Homo sapiens
aaacagcgggcgttc

SEQ ID NO: 30131 - DNA, 15 bp, Homo sapiens
aaaacagcgggcgtt

SEQ ID NO: 30132 - DNA, 15 bp, Homo sapiens
caaaacagcgggcgt

SEQ ID NO: 30133 - DNA, 15 bp, Homo sapiens
gcaaaacagcgggcg

SEQ ID NO: 30134 - DNA, 15 bp, Homo sapiens
agcaaaacagcgggc

SEQ ID NO: 30135 - DNA, 15 bp, Homo sapiens
gagcaaaacagcggg

SEQ ID NO: 30136 - DNA, 15 bp, Homo sapiens
cgagcaaaacagcgg

SEQ ID NO: 30137 - DNA, 15 bp, Homo sapiens
tcgagcaaaacagcg

SEQ ID NO: 30138 - DNA, 15 bp, Homo sapiens
ctcgagcaaaacagc

SEQ ID NO: 30139 - DNA, 15 bp, Homo sapiens
actcgagcaaaacag

SEQ ID NO: 30140 - DNA, 15 bp, Homo sapiens
aactcgagcaaaaca

SEQ ID NO: 30141 - DNA, 15 bp, Homo sapiens
caactcgagcaaaac

SEQ ID NO: 30142 - DNA, 15 bp, Homo sapiens
tcaactcgagcaaaa

SEQ ID NO: 30143 - DNA, 15 bp, Homo sapiens
ttcaactcgagcaaa

SEQ ID NO: 30144 - DNA, 15 bp, Homo sapiens
gttcaactcgagcaa

SEQ ID NO: 30145 - DNA, 15 bp, Homo sapiens
ggttcaactcgagca

SEQ ID NO: 30146 - DNA, 15 bp, Homo sapiens
gggttcaactcgagc

SEQ ID NO: 30147 - DNA, 15 bp, Homo sapiens
agggttcaactcgag

SEQ ID NO: 30148 - DNA, 15 bp, Homo sapiens
gagggttcaactcga

SEQ ID NO: 30149 - DNA, 15 bp, Homo sapiens
ggagggttcaactcg

SEQ ID NO: 30150 - DNA, 15 bp, Homo sapiens
gggagggttcaactc

SEQ ID NO: 30151 - DNA, 15 bp, Homo sapiens
tgggagggttcaact

SEQ ID NO: 30152 - DNA, 15 bp, Homo sapiens
gtgggagggttcaac

SEQ ID NO: 30153 - DNA, 15 bp, Homo sapiens
tgtgggagggttcaa

SEQ ID NO: 30154 - DNA, 15 bp, Homo sapiens
ttgtgggagggttca

SEQ ID NO: 30155 - DNA, 15 bp, Homo sapiens
cttgtgggagggttc

SEQ ID NO: 30156 - DNA, 15 bp, Homo sapiens
acttgtgggagggtt

SEQ ID NO: 30157 - DNA, 15 bp, Homo sapiens
gacttgtgggagggt

SEQ ID NO: 30158 - DNA, 15 bp, Homo sapiens
agacttgtgggaggg

SEQ ID NO: 30159 - DNA, 15 bp, Homo sapiens
tagacttgtgggagg

SEQ ID NO: 30160 - DNA, 15 bp, Homo sapiens
ttagacttgtgggag

SEQ ID NO: 30161 - DNA, 15 bp, Homo sapiens
tttagacttgtggga

SEQ ID NO: 30162 - DNA, 15 bp, Homo sapiens
ttttagacttgtggg

SEQ ID NO: 30163 - DNA, 15 bp, Homo sapiens
attttagacttgtgg

SEQ ID NO: 30164 - DNA, 15 bp, Homo sapiens
gattttagacttgtg

SEQ ID NO: 30165 - DNA, 15 bp, Homo sapiens
cgattttagacttgt

SEQ ID NO: 30166 - DNA, 15 bp, Homo sapiens
acgattttagacttg

SEQ ID NO: 30167 - DNA, 15 bp, Homo sapiens
tacgattttagactt

SEQ ID NO: 30168 - DNA, 15 bp, Homo sapiens
ctacgattttagact

SEQ ID NO: 30169 - DNA, 15 bp, Homo sapiens
tctacgattttagac

SEQ ID NO: 30170 - DNA, 15 bp, Homo sapiens
ttctacgattttaga

SEQ ID NO: 30171 - DNA, 15 bp, Homo sapiens
attctacgattttag

SEQ ID NO: 30172 - DNA, 15 bp, Homo sapiens
aattctacgatttta

SEQ ID NO: 30173 - DNA, 15 bp, Homo sapiens
aaattctacgatttt

SEQ ID NO: 30174 - DNA, 15 bp, Homo sapiens
gaaattctacgattt

SEQ ID NO: 30175 - DNA, 15 bp, Homo sapiens
agaaattctacgatt

SEQ ID NO: 30176 - DNA, 15 bp, Homo sapiens
aagaaattctacgat

SEQ ID NO: 30177 - DNA, 15 bp, Homo sapiens
gaagaaattctacga

SEQ ID NO: 30178 - DNA, 15 bp, Homo sapiens
tgaagaaattctacg

SEQ ID NO: 30179 - DNA, 15 bp, Homo sapiens
ctgaagaaattctac

SEQ ID NO: 30180 - DNA, 15 bp, Homo sapiens
actgaagaaattcta

SEQ ID NO: 30181 - DNA, 15 bp, Homo sapiens
gactgaagaaattct

SEQ ID NO: 30182 - DNA, 15 bp, Homo sapiens
agactgaagaaattc

SEQ ID NO: 30183 - DNA, 15 bp, Homo sapiens
aagactgaagaaatt

SEQ ID NO: 30184 - DNA, 15 bp, Homo sapiens
aaagactgaagaaat

SEQ ID NO: 30185 - DNA, 15 bp, Homo sapiens
aaaagactgaagaaa

SEQ ID NO: 30186 - DNA, 15 bp, Homo sapiens
caaaagactgaagaa

SEQ ID NO: 30187 - DNA, 15 bp, Homo sapiens
tcaaaagactgaaga

SEQ ID NO: 30188 - DNA, 15 bp, Homo sapiens
atcaaaagactgaag

SEQ ID NO: 30189 - DNA, 15 bp, Homo sapiens
catcaaaagactgaa

SEQ ID NO: 30190 - DNA, 15 bp, Homo sapiens
tcatcaaaagactga

SEQ ID NO: 30191 - DNA, 15 bp, Homo sapiens
ctcatcaaaagactg

SEQ ID NO: 30192 - DNA, 15 bp, Homo sapiens
tctcatcaaaagact

SEQ ID NO: 30193 - DNA, 15 bp, Homo sapiens
atctcatcaaaagac

SEQ ID NO: 30194 - DNA, 15 bp, Homo sapiens
aatctcatcaaaaga

SEQ ID NO: 30195 - DNA, 15 bp, Homo sapiens
taatctcatcaaaag

SEQ ID NO: 30196 - DNA, 15 bp, Homo sapiens
gtaatctcatcaaaa

SEQ ID NO: 30197 - DNA, 15 bp, Homo sapiens
tgtaatctcatcaaa

SEQ ID NO: 30198 - DNA, 15 bp, Homo sapiens
ctgtaatctcatcaa

SEQ ID NO: 30199 - DNA, 15 bp, Homo sapiens
gctgtaatctcatca

SEQ ID NO: 30200 - DNA, 15 bp, Homo sapiens
agctgtaatctcatc

SEQ ID NO: 30201 - DNA, 15 bp, Homo sapiens
tagctgtaatctcat

SEQ ID NO: 30202 - DNA, 15 bp, Homo sapiens
atagctgtaatctca

SEQ ID NO: 30203 - DNA, 15 bp, Homo sapiens
catagctgtaatctc

SEQ ID NO: 30204 - DNA, 15 bp, Homo sapiens
ccatagctgtaatct

SEQ ID NO: 30205 - DNA, 15 bp, Homo sapiens
accatagctgtaatc

SEQ ID NO: 30206 - DNA, 15 bp, Homo sapiens
caccatagctgtaat

SEQ ID NO: 30207 - DNA, 15 bp, Homo sapiens
tcaccatagctgtaa

SEQ ID NO: 30208 - DNA, 15 bp, Homo sapiens
ctcaccatagctgta

SEQ ID NO: 30209 - DNA, 15 bp, Homo sapiens
gctcaccatagctgt

SEQ ID NO: 30210 - DNA, 15 bp, Homo sapiens
tgctcaccatagctg

SEQ ID NO: 30211 - DNA, 15 bp, Homo sapiens
atgctcaccatagct

SEQ ID NO: 30212 - DNA, 15 bp, Homo sapiens
catgctcaccatagc

SEQ ID NO: 30213 - DNA, 15 bp, Homo sapiens
acatgctcaccatag

SEQ ID NO: 30214 - DNA, 15 bp, Homo sapiens
aacatgctcaccata

SEQ ID NO: 30215 - DNA, 15 bp, Homo sapiens
aaacatgctcaccat

SEQ ID NO: 30216 - DNA, 15 bp, Homo sapiens
caaacatgctcacca

SEQ ID NO: 30217 - DNA, 15 bp, Homo sapiens
tcaaacatgctcacc

SEQ ID NO: 30218 - DNA, 15 bp, Homo sapiens
ttcaaacatgctcac

SEQ ID NO: 30219 - DNA, 15 bp, Homo sapiens
gttcaaacatgctca

SEQ ID NO: 30220 - DNA, 15 bp, Homo sapiens
tgttcaaacatgctc

SEQ ID NO: 30221 - DNA, 15 bp, Homo sapiens
atgttcaaacatgct

SEQ ID NO: 30222 - DNA, 15 bp, Homo sapiens
catgttcaaacatgc

SEQ ID NO: 30223 - DNA, 15 bp, Homo sapiens
acatgttcaaacatg

SEQ ID NO: 30224 - DNA, 15 bp, Homo sapiens
tacatgttcaaacat

SEQ ID NO: 30225 - DNA, 15 bp, Homo sapiens
gtacatgttcaaaca

SEQ ID NO: 30226 - DNA, 15 bp, Homo sapiens
tgtacatgttcaaac

SEQ ID NO: 30227 - DNA, 15 bp, Homo sapiens
ctgtacatgttcaaa

SEQ ID NO: 30228 - DNA, 15 bp, Homo sapiens
cctgtacatgttcaa

SEQ ID NO: 30229 - DNA, 15 bp, Homo sapiens
acctgtacatgttca

SEQ ID NO: 30230 - DNA, 15 bp, Homo sapiens
cacctgtacatgttc

SEQ ID NO: 30231 - DNA, 15 bp, Homo sapiens
tcacctgtacatgtt

SEQ ID NO: 30232 - DNA, 15 bp, Homo sapiens
gtcacctgtacatgt

SEQ ID NO: 30233 - DNA, 15 bp, Homo sapiens
agtcacctgtacatg

SEQ ID NO: 30234 - DNA, 15 bp, Homo sapiens
gagtcacctgtacat

SEQ ID NO: 30235 - DNA, 15 bp, Homo sapiens
tgagtcacctgtaca

SEQ ID NO: 30236 - DNA, 15 bp, Homo sapiens
ctgagtcacctgtac

SEQ ID NO: 30237 - DNA, 15 bp, Homo sapiens
cctgagtcacctgta

SEQ ID NO: 30238 - DNA, 15 bp, Homo sapiens
gcctgagtcacctgt

SEQ ID NO: 30239 - DNA, 15 bp, Homo sapiens
agcctgagtcacctg

SEQ ID NO: 30240 - DNA, 15 bp, Homo sapiens
tagcctgagtcacct

SEQ ID NO: 30241 - DNA, 15 bp, Homo sapiens
gtagcctgagtcacc

SEQ ID NO: 30242 - DNA, 15 bp, Homo sapiens
tgtagcctgagtcac

SEQ ID NO: 30243 - DNA, 15 bp, Homo sapiens
gtgtagcctgagtca

SEQ ID NO: 30244 - DNA, 15 bp, Homo sapiens
tgtgtagcctgagtc

SEQ ID NO: 30245 - DNA, 15 bp, Homo sapiens
ttgtgtagcctgagt

SEQ ID NO: 30246 - DNA, 15 bp, Homo sapiens
cttgtgtagcctgag

SEQ ID NO: 30247 - DNA, 15 bp, Homo sapiens
gcttgtgtagcctga

SEQ ID NO: 30248 - DNA, 15 bp, Homo sapiens
tgcttgtgtagcctg

SEQ ID NO: 30249 - DNA, 15 bp, Homo sapiens
gtgcttgtgtagcct

SEQ ID NO: 30250 - DNA, 15 bp, Homo sapiens
tgtgcttgtgtagcc

SEQ ID NO: 30251 - DNA, 15 bp, Homo sapiens
atgtgcttgtgtagc

SEQ ID NO: 30252 - DNA, 15 bp, Homo sapiens
tatgtgcttgtgtag

SEQ ID NO: 30253 - DNA, 15 bp, Homo sapiens
ctatgtgcttgtgta

SEQ ID NO: 30254 - DNA, 15 bp, Homo sapiens
actatgtgcttgtgt

SEQ ID NO: 30255 - DNA, 15 bp, Homo sapiens
tactatgtgcttgtg

SEQ ID NO: 30256 - DNA, 15 bp, Homo sapiens
ctactatgtgcttgt

SEQ ID NO: 30257 - DNA, 15 bp, Homo sapiens
gctactatgtgcttg

SEQ ID NO: 30258 - DNA, 15 bp, Homo sapiens
ggctactatgtgctt

SEQ ID NO: 30259 - DNA, 15 bp, Homo sapiens
aggctactatgtgct

SEQ ID NO: 30260 - DNA, 15 bp, Homo sapiens
gaggctactatgtgc

SEQ ID NO: 30261 - DNA, 15 bp, Homo sapiens
agaggctactatgtg

SEQ ID NO: 30262 - DNA, 15 bp, Homo sapiens
tagaggctactatgt

SEQ ID NO: 30263 - DNA, 15 bp, Homo sapiens
ttagaggctactatg

SEQ ID NO: 30264 - DNA, 15 bp, Homo sapiens
attagaggctactat

SEQ ID NO: 30265 - DNA, 15 bp, Homo sapiens
aattagaggctacta

SEQ ID NO: 30266 - DNA, 15 bp, Homo sapiens
aaattagaggctact

SEQ ID NO: 30267 - DNA, 15 bp, Homo sapiens
aaaattagaggctac

SEQ ID NO: 30268 - DNA, 15 bp, Homo sapiens
caaaattagaggcta

SEQ ID NO: 30269 - DNA, 15 bp, Homo sapiens
tcaaaattagaggct

SEQ ID NO: 30270 - DNA, 15 bp, Homo sapiens
gtcaaaattagaggc

SEQ ID NO: 30271 - DNA, 15 bp, Homo sapiens
ggtcaaaattagagg

SEQ ID NO: 30272 - DNA, 15 bp, Homo sapiens
tggtcaaaattagag

SEQ ID NO: 30273 - DNA, 15 bp, Homo sapiens
gtggtcaaaattaga

SEQ ID NO: 30274 - DNA, 15 bp, Homo sapiens
agtggtcaaaattag

SEQ ID NO: 30275 - DNA, 15 bp, Homo sapiens
cagtggtcaaaatta

SEQ ID NO: 30276 - DNA, 15 bp, Homo sapiens
tcagtggtcaaaatt

SEQ ID NO: 30277 - DNA, 15 bp, Homo sapiens
ttcagtggtcaaaat

SEQ ID NO: 30278 - DNA, 15 bp, Homo sapiens
attcagtggtcaaaa

SEQ ID NO: 30279 - DNA, 15 bp, Homo sapiens
aattcagtggtcaaa

SEQ ID NO: 30280 - DNA, 15 bp, Homo sapiens
aaattcagtggtcaa

SEQ ID NO: 30281 - DNA, 15 bp, Homo sapiens
aaaattcagtggtca

SEQ ID NO: 30282 - DNA, 15 bp, Homo sapiens
aaaaattcagtggtc

SEQ ID NO: 30283 - DNA, 15 bp, Homo sapiens
aaaaaattcagtggt

SEQ ID NO: 30284 - DNA, 15 bp, Homo sapiens
aaaaaaattcagtgg

SEQ ID NO: 30285 - DNA, 15 bp, Homo sapiens
caaaaaaattcagtg

SEQ ID NO: 30286 - DNA, 15 bp, Homo sapiens
acaaaaaaattcagt

SEQ ID NO: 30287 - DNA, 15 bp, Homo sapiens
gacaaaaaaattcag

SEQ ID NO: 30288 - DNA, 15 bp, Homo sapiens
tgacaaaaaaattca

SEQ ID NO: 30289 - DNA, 15 bp, Homo sapiens
atgacaaaaaaattc

SEQ ID NO: 30290 - DNA, 15 bp, Homo sapiens
tatgacaaaaaaatt

SEQ ID NO: 30291 - DNA, 15 bp, Homo sapiens
ctatgacaaaaaaat

SEQ ID NO: 30292 - DNA, 15 bp, Homo sapiens
gctatgacaaaaaaa

SEQ ID NO: 30293 - DNA, 15 bp, Homo sapiens
agctatgacaaaaaa

SEQ ID NO: 30294 - DNA, 15 bp, Homo sapiens
gagctatgacaaaaa

SEQ ID NO: 30295 - DNA, 15 bp, Homo sapiens
ggagctatgacaaaa

SEQ ID NO: 30296 - DNA, 15 bp, Homo sapiens
gggagctatgacaaa

SEQ ID NO: 30297 - DNA, 15 bp, Homo sapiens
agggagctatgacaa

SEQ ID NO: 30298 - DNA, 15 bp, Homo sapiens
tagggagctatgaca

SEQ ID NO: 30299 - DNA, 15 bp, Homo sapiens
ttagggagctatgac

SEQ ID NO: 30300 - DNA, 15 bp, Homo sapiens
attagggagctatga

SEQ ID NO: 30301 - DNA, 15 bp, Homo sapiens
aattagggagctatg

SEQ ID NO: 30302 - DNA, 15 bp, Homo sapiens
aaattagggagctat

SEQ ID NO: 30303 - DNA, 15 bp, Homo sapiens
caaattagggagcta

SEQ ID NO: 30304 - DNA, 15 bp, Homo sapiens
ccaaattagggagct

SEQ ID NO: 30305 - DNA, 15 bp, Homo sapiens
tccaaattagggagc

SEQ ID NO: 30306 - DNA, 15 bp, Homo sapiens
ttccaaattagggag

SEQ ID NO: 30307 - DNA, 15 bp, Homo sapiens
attccaaattaggga

SEQ ID NO: 30308 - DNA, 15 bp, Homo sapiens
aattccaaattaggg

SEQ ID NO: 30309 - DNA, 15 bp, Homo sapiens
aaattccaaattagg

SEQ ID NO: 30310 - DNA, 15 bp, Homo sapiens
caaattccaaattag

SEQ ID NO: 30311 - DNA, 15 bp, Homo sapiens
acaaattccaaatta

SEQ ID NO: 30312 - DNA, 15 bp, Homo sapiens
gacaaattccaaatt

SEQ ID NO: 30313 - DNA, 15 bp, Homo sapiens
tgacaaattccaaat

SEQ ID NO: 30314 - DNA, 15 bp, Homo sapiens
atgacaaattccaaa

SEQ ID NO: 30315 - DNA, 15 bp, Homo sapiens
catgacaaattccaa

SEQ ID NO: 30316 - DNA, 15 bp, Homo sapiens
tcatgacaaattcca

SEQ ID NO: 30317 - DNA, 15 bp, Homo sapiens
atcatgacaaattcc

SEQ ID NO: 30318 - DNA, 15 bp, Homo sapiens
aatcatgacaaattc

SEQ ID NO: 30319 - DNA, 15 bp, Homo sapiens
aaatcatgacaaatt

SEQ ID NO: 30320 - DNA, 15 bp, Homo sapiens
caaatcatgacaaat

SEQ ID NO: 30321 - DNA, 15 bp, Homo sapiens
ccaaatcatgacaaa

SEQ ID NO: 30322 - DNA, 15 bp, Homo sapiens
cccaaatcatgacaa

SEQ ID NO: 30323 - DNA, 15 bp, Homo sapiens
acccaaatcatgaca

SEQ ID NO: 30324 - DNA, 15 bp, Homo sapiens
gacccaaatcatgac

SEQ ID NO: 30325 - DNA, 15 bp, Homo sapiens
agacccaaatcatga

SEQ ID NO: 30326 - DNA, 15 bp, Homo sapiens
aagacccaaatcatg

SEQ ID NO: 30327 - DNA, 15 bp, Homo sapiens
aaagacccaaatcat

SEQ ID NO: 30328 - DNA, 15 bp, Homo sapiens
aaaagacccaaatca

SEQ ID NO: 30329 - DNA, 15 bp, Homo sapiens
gaaaagacccaaatc

SEQ ID NO: 30330 - DNA, 15 bp, Homo sapiens
agaaaagacccaaat

SEQ ID NO: 30331 - DNA, 15 bp, Homo sapiens
gagaaaagacccaaa

SEQ ID NO: 30332 - DNA, 15 bp, Homo sapiens
agagaaaagacccaa

SEQ ID NO: 30333 - DNA, 15 bp, Homo sapiens
tagagaaaagaccca

SEQ ID NO: 30334 - DNA, 15 bp, Homo sapiens
ctagagaaaagaccc

SEQ ID NO: 30335 - DNA, 15 bp, Homo sapiens
tctagagaaaagacc

SEQ ID NO: 30336 - DNA, 15 bp, Homo sapiens
ttctagagaaaagac

SEQ ID NO: 30337 - DNA, 15 bp, Homo sapiens
attctagagaaaaga

SEQ ID NO: 30338 - DNA, 15 bp, Homo sapiens
aattctagagaaaag

SEQ ID NO: 30339 - DNA, 15 bp, Homo sapiens
gaattctagagaaaa

SEQ ID NO: 30340 - DNA, 15 bp, Homo sapiens
cgaattctagagaaa

SEQ ID NO: 30341 - DNA, 15 bp, Homo sapiens
ccgaattctagagaa

SEQ ID NO: 30342 - DNA, 15 bp, Homo sapiens
accgaattctagaga

SEQ ID NO: 30343 - DNA, 15 bp, Homo sapiens
caccgaattctagag

SEQ ID NO: 30344 - DNA, 15 bp, Homo sapiens
tcaccgaattctaga

SEQ ID NO: 30345 - DNA, 15 bp, Homo sapiens
ttcaccgaattctag

SEQ ID NO: 30346 - DNA, 15 bp, Homo sapiens
attcaccgaattcta

SEQ ID NO: 30347 - DNA, 15 bp, Homo sapiens
gattcaccgaattct

SEQ ID NO: 30348 - DNA, 15 bp, Homo sapiens
tgattcaccgaattc

SEQ ID NO: 30349 - DNA, 15 bp, Homo sapiens
ctgattcaccgaatt

SEQ ID NO: 30350 - DNA, 15 bp, Homo sapiens
actgattcaccgaat

SEQ ID NO: 30351 - DNA, 15 bp, Homo sapiens
cactgattcaccgaa

SEQ ID NO: 30352 - DNA, 15 bp, Homo sapiens
ccactgattcaccga

SEQ ID NO: 30353 - DNA, 15 bp, Homo sapiens
accactgattcaccg

SEQ ID NO: 30354 - DNA, 15 bp, Homo sapiens
aaccactgattcacc

SEQ ID NO: 30355 - DNA, 15 bp, Homo sapiens
taaccactgattcac

SEQ ID NO: 30356 - DNA, 15 bp, Homo sapiens
ctaaccactgattca

SEQ ID NO: 30357 - DNA, 15 bp, Homo sapiens
gctaaccactgattc

SEQ ID NO: 30358 - DNA, 15 bp, Homo sapiens
tgctaaccactgatt

SEQ ID NO: 30359 - DNA, 15 bp, Homo sapiens
atgctaaccactgat

SEQ ID NO: 30360 - DNA, 15 bp, Homo sapiens
catgctaaccactga

SEQ ID NO: 30361 - DNA, 15 bp, Homo sapiens
acatgctaaccactg

SEQ ID NO: 30362 - DNA, 15 bp, Homo sapiens
aacatgctaaccact

SEQ ID NO: 30363 - DNA, 15 bp, Homo sapiens
caacatgctaaccac

SEQ ID NO: 30364 - DNA, 15 bp, Homo sapiens
acaacatgctaacca

SEQ ID NO: 30365 - DNA, 15 bp, Homo sapiens
cacaacatgctaacc

SEQ ID NO: 30366 - DNA, 15 bp, Homo sapiens
acacaacatgctaac

SEQ ID NO: 30367 - DNA, 15 bp, Homo sapiens
cacacaacatgctaa

SEQ ID NO: 30368 - DNA, 15 bp, Homo sapiens
gcacacaacatgcta

SEQ ID NO: 30369 - DNA, 15 bp, Homo sapiens
agcacacaacatgct

SEQ ID NO: 30370 - DNA, 15 bp, Homo sapiens
tagcacacaacatgc

SEQ ID NO: 30371 - DNA, 15 bp, Homo sapiens
gtagcacacaacatg

SEQ ID NO: 30372 - DNA, 15 bp, Homo sapiens
agtagcacacaacat

SEQ ID NO: 30373 - DNA, 15 bp, Homo sapiens
aagtagcacacaaca

SEQ ID NO: 30374 - DNA, 15 bp, Homo sapiens
caagtagcacacaac

SEQ ID NO: 30375 - DNA, 15 bp, Homo sapiens
gcaagtagcacacaa

SEQ ID NO: 30376 - DNA, 15 bp, Homo sapiens
tgcaagtagcacaca

SEQ ID NO: 30377 - DNA, 15 bp, Homo sapiens
ctgcaagtagcacac

SEQ ID NO: 30378 - DNA, 15 bp, Homo sapiens
cctgcaagtagcaca

SEQ ID NO: 30379 - DNA, 15 bp, Homo sapiens
ccctgcaagtagcac

SEQ ID NO: 30380 - DNA, 15 bp, Homo sapiens
tccctgcaagtagca

SEQ ID NO: 30381 - DNA, 15 bp, Homo sapiens
ttccctgcaagtagc

SEQ ID NO: 30382 - DNA, 15 bp, Homo sapiens
cttccctgcaagtag

SEQ ID NO: 30383 - DNA, 15 bp, Homo sapiens
tcttccctgcaagta

SEQ ID NO: 30384 - DNA, 15 bp, Homo sapiens
atcttccctgcaagt

SEQ ID NO: 30385 - DNA, 15 bp, Homo sapiens
gatcttccctgcaag

SEQ ID NO: 30386 - DNA, 15 bp, Homo sapiens
ggatcttccctgcaa

SEQ ID NO: 30387 - DNA, 15 bp, Homo sapiens
aggatcttccctgca

SEQ ID NO: 30388 - DNA, 15 bp, Homo sapiens
taggatcttccctgc

SEQ ID NO: 30389 - DNA, 15 bp, Homo sapiens
ctaggatcttccctg

SEQ ID NO: 30390 - DNA, 15 bp, Homo sapiens
tctaggatcttccct

SEQ ID NO: 30391 - DNA, 15 bp, Homo sapiens
ctctaggatcttccc

SEQ ID NO: 30392 - DNA, 15 bp, Homo sapiens
actctaggatcttcc

SEQ ID NO: 30393 - DNA, 15 bp, Homo sapiens
gactctaggatcttc

SEQ ID NO: 30394 - DNA, 15 bp, Homo sapiens
cgactctaggatctt

SEQ ID NO: 30395 - DNA, 15 bp, Homo sapiens
acgactctaggatct

SEQ ID NO: 30396 - DNA, 15 bp, Homo sapiens
aacgactctaggatc

SEQ ID NO: 30397 - DNA, 15 bp, Homo sapiens
aaacgactctaggat

SEQ ID NO: 30398 - DNA, 15 bp, Homo sapiens
taaacgactctagga

SEQ ID NO: 30399 - DNA, 15 bp, Homo sapiens
ttaaacgactctagg

SEQ ID NO: 30400 - DNA, 15 bp, Homo sapiens
tttaaacgactctag

SEQ ID NO: 30401 - DNA, 15 bp, Homo sapiens
ttttaaacgactcta

SEQ ID NO: 30402 - DNA, 15 bp, Homo sapiens
gttttaaacgactct

SEQ ID NO: 30403 - DNA, 15 bp, Homo sapiens
ggttttaaacgactc

SEQ ID NO: 30404 - DNA, 15 bp, Homo sapiens
gggttttaaacgact

SEQ ID NO: 30405 - DNA, 15 bp, Homo sapiens
tgggttttaaacgac

SEQ ID NO: 30406 - DNA, 15 bp, Homo sapiens
ctgggttttaaacga

SEQ ID NO: 30407 - DNA, 15 bp, Homo sapiens
tctgggttttaaacg

SEQ ID NO: 30408 - DNA, 15 bp, Homo sapiens
ttctgggttttaaac

SEQ ID NO: 30409 - DNA, 15 bp, Homo sapiens
cttctgggttttaaa

SEQ ID NO: 30410 - DNA, 15 bp, Homo sapiens
ccttctgggttttaa

SEQ ID NO: 30411 - DNA, 15 bp, Homo sapiens
cccttctgggtttta

SEQ ID NO: 30412 - DNA, 15 bp, Homo sapiens
gcccttctgggtttt

SEQ ID NO: 30413 - DNA, 15 bp, Homo sapiens
ggcccttctgggttt

SEQ ID NO: 30414 - DNA, 15 bp, Homo sapiens
aggcccttctgggtt

SEQ ID NO: 30415 - DNA, 15 bp, Homo sapiens
aaggcccttctgggt

SEQ ID NO: 30416 - DNA, 15 bp, Homo sapiens
gaaggcccttctggg

SEQ ID NO: 30417 - DNA, 15 bp, Homo sapiens
ggaaggcccttctgg

SEQ ID NO: 30418 - DNA, 15 bp, Homo sapiens
tggaaggcccttctg

SEQ ID NO: 30419 - DNA, 15 bp, Homo sapiens
ctggaaggcccttct

SEQ ID NO: 30420 - DNA, 15 bp, Homo sapiens
tctggaaggcccttc

SEQ ID NO: 30421 - DNA, 15 bp, Homo sapiens
atctggaaggccctt

SEQ ID NO: 30422 - DNA, 15 bp, Homo sapiens
gatctggaaggccct

SEQ ID NO: 30423 - DNA, 15 bp, Homo sapiens
tgatctggaaggccc

SEQ ID NO: 30424 - DNA, 15 bp, Homo sapiens
ctgatctggaaggcc

SEQ ID NO: 30425 - DNA, 15 bp, Homo sapiens
actgatctggaaggc

SEQ ID NO: 30426 - DNA, 15 bp, Homo sapiens
gactgatctggaagg

SEQ ID NO: 30427 - DNA, 15 bp, Homo sapiens
ggactgatctggaag

SEQ ID NO: 30428 - DNA, 15 bp, Homo sapiens
gggactgatctggaa

SEQ ID NO: 30429 - DNA, 15 bp, Homo sapiens
tgggactgatctgga

SEQ ID NO: 30430 - DNA, 15 bp, Homo sapiens
ctgggactgatctgg

SEQ ID NO: 30431 - DNA, 15 bp, Homo sapiens
tctgggactgatctg

SEQ ID NO: 30432 - DNA, 15 bp, Homo sapiens
ctctgggactgatct

SEQ ID NO: 30433 - DNA, 15 bp, Homo sapiens
cctctgggactgatc

SEQ ID NO: 30434 - DNA, 15 bp, Homo sapiens
tcctctgggactgat

SEQ ID NO: 30435 - DNA, 15 bp, Homo sapiens
ttcctctgggactga

SEQ ID NO: 30436 - DNA, 15 bp, Homo sapiens
gttcctctgggactg

SEQ ID NO: 30437 - DNA, 15 bp, Homo sapiens
tgttcctctgggact

SEQ ID NO: 30438 - DNA, 15 bp, Homo sapiens
ttgttcctctgggac

SEQ ID NO: 30439 - DNA, 15 bp, Homo sapiens
attgttcctctggga

SEQ ID NO: 30440 - DNA, 15 bp, Homo sapiens
gattgttcctctggg

SEQ ID NO: 30441 - DNA, 15 bp, Homo sapiens
agattgttcctctgg

SEQ ID NO: 30442 - DNA, 15 bp, Homo sapiens
cagattgttcctctg

SEQ ID NO: 30443 - DNA, 15 bp, Homo sapiens
ccagattgttcctct

SEQ ID NO: 30444 - DNA, 15 bp, Homo sapiens
accagattgttcctc

SEQ ID NO: 30445 - DNA, 15 bp, Homo sapiens
caccagattgttcct

SEQ ID NO: 30446 - DNA, 15 bp, Homo sapiens
tcaccagattgttcc

SEQ ID NO: 30447 - DNA, 15 bp, Homo sapiens
atcaccagattgttc

SEQ ID NO: 30448 - DNA, 15 bp, Homo sapiens
gatcaccagattgtt

SEQ ID NO: 30449 - DNA, 15 bp, Homo sapiens
agatcaccagattgt

SEQ ID NO: 30450 - DNA, 15 bp, Homo sapiens
tagatcaccagattg

SEQ ID NO: 30451 - DNA, 15 bp, Homo sapiens
ctagatcaccagatt

SEQ ID NO: 30452 - DNA, 15 bp, Homo sapiens
actagatcaccagat

SEQ ID NO: 30453 - DNA, 15 bp, Homo sapiens
gactagatcaccaga

SEQ ID NO: 30454 - DNA, 15 bp, Homo sapiens
agactagatcaccag

SEQ ID NO: 30455 - DNA, 15 bp, Homo sapiens
gagactagatcacca

SEQ ID NO: 30456 - DNA, 15 bp, Homo sapiens
agagactagatcacc

SEQ ID NO: 30457 - DNA, 15 bp, Homo sapiens
aagagactagatcac

SEQ ID NO: 30458 - DNA, 15 bp, Homo sapiens
aaagagactagatca

SEQ ID NO: 30459 - DNA, 15 bp, Homo sapiens
aaaagagactagatc

SEQ ID NO: 30460 - DNA, 15 bp, Homo sapiens
aaaaagagactagat

SEQ ID NO: 30461 - DNA, 15 bp, Homo sapiens
aaaaaagagactaga

SEQ ID NO: 30462 - DNA, 15 bp, Homo sapiens
taaaaaagagactag

SEQ ID NO: 30463 - DNA, 15 bp, Homo sapiens
ttaaaaaagagacta

SEQ ID NO: 30464 - DNA, 15 bp, Homo sapiens
tttaaaaaagagact

SEQ ID NO: 30465 - DNA, 15 bp, Homo sapiens
atttaaaaaagagac

SEQ ID NO: 30466 - DNA, 15 bp, Homo sapiens
catttaaaaaagaga

SEQ ID NO: 30467 - DNA, 15 bp, Homo sapiens
tcatttaaaaaagag

SEQ ID NO: 30468 - DNA, 15 bp, Homo sapiens
ctcatttaaaaaaga

SEQ ID NO: 30469 - DNA, 15 bp, Homo sapiens
tctcatttaaaaaag

SEQ ID NO: 30470 - DNA, 15 bp, Homo sapiens
gtctcatttaaaaaa

SEQ ID NO: 30471 - DNA, 15 bp, Homo sapiens
cgtctcatttaaaaa

SEQ ID NO: 30472 - DNA, 15 bp, Homo sapiens
acgtctcatttaaaa

SEQ ID NO: 30473 - DNA, 15 bp, Homo sapiens
cacgtctcatttaaa

SEQ ID NO: 30474 - DNA, 15 bp, Homo sapiens
acacgtctcatttaa

SEQ ID NO: 30475 - DNA, 15 bp, Homo sapiens
aacacgtctcattta

SEQ ID NO: 30476 - DNA, 15 bp, Homo sapiens
aaacacgtctcattt

SEQ ID NO: 30477 - DNA, 15 bp, Homo sapiens
aaaacacgtctcatt

SEQ ID NO: 30478 - DNA, 15 bp, Homo sapiens
aaaaacacgtctcat

SEQ ID NO: 30479 - DNA, 15 bp, Homo sapiens
taaaaacacgtctca

SEQ ID NO: 30480 - DNA, 15 bp, Homo sapiens
ataaaaacacgtctc

SEQ ID NO: 30481 - DNA, 15 bp, Homo sapiens
aataaaaacacgtct

SEQ ID NO: 30482 - DNA, 15 bp, Homo sapiens
caataaaaacacgtc

SEQ ID NO: 30483 - DNA, 15 bp, Homo sapiens
acaataaaaacacgt

SEQ ID NO: 30484 - DNA, 15 bp, Homo sapiens
tacaataaaaacacg

SEQ ID NO: 30485 - DNA, 15 bp, Homo sapiens
ttacaataaaaacac

SEQ ID NO: 30486 - DNA, 15 bp, Homo sapiens
cttacaataaaaaca

SEQ ID NO: 30487 - DNA, 15 bp, Homo sapiens
acttacaataaaaac

SEQ ID NO: 30488 - DNA, 15 bp, Homo sapiens
aacttacaataaaaa

SEQ ID NO: 30489 - DNA, 15 bp, Homo sapiens
aaacttacaataaaa

SEQ ID NO: 30490 - DNA, 15 bp, Homo sapiens
aaaacttacaataaa

SEQ ID NO: 30491 - DNA, 15 bp, Homo sapiens
gaaaacttacaataa

SEQ ID NO: 30492 - DNA, 15 bp, Homo sapiens
agaaaacttacaata

SEQ ID NO: 30493 - DNA, 15 bp, Homo sapiens
cagaaaacttacaat

SEQ ID NO: 30494 - DNA, 15 bp, Homo sapiens
tcagaaaacttacaa

SEQ ID NO: 30495 - DNA, 15 bp, Homo sapiens
ttcagaaaacttaca

SEQ ID NO: 30496 - DNA, 15 bp, Homo sapiens
tttcagaaaacttac

SEQ ID NO: 30497 - DNA, 15 bp, Homo sapiens
ttttcagaaaactta

SEQ ID NO: 30498 - DNA, 15 bp, Homo sapiens
attttcagaaaactt

SEQ ID NO: 30499 - DNA, 15 bp, Homo sapiens
aattttcagaaaact

SEQ ID NO: 30500 - DNA, 15 bp, Homo sapiens
caattttcagaaaac

SEQ ID NO: 30501 - DNA, 15 bp, Homo sapiens
tcaattttcagaaaa

SEQ ID NO: 30502 - DNA, 15 bp, Homo sapiens
ctcaattttcagaaa

SEQ ID NO: 30503 - DNA, 15 bp, Homo sapiens
cctcaattttcagaa

SEQ ID NO: 30504 - DNA, 15 bp, Homo sapiens
tcctcaattttcaga

SEQ ID NO: 30505 - DNA, 15 bp, Homo sapiens
atcctcaattttcag

SEQ ID NO: 30506 - DNA, 15 bp, Homo sapiens
catcctcaattttca

SEQ ID NO: 30507 - DNA, 15 bp, Homo sapiens
acatcctcaattttc

SEQ ID NO: 30508 - DNA, 15 bp, Homo sapiens
tacatcctcaatttt

SEQ ID NO: 30509 - DNA, 15 bp, Homo sapiens
ttacatcctcaattt

SEQ ID NO: 30510 - DNA, 15 bp, Homo sapiens
attacatcctcaatt

SEQ ID NO: 30511 - DNA, 15 bp, Homo sapiens
gattacatcctcaat

SEQ ID NO: 30512 - DNA, 15 bp, Homo sapiens
tgattacatcctcaa

SEQ ID NO: 30513 - DNA, 15 bp, Homo sapiens
ctgattacatcctca

SEQ ID NO: 30514 - DNA, 15 bp, Homo sapiens
actgattacatcctc

SEQ ID NO: 30515 - DNA, 15 bp, Homo sapiens
gactgattacatcct

SEQ ID NO: 30516 - DNA, 15 bp, Homo sapiens
tgactgattacatcc

SEQ ID NO: 30517 - DNA, 15 bp, Homo sapiens
ctgactgattacatc

SEQ ID NO: 30518 - DNA, 15 bp, Homo sapiens
actgactgattacat

SEQ ID NO: 30519 - DNA, 15 bp, Homo sapiens
aactgactgattaca

SEQ ID NO: 30520 - DNA, 15 bp, Homo sapiens
caactgactgattac

SEQ ID NO: 30521 - DNA, 15 bp, Homo sapiens
acaactgactgatta

SEQ ID NO: 30522 - DNA, 15 bp, Homo sapiens
aacaactgactgatt

SEQ ID NO: 30523 - DNA, 15 bp, Homo sapiens
aaacaactgactgat

SEQ ID NO: 30524 - DNA, 15 bp, Homo sapiens
caaacaactgactga

SEQ ID NO: 30525 - DNA, 15 bp, Homo sapiens
ccaaacaactgactg

SEQ ID NO: 30526 - DNA, 15 bp, Homo sapiens
tccaaacaactgact

SEQ ID NO: 30527 - DNA, 15 bp, Homo sapiens
atccaaacaactgac

SEQ ID NO: 30528 - DNA, 15 bp, Homo sapiens
gatccaaacaactga

SEQ ID NO: 30529 - DNA, 15 bp, Homo sapiens
tgatccaaacaactg

SEQ ID NO: 30530 - DNA, 15 bp, Homo sapiens
gtgatccaaacaact

SEQ ID NO: 30531 - DNA, 15 bp, Homo sapiens
ggtgatccaaacaac

SEQ ID NO: 30532 - DNA, 15 bp, Homo sapiens
gggtgatccaaacaa

SEQ ID NO: 30533 - DNA, 15 bp, Homo sapiens
agggtgatccaaaca

SEQ ID NO: 30534 - DNA, 15 bp, Homo sapiens
cagggtgatccaaac

SEQ ID NO: 30535 - DNA, 15 bp, Homo sapiens
gcagggtgatccaaa

SEQ ID NO: 30536 - DNA, 15 bp, Homo sapiens
agcagggtgatccaa

SEQ ID NO: 30537 - DNA, 15 bp, Homo sapiens
aagcagggtgatcca

SEQ ID NO: 30538 - DNA, 15 bp, Homo sapiens
aaagcagggtgatcc

SEQ ID NO: 30539 - DNA, 15 bp, Homo sapiens
aaaagcagggtgatc

SEQ ID NO: 30540 - DNA, 15 bp, Homo sapiens
taaaagcagggtgat

SEQ ID NO: 30541 - DNA, 15 bp, Homo sapiens
ttaaaagcagggtga

SEQ ID NO: 30542 - DNA, 15 bp, Homo sapiens
cttaaaagcagggtg

SEQ ID NO: 30543 - DNA, 15 bp, Homo sapiens
acttaaaagcagggt

SEQ ID NO: 30544 - DNA, 15 bp, Homo sapiens
aacttaaaagcaggg

SEQ ID NO: 30545 - DNA, 15 bp, Homo sapiens
gaacttaaaagcagg

SEQ ID NO: 30546 - DNA, 15 bp, Homo sapiens
agaacttaaaagcag

SEQ ID NO: 30547 - DNA, 15 bp, Homo sapiens
aagaacttaaaagca

SEQ ID NO: 30548 - DNA, 15 bp, Homo sapiens
aaagaacttaaaagc

SEQ ID NO: 30549 - DNA, 15 bp, Homo sapiens
taaagaacttaaaag

SEQ ID NO: 30550 - DNA, 15 bp, Homo sapiens
ttaaagaacttaaaa

SEQ ID NO: 30551 - DNA, 15 bp, Homo sapiens
cttaaagaacttaaa

SEQ ID NO: 30552 - DNA, 15 bp, Homo sapiens
tcttaaagaacttaa

SEQ ID NO: 30553 - DNA, 15 bp, Homo sapiens
ctcttaaagaactta

SEQ ID NO: 30554 - DNA, 15 bp, Homo sapiens
gctcttaaagaactt

SEQ ID NO: 30555 - DNA, 15 bp, Homo sapiens
agctcttaaagaact

SEQ ID NO: 30556 - DNA, 15 bp, Homo sapiens
cagctcttaaagaac

SEQ ID NO: 30557 - DNA, 15 bp, Homo sapiens
ccagctcttaaagaa

SEQ ID NO: 30558 - DNA, 15 bp, Homo sapiens
gccagctcttaaaga

SEQ ID NO: 30559 - DNA, 15 bp, Homo sapiens
agccagctcttaaag

SEQ ID NO: 30560 - DNA, 15 bp, Homo sapiens
tagccagctcttaaa

SEQ ID NO: 30561 - DNA, 15 bp, Homo sapiens
atagccagctcttaa

SEQ ID NO: 30562 - DNA, 15 bp, Homo sapiens
aatagccagctctta

SEQ ID NO: 30563 - DNA, 15 bp, Homo sapiens
caatagccagctctt

SEQ ID NO: 30564 - DNA, 15 bp, Homo sapiens
tcaatagccagctct

SEQ ID NO: 30565 - DNA, 15 bp, Homo sapiens
atcaatagccagctc

SEQ ID NO: 30566 - DNA, 15 bp, Homo sapiens
catcaatagccagct

SEQ ID NO: 30567 - DNA, 15 bp, Homo sapiens
tcatcaatagccagc

SEQ ID NO: 30568 - DNA, 15 bp, Homo sapiens
ttcatcaatagccag

SEQ ID NO: 30569 - DNA, 15 bp, Homo sapiens
cttcatcaatagcca

SEQ ID NO: 30570 - DNA, 15 bp, Homo sapiens
gcttcatcaatagcc

SEQ ID NO: 30571 - DNA, 15 bp, Homo sapiens
tgcttcatcaatagc

SEQ ID NO: 30572 - DNA, 15 bp, Homo sapiens
atgcttcatcaatag

SEQ ID NO: 30573 - DNA, 15 bp, Homo sapiens
aatgcttcatcaata

SEQ ID NO: 30574 - DNA, 15 bp, Homo sapiens
aaatgcttcatcaat

SEQ ID NO: 30575 - DNA, 15 bp, Homo sapiens
gaaatgcttcatcaa

SEQ ID NO: 30576 - DNA, 15 bp, Homo sapiens
ggaaatgcttcatca

SEQ ID NO: 30577 - DNA, 15 bp, Homo sapiens
tggaaatgcttcatc

SEQ ID NO: 30578 - DNA, 15 bp, Homo sapiens
ctggaaatgcttcat

SEQ ID NO: 30579 - DNA, 15 bp, Homo sapiens
actggaaatgcttca

SEQ ID NO: 30580 - DNA, 15 bp, Homo sapiens
tactggaaatgcttc

SEQ ID NO: 30581 - DNA, 15 bp, Homo sapiens
atactggaaatgctt

SEQ ID NO: 30582 - DNA, 15 bp, Homo sapiens
aatactggaaatgct

SEQ ID NO: 30583 - DNA, 15 bp, Homo sapiens
gaatactggaaatgc

SEQ ID NO: 30584 - DNA, 15 bp, Homo sapiens
agaatactggaaatg

SEQ ID NO: 30585 - DNA, 15 bp, Homo sapiens
aagaatactggaaat

SEQ ID NO: 30586 - DNA, 15 bp, Homo sapiens
gaagaatactggaaa

SEQ ID NO: 30587 - DNA, 15 bp, Homo sapiens
ggaagaatactggaa

SEQ ID NO: 30588 - DNA, 15 bp, Homo sapiens
gggaagaatactgga

SEQ ID NO: 30589 - DNA, 15 bp, Homo sapiens
ggggaagaatactgg

SEQ ID NO: 30590 - DNA, 15 bp, Homo sapiens
aggggaagaatactg

SEQ ID NO: 30591 - DNA, 15 bp, Homo sapiens
gaggggaagaatact

SEQ ID NO: 30592 - DNA, 15 bp, Homo sapiens
tgaggggaagaatac

SEQ ID NO: 30593 - DNA, 15 bp, Homo sapiens
gtgaggggaagaata

SEQ ID NO: 30594 - DNA, 15 bp, Homo sapiens
ggtgaggggaagaat

SEQ ID NO: 30595 - DNA, 15 bp, Homo sapiens
aggtgaggggaagaa

SEQ ID NO: 30596 - DNA, 15 bp, Homo sapiens
caggtgaggggaaga

SEQ ID NO: 30597 - DNA, 15 bp, Homo sapiens
tcaggtgaggggaag

SEQ ID NO: 30598 - DNA, 15 bp, Homo sapiens
atcaggtgaggggaa

SEQ ID NO: 30599 - DNA, 15 bp, Homo sapiens
aatcaggtgagggga

SEQ ID NO: 30600 - DNA, 15 bp, Homo sapiens
aaatcaggtgagggg

SEQ ID NO: 30601 - DNA, 15 bp, Homo sapiens
aaaatcaggtgaggg

SEQ ID NO: 30602 - DNA, 15 bp, Homo sapiens
gaaaatcaggtgagg

SEQ ID NO: 30603 - DNA, 15 bp, Homo sapiens
tgaaaatcaggtgag

SEQ ID NO: 30604 - DNA, 15 bp, Homo sapiens
gtgaaaatcaggtga

SEQ ID NO: 30605 - DNA, 15 bp, Homo sapiens
ggtgaaaatcaggtg

SEQ ID NO: 30606 - DNA, 15 bp, Homo sapiens
gggtgaaaatcaggt

SEQ ID NO: 30607 - DNA, 15 bp, Homo sapiens
tgggtgaaaatcagg

SEQ ID NO: 30608 - DNA, 15 bp, Homo sapiens
ctgggtgaaaatcag

SEQ ID NO: 30609 - DNA, 15 bp, Homo sapiens
tctgggtgaaaatca

SEQ ID NO: 30610 - DNA, 15 bp, Homo sapiens
atctgggtgaaaatc

SEQ ID NO: 30611 - DNA, 15 bp, Homo sapiens
tatctgggtgaaaat

SEQ ID NO: 30612 - DNA, 15 bp, Homo sapiens
gtatctgggtgaaaa

SEQ ID NO: 30613 - DNA, 15 bp, Homo sapiens
tgtatctgggtgaaa

SEQ ID NO: 30614 - DNA, 15 bp, Homo sapiens
atgtatctgggtgaa

SEQ ID NO: 30615 - DNA, 15 bp, Homo sapiens
aatgtatctgggtga

SEQ ID NO: 30616 - DNA, 15 bp, Homo sapiens
taatgtatctgggtg

SEQ ID NO: 30617 - DNA, 15 bp, Homo sapiens
ataatgtatctgggt

SEQ ID NO: 30618 - DNA, 15 bp, Homo sapiens
cataatgtatctggg

SEQ ID NO: 30619 - DNA, 15 bp, Homo sapiens
acataatgtatctgg

SEQ ID NO: 30620 - DNA, 15 bp, Homo sapiens
aacataatgtatctg

SEQ ID NO: 30621 - DNA, 15 bp, Homo sapiens
taacataatgtatct

SEQ ID NO: 30622 - DNA, 15 bp, Homo sapiens
ttaacataatgtatc

SEQ ID NO: 30623 - DNA, 15 bp, Homo sapiens
tttaacataatgtat

SEQ ID NO: 30624 - DNA, 15 bp, Homo sapiens
atttaacataatgta

SEQ ID NO: 30625 - DNA, 15 bp, Homo sapiens
aatttaacataatgt

SEQ ID NO: 30626 - DNA, 15 bp, Homo sapiens
aaatttaacataatg

SEQ ID NO: 30627 - DNA, 15 bp, Homo sapiens
taaatttaacataat

SEQ ID NO: 30628 - DNA, 15 bp, Homo sapiens
gtaaatttaacataa

SEQ ID NO: 30629 - DNA, 15 bp, Homo sapiens
agtaaatttaacata

SEQ ID NO: 30630 - DNA, 15 bp, Homo sapiens
aagtaaatttaacat

SEQ ID NO: 30631 - DNA, 15 bp, Homo sapiens
aaagtaaatttaaca

SEQ ID NO: 30632 - DNA, 15 bp, Homo sapiens
gaaagtaaatttaac

SEQ ID NO: 30633 - DNA, 15 bp, Homo sapiens
agaaagtaaatttaa

SEQ ID NO: 30634 - DNA, 15 bp, Homo sapiens
aagaaagtaaattta

SEQ ID NO: 30635 - DNA, 15 bp, Homo sapiens
gaagaaagtaaattt

SEQ ID NO: 30636 - DNA, 15 bp, Homo sapiens
agaagaaagtaaatt

SEQ ID NO: 30637 - DNA, 15 bp, Homo sapiens
gagaagaaagtaaat

SEQ ID NO: 30638 - DNA, 15 bp, Homo sapiens
agagaagaaagtaaa

SEQ ID NO: 30639 - DNA, 15 bp, Homo sapiens
aagagaagaaagtaa

SEQ ID NO: 30640 - DNA, 15 bp, Homo sapiens
aaagagaagaaagta

SEQ ID NO: 30641 - DNA, 15 bp, Homo sapiens
aaaagagaagaaagt

SEQ ID NO: 30642 - DNA, 15 bp, Homo sapiens
taaaagagaagaaag

SEQ ID NO: 30643 - DNA, 15 bp, Homo sapiens
ttaaaagagaagaaa

SEQ ID NO: 30644 - DNA, 15 bp, Homo sapiens
tttaaaagagaagaa

SEQ ID NO: 30645 - DNA, 15 bp, Homo sapiens
ttttaaaagagaaga

SEQ ID NO: 30646 - DNA, 15 bp, Homo sapiens
tttttaaaagagaag

SEQ ID NO: 30647 - DNA, 15 bp, Homo sapiens
ttttttaaaagagaa

SEQ ID NO: 30648 - DNA, 15 bp, Homo sapiens
tttttttaaaagaga

SEQ ID NO: 30649 - DNA, 15 bp, Homo sapiens
ttttttttaaaagag

SEQ ID NO: 30650 - DNA, 15 bp, Homo sapiens
tttttttttaaaaga

SEQ ID NO: 30651 - DNA, 15 bp, Homo sapiens
atttttttttaaaag

SEQ ID NO: 30652 - DNA, 15 bp, Homo sapiens
gatttttttttaaaa

SEQ ID NO: 30653 - DNA, 15 bp, Homo sapiens
agatttttttttaaa

SEQ ID NO: 30654 - DNA, 15 bp, Homo sapiens
aagatttttttttaa

SEQ ID NO: 30655 - DNA, 15 bp, Homo sapiens
taagattttttttta

SEQ ID NO: 30656 - DNA, 15 bp, Homo sapiens
ctaagattttttttt

SEQ ID NO: 30657 - DNA, 15 bp, Homo sapiens
actaagatttttttt

SEQ ID NO: 30658 - DNA, 15 bp, Homo sapiens
aactaagattttttt

SEQ ID NO: 30659 - DNA, 15 bp, Homo sapiens
aaactaagatttttt

SEQ ID NO: 30660 - DNA, 15 bp, Homo sapiens
aaaactaagattttt

SEQ ID NO: 30661 - DNA, 15 bp, Homo sapiens
caaaactaagatttt

SEQ ID NO: 30662 - DNA, 15 bp, Homo sapiens
tcaaaactaagattt

SEQ ID NO: 30663 - DNA, 15 bp, Homo sapiens
ttcaaaactaagatt

SEQ ID NO: 30664 - DNA, 15 bp, Homo sapiens
tttcaaaactaagat

SEQ ID NO: 30665 - DNA, 15 bp, Homo sapiens
gtttcaaaactaaga

SEQ ID NO: 30666 - DNA, 15 bp, Homo sapiens
tgtttcaaaactaag

SEQ ID NO: 30667 - DNA, 15 bp, Homo sapiens
atgtttcaaaactaa

SEQ ID NO: 30668 - DNA, 15 bp, Homo sapiens
tatgtttcaaaacta

SEQ ID NO: 30669 - DNA, 15 bp, Homo sapiens
gtatgtttcaaaact

SEQ ID NO: 30670 - DNA, 15 bp, Homo sapiens
agtatgtttcaaaac

SEQ ID NO: 30671 - DNA, 15 bp, Homo sapiens
tagtatgtttcaaaa

SEQ ID NO: 30672 - DNA, 15 bp, Homo sapiens
atagtatgtttcaaa

SEQ ID NO: 30673 - DNA, 15 bp, Homo sapiens
tatagtatgtttcaa

SEQ ID NO: 30674 - DNA, 15 bp, Homo sapiens
ttatagtatgtttca

SEQ ID NO: 30675 - DNA, 15 bp, Homo sapiens
cttatagtatgtttc

SEQ ID NO: 30676 - DNA, 15 bp, Homo sapiens
acttatagtatgttt

SEQ ID NO: 30677 - DNA, 15 bp, Homo sapiens
cacttatagtatgtt

SEQ ID NO: 30678 - DNA, 15 bp, Homo sapiens
acacttatagtatgt

SEQ ID NO: 30679 - DNA, 15 bp, Homo sapiens
tacacttatagtatg

SEQ ID NO: 30680 - DNA, 15 bp, Homo sapiens
gtacacttatagtat

SEQ ID NO: 30681 - DNA, 15 bp, Homo sapiens
agtacacttatagta

SEQ ID NO: 30682 - DNA, 15 bp, Homo sapiens
gagtacacttatagt

SEQ ID NO: 30683 - DNA, 15 bp, Homo sapiens
agagtacacttatag

SEQ ID NO: 30684 - DNA, 15 bp, Homo sapiens
gagagtacacttata

SEQ ID NO: 30685 - DNA, 15 bp, Homo sapiens
ggagagtacacttat

SEQ ID NO: 30686 - DNA, 15 bp, Homo sapiens
aggagagtacactta

SEQ ID NO: 30687 - DNA, 15 bp, Homo sapiens
gaggagagtacactt

SEQ ID NO: 30688 - DNA, 15 bp, Homo sapiens
agaggagagtacact

SEQ ID NO: 30689 - DNA, 15 bp, Homo sapiens
gagaggagagtacac

SEQ ID NO: 30690 - DNA, 15 bp, Homo sapiens
ggagaggagagtaca

SEQ ID NO: 30691 - DNA, 15 bp, Homo sapiens
gggagaggagagtac

SEQ ID NO: 30692 - DNA, 15 bp, Homo sapiens
ggggagaggagagta

SEQ ID NO: 30693 - DNA, 15 bp, Homo sapiens
gggggagaggagagt

SEQ ID NO: 30694 - DNA, 15 bp, Homo sapiens
tgggggagaggagag

SEQ ID NO: 30695 - DNA, 15 bp, Homo sapiens
ctgggggagaggaga

SEQ ID NO: 30696 - DNA, 15 bp, Homo sapiens
tctgggggagaggag

SEQ ID NO: 30697 - DNA, 15 bp, Homo sapiens
ctctgggggagagga

SEQ ID NO: 30698 - DNA, 15 bp, Homo sapiens
cctctgggggagagg

SEQ ID NO: 30699 - DNA, 15 bp, Homo sapiens
acctctgggggagag

SEQ ID NO: 30700 - DNA, 15 bp, Homo sapiens
tacctctgggggaga

SEQ ID NO: 30701 - DNA, 15 bp, Homo sapiens
ttacctctgggggag

SEQ ID NO: 30702 - DNA, 15 bp, Homo sapiens
gttacctctggggga

SEQ ID NO: 30703 - DNA, 15 bp, Homo sapiens
agttacctctggggg

SEQ ID NO: 30704 - DNA, 15 bp, Homo sapiens
cagttacctctgggg

SEQ ID NO: 30705 - DNA, 15 bp, Homo sapiens
tcagttacctctggg

SEQ ID NO: 30706 - DNA, 15 bp, Homo sapiens
ttcagttacctctgg

SEQ ID NO: 30707 - DNA, 15 bp, Homo sapiens
cttcagttacctctg

SEQ ID NO: 30708 - DNA, 15 bp, Homo sapiens
acttcagttacctct

SEQ ID NO: 30709 - DNA, 15 bp, Homo sapiens
aacttcagttacctc

SEQ ID NO: 30710 - DNA, 15 bp, Homo sapiens
caacttcagttacct

SEQ ID NO: 30711 - DNA, 15 bp, Homo sapiens
ccaacttcagttacc

SEQ ID NO: 30712 - DNA, 15 bp, Homo sapiens
tccaacttcagttac

SEQ ID NO: 30713 - DNA, 15 bp, Homo sapiens
ttccaacttcagtta

SEQ ID NO: 30714 - DNA, 15 bp, Homo sapiens
attccaacttcagtt

SEQ ID NO: 30715 - DNA, 15 bp, Homo sapiens
aattccaacttcagt

SEQ ID NO: 30716 - DNA, 15 bp, Homo sapiens
aaattccaacttcag

SEQ ID NO: 30717 - DNA, 15 bp, Homo sapiens
taaattccaacttca

SEQ ID NO: 30718 - DNA, 15 bp, Homo sapiens
ctaaattccaacttc

SEQ ID NO: 30719 - DNA, 15 bp, Homo sapiens
gctaaattccaactt

SEQ ID NO: 30720 - DNA, 15 bp, Homo sapiens
tgctaaattccaact

SEQ ID NO: 30721 - DNA, 15 bp, Homo sapiens
ttgctaaattccaac

SEQ ID NO: 30722 - DNA, 15 bp, Homo sapiens
tttgctaaattccaa

SEQ ID NO: 30723 - DNA, 15 bp, Homo sapiens
ttttgctaaattcca

SEQ ID NO: 30724 - DNA, 15 bp, Homo sapiens
tttttgctaaattcc

SEQ ID NO: 30725 - DNA, 15 bp, Homo sapiens
atttttgctaaattc

SEQ ID NO: 30726 - DNA, 15 bp, Homo sapiens
tatttttgctaaatt

SEQ ID NO: 30727 - DNA, 15 bp, Homo sapiens
atatttttgctaaat

SEQ ID NO: 30728 - DNA, 15 bp, Homo sapiens
aatatttttgctaaa

SEQ ID NO: 30729 - DNA, 15 bp, Homo sapiens
taatatttttgctaa

SEQ ID NO: 30730 - DNA, 15 bp, Homo sapiens
ttaatatttttgcta

SEQ ID NO: 30731 - DNA, 15 bp, Homo sapiens
tttaatatttttgct

SEQ ID NO: 30732 - DNA, 15 bp, Homo sapiens
ttttaatatttttgc

SEQ ID NO: 30733 - DNA, 15 bp, Homo sapiens
tttttaatatttttg

SEQ ID NO: 30734 - DNA, 15 bp, Homo sapiens
gtttttaatattttt

SEQ ID NO: 30735 - DNA, 15 bp, Homo sapiens
tgtttttaatatttt

SEQ ID NO: 30736 - DNA, 15 bp, Homo sapiens
atgtttttaatattt

SEQ ID NO: 30737 - DNA, 15 bp, Homo sapiens
catgtttttaatatt

SEQ ID NO: 30738 - DNA, 15 bp, Homo sapiens
ccatgtttttaatat

SEQ ID NO: 30739 - DNA, 15 bp, Homo sapiens
cccatgtttttaata

SEQ ID NO: 30740 - DNA, 15 bp, Homo sapiens
tcccatgtttttaat

SEQ ID NO: 30741 - DNA, 15 bp, Homo sapiens
ctcccatgtttttaa

SEQ ID NO: 30742 - DNA, 15 bp, Homo sapiens
actcccatgttttta

SEQ ID NO: 30743 - DNA, 15 bp, Homo sapiens
cactcccatgttttt

SEQ ID NO: 30744 - DNA, 15 bp, Homo sapiens
gcactcccatgtttt

SEQ ID NO: 30745 - DNA, 15 bp, Homo sapiens
agcactcccatgttt

SEQ ID NO: 30746 - DNA, 15 bp, Homo sapiens
cagcactcccatgtt

SEQ ID NO: 30747 - DNA, 15 bp, Homo sapiens
acagcactcccatgt

SEQ ID NO: 30748 - DNA, 15 bp, Homo sapiens
aacagcactcccatg

SEQ ID NO: 30749 - DNA, 15 bp, Homo sapiens
aaacagcactcccat

SEQ ID NO: 30750 - DNA, 15 bp, Homo sapiens
aaaacagcactccca

SEQ ID NO: 30751 - DNA, 15 bp, Homo sapiens
aaaaacagcactccc

SEQ ID NO: 30752 - DNA, 15 bp, Homo sapiens
caaaaacagcactcc

SEQ ID NO: 30753 - DNA, 15 bp, Homo sapiens
acaaaaacagcactc

SEQ ID NO: 30754 - DNA, 15 bp, Homo sapiens
cacaaaaacagcact

SEQ ID NO: 30755 - DNA, 15 bp, Homo sapiens
acacaaaaacagcac

SEQ ID NO: 30756 - DNA, 15 bp, Homo sapiens
gacacaaaaacagca

SEQ ID NO: 30757 - DNA, 15 bp, Homo sapiens
agacacaaaaacagc

SEQ ID NO: 30758 - DNA, 15 bp, Homo sapiens
cagacacaaaaacag

SEQ ID NO: 30759 - DNA, 15 bp, Homo sapiens
acagacacaaaaaca

SEQ ID NO: 30760 - DNA, 15 bp, Homo sapiens
tacagacacaaaaac

SEQ ID NO: 30761 - DNA, 15 bp, Homo sapiens
ctacagacacaaaaa

SEQ ID NO: 30762 - DNA, 15 bp, Homo sapiens
tctacagacacaaaa

SEQ ID NO: 30763 - DNA, 15 bp, Homo sapiens
gtctacagacacaaa

SEQ ID NO: 30764 - DNA, 15 bp, Homo sapiens
tgtctacagacacaa

SEQ ID NO: 30765 - DNA, 15 bp, Homo sapiens
ctgtctacagacaca

SEQ ID NO: 30766 - DNA, 15 bp, Homo sapiens
actgtctacagacac

SEQ ID NO: 30767 - DNA, 15 bp, Homo sapiens
tactgtctacagaca

SEQ ID NO: 30768 - DNA, 15 bp, Homo sapiens
atactgtctacagac

SEQ ID NO: 30769 - DNA, 15 bp, Homo sapiens
aatactgtctacaga

SEQ ID NO: 30770 - DNA, 15 bp, Homo sapiens
taatactgtctacag

SEQ ID NO: 30771 - DNA, 15 bp, Homo sapiens
ataatactgtctaca

SEQ ID NO: 30772 - DNA, 15 bp, Homo sapiens
aataatactgtctac

SEQ ID NO: 30773 - DNA, 15 bp, Homo sapiens
aaataatactgtcta

SEQ ID NO: 30774 - DNA, 15 bp, Homo sapiens
aaaataatactgtct

SEQ ID NO: 30775 - DNA, 15 bp, Homo sapiens
aaaaataatactgtc

SEQ ID NO: 30776 - DNA, 15 bp, Homo sapiens
caaaaataatactgt

SEQ ID NO: 30777 - DNA, 15 bp, Homo sapiens
gcaaaaataatactg

SEQ ID NO: 30778 - DNA, 15 bp, Homo sapiens
tgcaaaaataatact

SEQ ID NO: 30779 - DNA, 15 bp, Homo sapiens
atgcaaaaataatac

SEQ ID NO: 30780 - DNA, 15 bp, Homo sapiens
catgcaaaaataata

SEQ ID NO: 30781 - DNA, 15 bp, Homo sapiens
gcatgcaaaaataat

SEQ ID NO: 30782 - DNA, 15 bp, Homo sapiens
agcatgcaaaaataa

SEQ ID NO: 30783 - DNA, 15 bp, Homo sapiens
aagcatgcaaaaata

SEQ ID NO: 30784 - DNA, 15 bp, Homo sapiens
aaagcatgcaaaaat

SEQ ID NO: 30785 - DNA, 15 bp, Homo sapiens
aaaagcatgcaaaaa

SEQ ID NO: 30786 - DNA, 15 bp, Homo sapiens
caaaagcatgcaaaa

SEQ ID NO: 30787 - DNA, 15 bp, Homo sapiens
tcaaaagcatgcaaa

SEQ ID NO: 30788 - DNA, 15 bp, Homo sapiens
ttcaaaagcatgcaa

SEQ ID NO: 30789 - DNA, 15 bp, Homo sapiens
cttcaaaagcatgca

SEQ ID NO: 30790 - DNA, 15 bp, Homo sapiens
ccttcaaaagcatgc

SEQ ID NO: 30791 - DNA, 15 bp, Homo sapiens
gccttcaaaagcatg

SEQ ID NO: 30792 - DNA, 15 bp, Homo sapiens
tgccttcaaaagcat

SEQ ID NO: 30793 - DNA, 15 bp, Homo sapiens
atgccttcaaaagca

SEQ ID NO: 30794 - DNA, 15 bp, Homo sapiens
tatgccttcaaaagc

SEQ ID NO: 30795 - DNA, 15 bp, Homo sapiens
atatgccttcaaaag

SEQ ID NO: 30796 - DNA, 15 bp, Homo sapiens
aatatgccttcaaaa

SEQ ID NO: 30797 - DNA, 15 bp, Homo sapiens
aaatatgccttcaaa

SEQ ID NO: 30798 - DNA, 15 bp, Homo sapiens
aaaatatgccttcaa

SEQ ID NO: 30799 - DNA, 15 bp, Homo sapiens
aaaaatatgccttca

SEQ ID NO: 30800 - DNA, 15 bp, Homo sapiens
aaaaaatatgccttc

SEQ ID NO: 30801 - DNA, 15 bp, Homo sapiens
caaaaaatatgcctt

SEQ ID NO: 30802 - DNA, 15 bp, Homo sapiens
ccaaaaaatatgcct

SEQ ID NO: 30803 - DNA, 15 bp, Homo sapiens
gccaaaaaatatgcc

SEQ ID NO: 30804 - DNA, 15 bp, Homo sapiens
ggccaaaaaatatgc

SEQ ID NO: 30805 - DNA, 15 bp, Homo sapiens
cggccaaaaaatatg

SEQ ID NO: 30806 - DNA, 15 bp, Homo sapiens
tcggccaaaaaatat

SEQ ID NO: 30807 - DNA, 15 bp, Homo sapiens
ctcggccaaaaaata

SEQ ID NO: 30808 - DNA, 15 bp, Homo sapiens
actcggccaaaaaat

SEQ ID NO: 30809 - DNA, 15 bp, Homo sapiens
cactcggccaaaaaa

SEQ ID NO: 30810 - DNA, 15 bp, Homo sapiens
gcactcggccaaaaa

SEQ ID NO: 30811 - DNA, 15 bp, Homo sapiens
tgcactcggccaaaa

SEQ ID NO: 30812 - DNA, 15 bp, Homo sapiens
ctgcactcggccaaa

SEQ ID NO: 30813 - DNA, 15 bp, Homo sapiens
actgcactcggccaa

SEQ ID NO: 30814 - DNA, 15 bp, Homo sapiens
cactgcactcggcca

SEQ ID NO: 30815 - DNA, 15 bp, Homo sapiens
ccactgcactcggcc

SEQ ID NO: 30816 - DNA, 15 bp, Homo sapiens
gccactgcactcggc

SEQ ID NO: 30817 - DNA, 15 bp, Homo sapiens
agccactgcactcgg

SEQ ID NO: 30818 - DNA, 15 bp, Homo sapiens
gagccactgcactcg

SEQ ID NO: 30819 - DNA, 15 bp, Homo sapiens
tgagccactgcactc

SEQ ID NO: 30820 - DNA, 15 bp, Homo sapiens
atgagccactgcact

SEQ ID NO: 30821 - DNA, 15 bp, Homo sapiens
catgagccactgcac

SEQ ID NO: 30822 - DNA, 15 bp, Homo sapiens
gcatgagccactgca

SEQ ID NO: 30823 - DNA, 15 bp, Homo sapiens
gttacaggcatgagc

SEQ ID NO: 30824 - DNA, 15 bp, Homo sapiens
ggttacaggcatgag

SEQ ID NO: 30825 - DNA, 15 bp, Homo sapiens
gggttacaggcatga

SEQ ID NO: 30826 - DNA, 15 bp, Homo sapiens
ggggttacaggcatg

SEQ ID NO: 30827 - DNA, 15 bp, Homo sapiens
tggggttacaggcat

SEQ ID NO: 30828 - DNA, 15 bp, Homo sapiens
ttggggttacaggca

SEQ ID NO: 30829 - DNA, 15 bp, Homo sapiens
gttggggttacaggc

SEQ ID NO: 30830 - DNA, 15 bp, Homo sapiens
tgttggggttacagg

SEQ ID NO: 30831 - DNA, 15 bp, Homo sapiens
gtgttggggttacag

SEQ ID NO: 30832 - DNA, 15 bp, Homo sapiens
agtgttggggttaca

SEQ ID NO: 30833 - DNA, 15 bp, Homo sapiens
aagtgttggggttac

SEQ ID NO: 30834 - DNA, 15 bp, Homo sapiens
caagtgttggggtta

SEQ ID NO: 30835 - DNA, 15 bp, Homo sapiens
ccaagtgttggggtt

SEQ ID NO: 30836 - DNA, 15 bp, Homo sapiens
cccaagtgttggggt

SEQ ID NO: 30837 - DNA, 15 bp, Homo sapiens
tcccaagtgttgggg

SEQ ID NO: 30838 - DNA, 15 bp, Homo sapiens
ctcccaagtgttggg

SEQ ID NO: 30839 - DNA, 15 bp, Homo sapiens
cctcccaagtgttgg

SEQ ID NO: 30840 - DNA, 15 bp, Homo sapiens
gcctcccaagtgttg

SEQ ID NO: 30841 - DNA, 15 bp, Homo sapiens
ggcctcccaagtgtt

SEQ ID NO: 30842 - DNA, 15 bp, Homo sapiens
cggcctcccaagtgt

SEQ ID NO: 30843 - DNA, 15 bp, Homo sapiens
tcggcctcccaagtg

SEQ ID NO: 30844 - DNA, 15 bp, Homo sapiens
ctcggcctcccaagt

SEQ ID NO: 30845 - DNA, 15 bp, Homo sapiens
cctcggcctcccaag

SEQ ID NO: 30846 - DNA, 15 bp, Homo sapiens
tcacctgcctcggcc

SEQ ID NO: 30847 - DNA, 15 bp, Homo sapiens
ttcacctgcctcggc

SEQ ID NO: 30848 - DNA, 15 bp, Homo sapiens
attcacctgcctcgg

SEQ ID NO: 30849 - DNA, 15 bp, Homo sapiens
gattcacctgcctcg

SEQ ID NO: 30850 - DNA, 15 bp, Homo sapiens
tgattcacctgcctc

SEQ ID NO: 30851 - DNA, 15 bp, Homo sapiens
gtgattcacctgcct

SEQ ID NO: 30852 - DNA, 15 bp, Homo sapiens
agtgattcacctgcc

SEQ ID NO: 30853 - DNA, 15 bp, Homo sapiens
aagtgattcacctgc

SEQ ID NO: 30854 - DNA, 15 bp, Homo sapiens
caagtgattcacctg

SEQ ID NO: 30855 - DNA, 15 bp, Homo sapiens
ccaagtgattcacct

SEQ ID NO: 30856 - DNA, 15 bp, Homo sapiens
cccaagtgattcacc

SEQ ID NO: 30857 - DNA, 15 bp, Homo sapiens
ccccaagtgattcac

SEQ ID NO: 30858 - DNA, 15 bp, Homo sapiens
accccaagtgattca

SEQ ID NO: 30859 - DNA, 15 bp, Homo sapiens
gaccccaagtgattc

SEQ ID NO: 30860 - DNA, 15 bp, Homo sapiens
tgaccccaagtgatt

SEQ ID NO: 30861 - DNA, 15 bp, Homo sapiens
ctgaccccaagtgat

SEQ ID NO: 30862 - DNA, 15 bp, Homo sapiens
cctgaccccaagtga

SEQ ID NO: 30863 - DNA, 15 bp, Homo sapiens
tcctgaccccaagtg

SEQ ID NO: 30864 - DNA, 15 bp, Homo sapiens
ctcctgaccccaagt

SEQ ID NO: 30865 - DNA, 15 bp, Homo sapiens
actcctgaccccaag

SEQ ID NO: 30866 - DNA, 15 bp, Homo sapiens
aactcctgaccccaa

SEQ ID NO: 30867 - DNA, 15 bp, Homo sapiens
gaactcctgacccca

SEQ ID NO: 30868 - DNA, 15 bp, Homo sapiens
tgaactcctgacccc

SEQ ID NO: 30869 - DNA, 15 bp, Homo sapiens
ttgaactcctgaccc

SEQ ID NO: 30870 - DNA, 15 bp, Homo sapiens
cttgaactcctgacc

SEQ ID NO: 30871 - DNA, 15 bp, Homo sapiens
cagacggggtttcac

SEQ ID NO: 30872 - DNA, 15 bp, Homo sapiens
acagacggggtttca

SEQ ID NO: 30873 - DNA, 15 bp, Homo sapiens
tacagacggggtttc

SEQ ID NO: 30874 - DNA, 15 bp, Homo sapiens
gtacagacggggttt

SEQ ID NO: 30875 - DNA, 15 bp, Homo sapiens
agtacagacggggtt

SEQ ID NO: 30876 - DNA, 15 bp, Homo sapiens
tagtacagacggggt

SEQ ID NO: 30877 - DNA, 15 bp, Homo sapiens
ttagtacagacgggg

SEQ ID NO: 30878 - DNA, 15 bp, Homo sapiens
tttagtacagacggg

SEQ ID NO: 30879 - DNA, 15 bp, Homo sapiens
ttttagtacagacgg

SEQ ID NO: 30880 - DNA, 15 bp, Homo sapiens
tttttagtacagacg

SEQ ID NO: 30881 - DNA, 15 bp, Homo sapiens
atttttagtacagac

SEQ ID NO: 30882 - DNA, 15 bp, Homo sapiens
tatttttagtacaga

SEQ ID NO: 30883 - DNA, 15 bp, Homo sapiens
ttttttgtattttta

SEQ ID NO: 30884 - DNA, 15 bp, Homo sapiens
attttttgtattttt

SEQ ID NO: 30885 - DNA, 15 bp, Homo sapiens
aattttttgtatttt

SEQ ID NO: 30886 - DNA, 15 bp, Homo sapiens
caattttttgtattt

SEQ ID NO: 30887 - DNA, 15 bp, Homo sapiens
gcaattttttgtatt

SEQ ID NO: 30888 - DNA, 15 bp, Homo sapiens
agcaattttttgtat

SEQ ID NO: 30889 - DNA, 15 bp, Homo sapiens
cagcaattttttgta

SEQ ID NO: 30890 - DNA, 15 bp, Homo sapiens
ccagcaattttttgt

SEQ ID NO: 30891 - DNA, 15 bp, Homo sapiens
cccagcaattttttg

SEQ ID NO: 30892 - DNA, 15 bp, Homo sapiens
acccagcaatttttt

SEQ ID NO: 30893 - DNA, 15 bp, Homo sapiens
cacccagcaattttt

SEQ ID NO: 30894 - DNA, 15 bp, Homo sapiens
acacccagcaatttt

SEQ ID NO: 30895 - DNA, 15 bp, Homo sapiens
cacacccagcaattt

SEQ ID NO: 30896 - DNA, 15 bp, Homo sapiens
ccacacccagcaatt

SEQ ID NO: 30897 - DNA, 15 bp, Homo sapiens
accacacccagcaat

SEQ ID NO: 30898 - DNA, 15 bp, Homo sapiens
caccacacccagcaa

SEQ ID NO: 30899 - DNA, 15 bp, Homo sapiens
ccaccacacccagca

SEQ ID NO: 30900 - DNA, 15 bp, Homo sapiens
accaccacacccagc

SEQ ID NO: 30901 - DNA, 15 bp, Homo sapiens
caccaccacacccag

SEQ ID NO: 30902 - DNA, 15 bp, Homo sapiens
ccaccaccacaccca

SEQ ID NO: 30903 - DNA, 15 bp, Homo sapiens
cccaccaccacaccc

SEQ ID NO: 30904 - DNA, 15 bp, Homo sapiens
cgcccaccaccacac

SEQ ID NO: 30905 - DNA, 15 bp, Homo sapiens
gcgcccaccaccaca

SEQ ID NO: 30906 - DNA, 15 bp, Homo sapiens
ggcgcccaccaccac

SEQ ID NO: 30907 - DNA, 15 bp, Homo sapiens
aggcgcccaccacca

SEQ ID NO: 30908 - DNA, 15 bp, Homo sapiens
caggcgcccaccacc

SEQ ID NO: 30909 - DNA, 15 bp, Homo sapiens
acaggcgcccaccac

SEQ ID NO: 30910 - DNA, 15 bp, Homo sapiens
tacaggcgcccacca

SEQ ID NO: 30911 - DNA, 15 bp, Homo sapiens
ttacaggcgcccacc

SEQ ID NO: 30912 - DNA, 15 bp, Homo sapiens
attacaggcgcccac

SEQ ID NO: 30913 - DNA, 15 bp, Homo sapiens
gattacaggcgccca

SEQ ID NO: 30914 - DNA, 15 bp, Homo sapiens
ggattacaggcgccc

SEQ ID NO: 30915 - DNA, 15 bp, Homo sapiens
gggattacaggcgcc

SEQ ID NO: 30916 - DNA, 15 bp, Homo sapiens
tgggattacaggcgc

SEQ ID NO: 30917 - DNA, 15 bp, Homo sapiens
tctcccgagtagctg

SEQ ID NO: 30918 - DNA, 15 bp, Homo sapiens
atctcccgagtagct

SEQ ID NO: 30919 - DNA, 15 bp, Homo sapiens
aatctcccgagtagc

SEQ ID NO: 30920 - DNA, 15 bp, Homo sapiens
caatctcccgagtag

SEQ ID NO: 30921 - DNA, 15 bp, Homo sapiens
tcaatctcccgagta

SEQ ID NO: 30922 - DNA, 15 bp, Homo sapiens
ctcaatctcccgagt

SEQ ID NO: 30923 - DNA, 15 bp, Homo sapiens
cctcaatctcccgag

SEQ ID NO: 30924 - DNA, 15 bp, Homo sapiens
gcctcaatctcccga

SEQ ID NO: 30925 - DNA, 15 bp, Homo sapiens
tgcctcaatctcccg

SEQ ID NO: 30926 - DNA, 15 bp, Homo sapiens
ctgcctcaatctccc

SEQ ID NO: 30927 - DNA, 15 bp, Homo sapiens
cctgcctcaatctcc

SEQ ID NO: 30928 - DNA, 15 bp, Homo sapiens
tcctgcctcaatctc

SEQ ID NO: 30929 - DNA, 15 bp, Homo sapiens
ctcctgcctcaatct

SEQ ID NO: 30930 - DNA, 15 bp, Homo sapiens
tctcctgcctcaatc

SEQ ID NO: 30931 - DNA, 15 bp, Homo sapiens
ttctcctgcctcaat

SEQ ID NO: 30932 - DNA, 15 bp, Homo sapiens
attctcctgcctcaa

SEQ ID NO: 30933 - DNA, 15 bp, Homo sapiens
acgcctcctgggttc

SEQ ID NO: 30934 - DNA, 15 bp, Homo sapiens
cacgcctcctgggtt

SEQ ID NO: 30935 - DNA, 15 bp, Homo sapiens
gcacgcctcctgggt

SEQ ID NO: 30936 - DNA, 15 bp, Homo sapiens
tgcacgcctcctggg

SEQ ID NO: 30937 - DNA, 15 bp, Homo sapiens
ctgcacgcctcctgg

SEQ ID NO: 30938 - DNA, 15 bp, Homo sapiens
actgcacgcctcctg

SEQ ID NO: 30939 - DNA, 15 bp, Homo sapiens
cactgcacgcctcct

SEQ ID NO: 30940 - DNA, 15 bp, Homo sapiens
tcactgcacgcctcc

SEQ ID NO: 30941 - DNA, 15 bp, Homo sapiens
ctcactgcacgcctc

SEQ ID NO: 30942 - DNA, 15 bp, Homo sapiens
gctcactgcacgcct

SEQ ID NO: 30943 - DNA, 15 bp, Homo sapiens
ggctcactgcacgcc

SEQ ID NO: 30944 - DNA, 15 bp, Homo sapiens
cggctcactgcacgc

SEQ ID NO: 30945 - DNA, 15 bp, Homo sapiens
tcggctcactgcacg

SEQ ID NO: 30946 - DNA, 15 bp, Homo sapiens
ctcggctcactgcac

SEQ ID NO: 30947 - DNA, 15 bp, Homo sapiens
gtctcggctcactgc

SEQ ID NO: 30948 - DNA, 15 bp, Homo sapiens
agtctcggctcactg

SEQ ID NO: 30949 - DNA, 15 bp, Homo sapiens
cagtctcggctcact

SEQ ID NO: 30950 - DNA, 15 bp, Homo sapiens
gcagtctcggctcac

SEQ ID NO: 30951 - DNA, 15 bp, Homo sapiens
cgcagtctcggctca

SEQ ID NO: 30952 - DNA, 15 bp, Homo sapiens
gcgcagtctcggctc

SEQ ID NO: 30953 - DNA, 15 bp, Homo sapiens
ggcgcagtctcggct

SEQ ID NO: 30954 - DNA, 15 bp, Homo sapiens
tggcgcagtctcggc

SEQ ID NO: 30955 - DNA, 15 bp, Homo sapiens
gtggcgcagtctcgg

SEQ ID NO: 30956 - DNA, 15 bp, Homo sapiens
agtggcgcagtctcg

SEQ ID NO: 30957 - DNA, 15 bp, Homo sapiens
cagtggcgcagtctc

SEQ ID NO: 30958 - DNA, 15 bp, Homo sapiens
gcagtggcgcagtct

SEQ ID NO: 30959 - DNA, 15 bp, Homo sapiens
tgcagtggcgcagtc

SEQ ID NO: 30960 - DNA, 15 bp, Homo sapiens
gtgcagtggcgcagt

SEQ ID NO: 30961 - DNA, 15 bp, Homo sapiens
agtgcagtggcgcag

SEQ ID NO: 30962 - DNA, 15 bp, Homo sapiens
tagtgcagtggcgca

SEQ ID NO: 30963 - DNA, 15 bp, Homo sapiens
gtagtgcagtggcgc

SEQ ID NO: 30964 - DNA, 15 bp, Homo sapiens
tgtagtgcagtggcg

SEQ ID NO: 30965 - DNA, 15 bp, Homo sapiens
ctgtagtgcagtggc

SEQ ID NO: 30966 - DNA, 15 bp, Homo sapiens
gctgtagtgcagtgg

SEQ ID NO: 30967 - DNA, 15 bp, Homo sapiens
ggctgtagtgcagtg

SEQ ID NO: 30968 - DNA, 15 bp, Homo sapiens
aggctgtagtgcagt

SEQ ID NO: 30969 - DNA, 15 bp, Homo sapiens
caggctgtagtgcag

SEQ ID NO: 30970 - DNA, 15 bp, Homo sapiens
ccaggctgtagtgca

SEQ ID NO: 30971 - DNA, 15 bp, Homo sapiens
cccaggctgtagtgc

SEQ ID NO: 30972 - DNA, 15 bp, Homo sapiens
gcccaggctgtagtg

SEQ ID NO: 30973 - DNA, 15 bp, Homo sapiens
cgcccaggctgtagt

SEQ ID NO: 30974 - DNA, 15 bp, Homo sapiens
tcgcccaggctgtag

SEQ ID NO: 30975 - DNA, 15 bp, Homo sapiens
gtcgcccaggctgta

SEQ ID NO: 30976 - DNA, 15 bp, Homo sapiens
tgtcgcccaggctgt

SEQ ID NO: 30977 - DNA, 15 bp, Homo sapiens
cgctctgtcgcccag

SEQ ID NO: 30978 - DNA, 15 bp, Homo sapiens
ccgctctgtcgccca

SEQ ID NO: 30979 - DNA, 15 bp, Homo sapiens
cccgctctgtcgccc

SEQ ID NO: 30980 - DNA, 15 bp, Homo sapiens
tcccgctctgtcgcc

SEQ ID NO: 30981 - DNA, 15 bp, Homo sapiens
gtcccgctctgtcgc

SEQ ID NO: 30982 - DNA, 15 bp, Homo sapiens
agtcccgctctgtcg

SEQ ID NO: 30983 - DNA, 15 bp, Homo sapiens
gagtcccgctctgtc

SEQ ID NO: 30984 - DNA, 15 bp, Homo sapiens
ggagtcccgctctgt

SEQ ID NO: 30985 - DNA, 15 bp, Homo sapiens
tggagtcccgctctg

SEQ ID NO: 30986 - DNA, 15 bp, Homo sapiens
atggagtcccgctct

SEQ ID NO: 30987 - DNA, 15 bp, Homo sapiens
gatggagtcccgctc

SEQ ID NO: 30988 - DNA, 15 bp, Homo sapiens
agatggagtcccgct

SEQ ID NO: 30989 - DNA, 15 bp, Homo sapiens
gagatggagtcccgc

SEQ ID NO: 30990 - DNA, 15 bp, Homo sapiens
tgagatggagtcccg

SEQ ID NO: 30991 - DNA, 15 bp, Homo sapiens
ctgagatggagtccc

SEQ ID NO: 30992 - DNA, 15 bp, Homo sapiens
tctgagatggagtcc

SEQ ID NO: 30993 - DNA, 15 bp, Homo sapiens
ttctgagatggagtc

SEQ ID NO: 30994 - DNA, 15 bp, Homo sapiens
tttctgagatggagt

SEQ ID NO: 30995 - DNA, 15 bp, Homo sapiens
ttttctgagatggag

SEQ ID NO: 30996 - DNA, 15 bp, Homo sapiens
tttttctgagatgga

SEQ ID NO: 30997 - DNA, 15 bp, Homo sapiens
atttttctgagatgg

SEQ ID NO: 30998 - DNA, 15 bp, Homo sapiens
tatttttctgagatg

SEQ ID NO: 30999 - DNA, 15 bp, Homo sapiens
ttatttttctgagat

SEQ ID NO: 31000 - DNA, 15 bp, Homo sapiens
tttatttttctgaga

SEQ ID NO: 31001 - DNA, 15 bp, Homo sapiens
ttttatttttctgag

SEQ ID NO: 31002 - DNA, 15 bp, Homo sapiens
tttttatttttctga

SEQ ID NO: 31003 - DNA, 15 bp, Homo sapiens
atttttatttttctg

SEQ ID NO: 31004 - DNA, 15 bp, Homo sapiens
aatttttatttttct

SEQ ID NO: 31005 - DNA, 15 bp, Homo sapiens
aaatttttatttttc

SEQ ID NO: 31006 - DNA, 15 bp, Homo sapiens
caaatttttattttt

SEQ ID NO: 31007 - DNA, 15 bp, Homo sapiens
gcaaatttttatttt

SEQ ID NO: 31008 - DNA, 15 bp, Homo sapiens
tgcaaatttttattt

SEQ ID NO: 31009 - DNA, 15 bp, Homo sapiens
atgcaaatttttatt

SEQ ID NO: 31010 - DNA, 15 bp, Homo sapiens
tatgcaaatttttat

SEQ ID NO: 31011 - DNA, 15 bp, Homo sapiens
atatgcaaattttta

SEQ ID NO: 31012 - DNA, 15 bp, Homo sapiens
aatatgcaaattttt

SEQ ID NO: 31013 - DNA, 15 bp, Homo sapiens
aaatatgcaaatttt

SEQ ID NO: 31014 - DNA, 15 bp, Homo sapiens
aaaatatgcaaattt

SEQ ID NO: 31015 - DNA, 15 bp, Homo sapiens
aaaaatatgcaaatt

SEQ ID NO: 31016 - DNA, 15 bp, Homo sapiens
caaaaatatgcaaat

SEQ ID NO: 31017 - DNA, 15 bp, Homo sapiens
gcaaaaatatgcaaa

SEQ ID NO: 31018 - DNA, 15 bp, Homo sapiens
tgcaaaaatatgcaa

SEQ ID NO: 31019 - DNA, 15 bp, Homo sapiens
ttgcaaaaatatgca

SEQ ID NO: 31020 - DNA, 15 bp, Homo sapiens
attgcaaaaatatgc

SEQ ID NO: 31021 - DNA, 15 bp, Homo sapiens
gattgcaaaaatatg

SEQ ID NO: 31022 - DNA, 15 bp, Homo sapiens
agattgcaaaaatat

SEQ ID NO: 31023 - DNA, 15 bp, Homo sapiens
cagattgcaaaaata

SEQ ID NO: 31024 - DNA, 15 bp, Homo sapiens
gcagattgcaaaaat

SEQ ID NO: 31025 - DNA, 15 bp, Homo sapiens
tgcagattgcaaaaa

SEQ ID NO: 31026 - DNA, 15 bp, Homo sapiens
atgcagattgcaaaa

SEQ ID NO: 31027 - DNA, 15 bp, Homo sapiens
gatgcagattgcaaa

SEQ ID NO: 31028 - DNA, 15 bp, Homo sapiens
agatgcagattgcaa

SEQ ID NO: 31029 - DNA, 15 bp, Homo sapiens
aagatgcagattgca

SEQ ID NO: 31030 - DNA, 15 bp, Homo sapiens
aaagatgcagattgc

SEQ ID NO: 31031 - DNA, 15 bp, Homo sapiens
gaaagatgcagattg

SEQ ID NO: 31032 - DNA, 15 bp, Homo sapiens
agaaagatgcagatt

SEQ ID NO: 31033 - DNA, 15 bp, Homo sapiens
tagaaagatgcagat

SEQ ID NO: 31034 - DNA, 15 bp, Homo sapiens
gtagaaagatgcaga

SEQ ID NO: 31035 - DNA, 15 bp, Homo sapiens
agtagaaagatgcag

SEQ ID NO: 31036 - DNA, 15 bp, Homo sapiens
aagtagaaagatgca

SEQ ID NO: 31037 - DNA, 15 bp, Homo sapiens
caagtagaaagatgc

SEQ ID NO: 31038 - DNA, 15 bp, Homo sapiens
tcaagtagaaagatg

SEQ ID NO: 31039 - DNA, 15 bp, Homo sapiens
ttcaagtagaaagat

SEQ ID NO: 31040 - DNA, 15 bp, Homo sapiens
tttcaagtagaaaga

SEQ ID NO: 31041 - DNA, 15 bp, Homo sapiens
atttcaagtagaaag

SEQ ID NO: 31042 - DNA, 15 bp, Homo sapiens
aatttcaagtagaaa

SEQ ID NO: 31043 - DNA, 15 bp, Homo sapiens
aaatttcaagtagaa

SEQ ID NO: 31044 - DNA, 15 bp, Homo sapiens
taaatttcaagtaga

SEQ ID NO: 31045 - DNA, 15 bp, Homo sapiens
ataaatttcaagtag

SEQ ID NO: 31046 - DNA, 15 bp, Homo sapiens
gataaatttcaagta

SEQ ID NO: 31047 - DNA, 15 bp, Homo sapiens
ggataaatttcaagt

SEQ ID NO: 31048 - DNA, 15 bp, Homo sapiens
tggataaatttcaag

SEQ ID NO: 31049 - DNA, 15 bp, Homo sapiens
atggataaatttcaa

SEQ ID NO: 31050 - DNA, 15 bp, Homo sapiens
catggataaatttca

SEQ ID NO: 31051 - DNA, 15 bp, Homo sapiens
acatggataaatttc

SEQ ID NO: 31052 - DNA, 15 bp, Homo sapiens
cacatggataaattt

SEQ ID NO: 31053 - DNA, 15 bp, Homo sapiens
ccacatggataaatt

SEQ ID NO: 31054 - DNA, 15 bp, Homo sapiens
tccacatggataaat

SEQ ID NO: 31055 - DNA, 15 bp, Homo sapiens
atccacatggataaa

SEQ ID NO: 31056 - DNA, 15 bp, Homo sapiens
tatccacatggataa

SEQ ID NO: 31057 - DNA, 15 bp, Homo sapiens
gtatccacatggata

SEQ ID NO: 31058 - DNA, 15 bp, Homo sapiens
tgtatccacatggat

SEQ ID NO: 31059 - DNA, 15 bp, Homo sapiens
ttgtatccacatgga

SEQ ID NO: 31060 - DNA, 15 bp, Homo sapiens
cttgtatccacatgg

SEQ ID NO: 31061 - DNA, 15 bp, Homo sapiens
acttgtatccacatg

SEQ ID NO: 31062 - DNA, 15 bp, Homo sapiens
cacttgtatccacat

SEQ ID NO: 31063 - DNA, 15 bp, Homo sapiens
gcacttgtatccaca

SEQ ID NO: 31064 - DNA, 15 bp, Homo sapiens
agcacttgtatccac

SEQ ID NO: 31065 - DNA, 15 bp, Homo sapiens
aagcacttgtatcca

SEQ ID NO: 31066 - DNA, 15 bp, Homo sapiens
gaagcacttgtatcc

SEQ ID NO: 31067 - DNA, 15 bp, Homo sapiens
ggaagcacttgtatc

SEQ ID NO: 31068 - DNA, 15 bp, Homo sapiens
aggaagcacttgtat

SEQ ID NO: 31069 - DNA, 15 bp, Homo sapiens
gaggaagcacttgta

SEQ ID NO: 31070 - DNA, 15 bp, Homo sapiens
agaggaagcacttgt

SEQ ID NO: 31071 - DNA, 15 bp, Homo sapiens
aagaggaagcacttg

SEQ ID NO: 31072 - DNA, 15 bp, Homo sapiens
caagaggaagcactt

SEQ ID NO: 31073 - DNA, 15 bp, Homo sapiens
tcaagaggaagcact

SEQ ID NO: 31074 - DNA, 15 bp, Homo sapiens
gtcaagaggaagcac

SEQ ID NO: 31075 - DNA, 15 bp, Homo sapiens
agtcaagaggaagca

SEQ ID NO: 31076 - DNA, 15 bp, Homo sapiens
cagtcaagaggaagc

SEQ ID NO: 31077 - DNA, 15 bp, Homo sapiens
gcagtcaagaggaag

SEQ ID NO: 31078 - DNA, 15 bp, Homo sapiens
ggcagtcaagaggaa

SEQ ID NO: 31079 - DNA, 15 bp, Homo sapiens
tggcagtcaagagga

SEQ ID NO: 31080 - DNA, 15 bp, Homo sapiens
gtggcagtcaagagg

SEQ ID NO: 31081 - DNA, 15 bp, Homo sapiens
tgtggcagtcaagag

SEQ ID NO: 31082 - DNA, 15 bp, Homo sapiens
atgtggcagtcaaga

SEQ ID NO: 31083 - DNA, 15 bp, Homo sapiens
tatgtggcagtcaag

SEQ ID NO: 31084 - DNA, 15 bp, Homo sapiens
ctatgtggcagtcaa

SEQ ID NO: 31085 - DNA, 15 bp, Homo sapiens
cctatgtggcagtca

SEQ ID NO: 31086 - DNA, 15 bp, Homo sapiens
acctatgtggcagtc

SEQ ID NO: 31087 - DNA, 15 bp, Homo sapiens
aacctatgtggcagt

SEQ ID NO: 31088 - DNA, 15 bp, Homo sapiens
caacctatgtggcag

SEQ ID NO: 31089 - DNA, 15 bp, Homo sapiens
acaacctatgtggca

SEQ ID NO: 31090 - DNA, 15 bp, Homo sapiens
cacaacctatgtggc

SEQ ID NO: 31091 - DNA, 15 bp, Homo sapiens
acacaacctatgtgg

SEQ ID NO: 31092 - DNA, 15 bp, Homo sapiens
aacacaacctatgtg

SEQ ID NO: 31093 - DNA, 15 bp, Homo sapiens
aaacacaacctatgt

SEQ ID NO: 31094 - DNA, 15 bp, Homo sapiens
aaaacacaacctatg

SEQ ID NO: 31095 - DNA, 15 bp, Homo sapiens
aaaaacacaacctat

SEQ ID NO: 31096 - DNA, 15 bp, Homo sapiens
caaaaacacaaccta

SEQ ID NO: 31097 - DNA, 15 bp, Homo sapiens
acaaaaacacaacct

SEQ ID NO: 31098 - DNA, 15 bp, Homo sapiens
aacaaaaacacaacc

SEQ ID NO: 31099 - DNA, 15 bp, Homo sapiens
aaacaaaaacacaac

SEQ ID NO: 31100 - DNA, 15 bp, Homo sapiens
aaaacaaaaacacaa

SEQ ID NO: 31101 - DNA, 15 bp, Homo sapiens
aaaaacaaaaacaca

SEQ ID NO: 31102 - DNA, 15 bp, Homo sapiens
taaaaacaaaaacac

SEQ ID NO: 31103 - DNA, 15 bp, Homo sapiens
ctaaaaacaaaaaca

SEQ ID NO: 31104 - DNA, 15 bp, Homo sapiens
actaaaaacaaaaac

SEQ ID NO: 31105 - DNA, 15 bp, Homo sapiens
tactaaaaacaaaaa

SEQ ID NO: 31106 - DNA, 15 bp, Homo sapiens
ttactaaaaacaaaa

SEQ ID NO: 31107 - DNA, 15 bp, Homo sapiens
cttactaaaaacaaa

SEQ ID NO: 31108 - DNA, 15 bp, Homo sapiens
tcttactaaaaacaa

SEQ ID NO: 31109 - DNA, 15 bp, Homo sapiens
atcttactaaaaaca

SEQ ID NO: 31110 - DNA, 15 bp, Homo sapiens
tatcttactaaaaac

SEQ ID NO: 31111 - DNA, 15 bp, Homo sapiens
ttatcttactaaaaa

SEQ ID NO: 31112 - DNA, 15 bp, Homo sapiens
attatcttactaaaa

SEQ ID NO: 31113 - DNA, 15 bp, Homo sapiens
tattatcttactaaa

SEQ ID NO: 31114 - DNA, 15 bp, Homo sapiens
gtattatcttactaa

SEQ ID NO: 31115 - DNA, 15 bp, Homo sapiens
tgtattatcttacta

SEQ ID NO: 31116 - DNA, 15 bp, Homo sapiens
ctgtattatcttact

SEQ ID NO: 31117 - DNA, 15 bp, Homo sapiens
tctgtattatcttac

SEQ ID NO: 31118 - DNA, 15 bp, Homo sapiens
atctgtattatctta

SEQ ID NO: 31119 - DNA, 15 bp, Homo sapiens
tatctgtattatctt

SEQ ID NO: 31120 - DNA, 15 bp, Homo sapiens
ttatctgtattatct

SEQ ID NO: 31121 - DNA, 15 bp, Homo sapiens
tttatctgtattatc

SEQ ID NO: 31122 - DNA, 15 bp, Homo sapiens
atttatctgtattat

SEQ ID NO: 31123 - DNA, 15 bp, Homo sapiens
aatttatctgtatta

SEQ ID NO: 31124 - DNA, 15 bp, Homo sapiens
aaatttatctgtatt

SEQ ID NO: 31125 - DNA, 15 bp, Homo sapiens
caaatttatctgtat

SEQ ID NO: 31126 - DNA, 15 bp, Homo sapiens
tcaaatttatctgta

SEQ ID NO: 31127 - DNA, 15 bp, Homo sapiens
ttcaaatttatctgt

SEQ ID NO: 31128 - DNA, 15 bp, Homo sapiens
cttcaaatttatctg

SEQ ID NO: 31129 - DNA, 15 bp, Homo sapiens
acttcaaatttatct

SEQ ID NO: 31130 - DNA, 15 bp, Homo sapiens
gacttcaaatttatc

SEQ ID NO: 31131 - DNA, 15 bp, Homo sapiens
ggacttcaaatttat

SEQ ID NO: 31132 - DNA, 15 bp, Homo sapiens
gggacttcaaattta

SEQ ID NO: 31133 - DNA, 15 bp, Homo sapiens
ggggacttcaaattt

SEQ ID NO: 31134 - DNA, 15 bp, Homo sapiens
aggggacttcaaatt

SEQ ID NO: 31135 - DNA, 15 bp, Homo sapiens
aaggggacttcaaat

SEQ ID NO: 31136 - DNA, 15 bp, Homo sapiens
aaaggggacttcaaa

SEQ ID NO: 31137 - DNA, 15 bp, Homo sapiens
caaaggggacttcaa

SEQ ID NO: 31138 - DNA, 15 bp, Homo sapiens
acaaaggggacttca

SEQ ID NO: 31139 - DNA, 15 bp, Homo sapiens
gacaaaggggacttc

SEQ ID NO: 31140 - DNA, 15 bp, Homo sapiens
ggacaaaggggactt

SEQ ID NO: 31141 - DNA, 15 bp, Homo sapiens
gggacaaaggggact

SEQ ID NO: 31142 - DNA, 15 bp, Homo sapiens
tgggacaaaggggac

SEQ ID NO: 31143 - DNA, 15 bp, Homo sapiens
gtgggacaaagggga

SEQ ID NO: 31144 - DNA, 15 bp, Homo sapiens
agtgggacaaagggg

SEQ ID NO: 31145 - DNA, 15 bp, Homo sapiens
aagtgggacaaaggg

SEQ ID NO: 31146 - DNA, 15 bp, Homo sapiens
gaagtgggacaaagg

SEQ ID NO: 31147 - DNA, 15 bp, Homo sapiens
cgaagtgggacaaag

SEQ ID NO: 31148 - DNA, 15 bp, Homo sapiens
ccgaagtgggacaaa

SEQ ID NO: 31149 - DNA, 15 bp, Homo sapiens
accgaagtgggacaa

SEQ ID NO: 31150 - DNA, 15 bp, Homo sapiens
taccgaagtgggaca

SEQ ID NO: 31151 - DNA, 15 bp, Homo sapiens
ttaccgaagtgggac

SEQ ID NO: 31152 - DNA, 15 bp, Homo sapiens
tttaccgaagtggga

SEQ ID NO: 31153 - DNA, 15 bp, Homo sapiens
gtttaccgaagtggg

SEQ ID NO: 31154 - DNA, 15 bp, Homo sapiens
agtttaccgaagtgg

SEQ ID NO: 31155 - DNA, 15 bp, Homo sapiens
aagtttaccgaagtg

SEQ ID NO: 31156 - DNA, 15 bp, Homo sapiens
taagtttaccgaagt

SEQ ID NO: 31157 - DNA, 15 bp, Homo sapiens
ataagtttaccgaag

SEQ ID NO: 31158 - DNA, 15 bp, Homo sapiens
aataagtttaccgaa

SEQ ID NO: 31159 - DNA, 15 bp, Homo sapiens
aaataagtttaccga

SEQ ID NO: 31160 - DNA, 15 bp, Homo sapiens
caaataagtttaccg

SEQ ID NO: 31161 - DNA, 15 bp, Homo sapiens
ccaaataagtttacc

SEQ ID NO: 31162 - DNA, 15 bp, Homo sapiens
accaaataagtttac

SEQ ID NO: 31163 - DNA, 15 bp, Homo sapiens
taccaaataagttta

SEQ ID NO: 31164 - DNA, 15 bp, Homo sapiens
ttaccaaataagttt

SEQ ID NO: 31165 - DNA, 15 bp, Homo sapiens
attaccaaataagtt

SEQ ID NO: 31166 - DNA, 15 bp, Homo sapiens
aattaccaaataagt

SEQ ID NO: 31167 - DNA, 15 bp, Homo sapiens
aaattaccaaataag

SEQ ID NO: 31168 - DNA, 15 bp, Homo sapiens
aaaattaccaaataa

SEQ ID NO: 31169 - DNA, 15 bp, Homo sapiens
taaaattaccaaata

SEQ ID NO: 31170 - DNA, 15 bp, Homo sapiens
gtaaaattaccaaat

SEQ ID NO: 31171 - DNA, 15 bp, Homo sapiens
tgtaaaattaccaaa

SEQ ID NO: 31172 - DNA, 15 bp, Homo sapiens
atgtaaaattaccaa

SEQ ID NO: 31173 - DNA, 15 bp, Homo sapiens
aatgtaaaattacca

SEQ ID NO: 31174 - DNA, 15 bp, Homo sapiens
aaatgtaaaattacc

SEQ ID NO: 31175 - DNA, 15 bp, Homo sapiens
gaaatgtaaaattac

SEQ ID NO: 31176 - DNA, 15 bp, Homo sapiens
ggaaatgtaaaatta

SEQ ID NO: 31177 - DNA, 15 bp, Homo sapiens
aggaaatgtaaaatt

SEQ ID NO: 31178 - DNA, 15 bp, Homo sapiens
taggaaatgtaaaat

SEQ ID NO: 31179 - DNA, 15 bp, Homo sapiens
ctaggaaatgtaaaa

SEQ ID NO: 31180 - DNA, 15 bp, Homo sapiens
cctaggaaatgtaaa

SEQ ID NO: 31181 - DNA, 15 bp, Homo sapiens
acctaggaaatgtaa

SEQ ID NO: 31182 - DNA, 15 bp, Homo sapiens
tacctaggaaatgta

SEQ ID NO: 31183 - DNA, 15 bp, Homo sapiens
ttacctaggaaatgt

SEQ ID NO: 31184 - DNA, 15 bp, Homo sapiens
tttacctaggaaatg

SEQ ID NO: 31185 - DNA, 15 bp, Homo sapiens
ttttacctaggaaat

SEQ ID NO: 31186 - DNA, 15 bp, Homo sapiens
attttacctaggaaa

SEQ ID NO: 31187 - DNA, 15 bp, Homo sapiens
cattttacctaggaa

SEQ ID NO: 31188 - DNA, 15 bp, Homo sapiens
acattttacctagga

SEQ ID NO: 31189 - DNA, 15 bp, Homo sapiens
cacattttacctagg

SEQ ID NO: 31190 - DNA, 15 bp, Homo sapiens
acacattttacctag

SEQ ID NO: 31191 - DNA, 15 bp, Homo sapiens
aacacattttaccta

SEQ ID NO: 31192 - DNA, 15 bp, Homo sapiens
aaacacattttacct

SEQ ID NO: 31193 - DNA, 15 bp, Homo sapiens
aaaacacattttacc

SEQ ID NO: 31194 - DNA, 15 bp, Homo sapiens
caaaacacattttac

SEQ ID NO: 31195 - DNA, 15 bp, Homo sapiens
acaaaacacatttta

SEQ ID NO: 31196 - DNA, 15 bp, Homo sapiens
cacaaaacacatttt

SEQ ID NO: 31197 - DNA, 15 bp, Homo sapiens
tcacaaaacacattt

SEQ ID NO: 31198 - DNA, 15 bp, Homo sapiens
gtcacaaaacacatt

SEQ ID NO: 31199 - DNA, 15 bp, Homo sapiens
tgtcacaaaacacat

SEQ ID NO: 31200 - DNA, 15 bp, Homo sapiens
gtgtcacaaaacaca

SEQ ID NO: 31201 - DNA, 15 bp, Homo sapiens
ggtgtcacaaaacac

SEQ ID NO: 31202 - DNA, 15 bp, Homo sapiens
tggtgtcacaaaaca

SEQ ID NO: 31203 - DNA, 15 bp, Homo sapiens
ttggtgtcacaaaac

SEQ ID NO: 31204 - DNA, 15 bp, Homo sapiens
gttggtgtcacaaaa

SEQ ID NO: 31205 - DNA, 15 bp, Homo sapiens
agttggtgtcacaaa

SEQ ID NO: 31206 - DNA, 15 bp, Homo sapiens
aagttggtgtcacaa

SEQ ID NO: 31207 - DNA, 15 bp, Homo sapiens
taagttggtgtcaca

SEQ ID NO: 31208 - DNA, 15 bp, Homo sapiens
ataagttggtgtcac

SEQ ID NO: 31209 - DNA, 15 bp, Homo sapiens
cataagttggtgtca

SEQ ID NO: 31210 - DNA, 15 bp, Homo sapiens
tcataagttggtgtc

SEQ ID NO: 31211 - DNA, 15 bp, Homo sapiens
ttcataagttggtgt

SEQ ID NO: 31212 - DNA, 15 bp, Homo sapiens
tttcataagttggtg

SEQ ID NO: 31213 - DNA, 15 bp, Homo sapiens
gtttcataagttggt

SEQ ID NO: 31214 - DNA, 15 bp, Homo sapiens
tgtttcataagttgg

SEQ ID NO: 31215 - DNA, 15 bp, Homo sapiens
ttgtttcataagttg

SEQ ID NO: 31216 - DNA, 15 bp, Homo sapiens
tttgtttcataagtt

SEQ ID NO: 31217 - DNA, 15 bp, Homo sapiens
ttttgtttcataagt

SEQ ID NO: 31218 - DNA, 15 bp, Homo sapiens
tttttgtttcataag

SEQ ID NO: 31219 - DNA, 15 bp, Homo sapiens
atttttgtttcataa

SEQ ID NO: 31220 - DNA, 15 bp, Homo sapiens
aatttttgtttcata

SEQ ID NO: 31221 - DNA, 15 bp, Homo sapiens
gaatttttgtttcat

SEQ ID NO: 31222 - DNA, 15 bp, Homo sapiens
agaatttttgtttca

SEQ ID NO: 31223 - DNA, 15 bp, Homo sapiens
tagaatttttgtttc

SEQ ID NO: 31224 - DNA, 15 bp, Homo sapiens
ttagaatttttgttt

SEQ ID NO: 31225 - DNA, 15 bp, Homo sapiens
tttagaatttttgtt

SEQ ID NO: 31226 - DNA, 15 bp, Homo sapiens
ttttagaatttttgt

SEQ ID NO: 31227 - DNA, 15 bp, Homo sapiens
gttttagaatttttg

SEQ ID NO: 31228 - DNA, 15 bp, Homo sapiens
agttttagaattttt

SEQ ID NO: 31229 - DNA, 15 bp, Homo sapiens
gagttttagaatttt

SEQ ID NO: 31230 - DNA, 15 bp, Homo sapiens
agagttttagaattt

SEQ ID NO: 31231 - DNA, 15 bp, Homo sapiens
aagagttttagaatt

SEQ ID NO: 31232 - DNA, 15 bp, Homo sapiens
aaagagttttagaat

SEQ ID NO: 31233 - DNA, 15 bp, Homo sapiens
caaagagttttagaa

SEQ ID NO: 31234 - DNA, 15 bp, Homo sapiens
gcaaagagttttaga

SEQ ID NO: 31235 - DNA, 15 bp, Homo sapiens
ggcaaagagttttag

SEQ ID NO: 31236 - DNA, 15 bp, Homo sapiens
tggcaaagagtttta

SEQ ID NO: 31237 - DNA, 15 bp, Homo sapiens
ttggcaaagagtttt

SEQ ID NO: 31238 - DNA, 15 bp, Homo sapiens
cttggcaaagagttt

SEQ ID NO: 31239 - DNA, 15 bp, Homo sapiens
tcttggcaaagagtt

SEQ ID NO: 31240 - DNA, 15 bp, Homo sapiens
ctcttggcaaagagt

SEQ ID NO: 31241 - DNA, 15 bp, Homo sapiens
tctcttggcaaagag

SEQ ID NO: 31242 - DNA, 15 bp, Homo sapiens
gtctcttggcaaaga

SEQ ID NO: 31243 - DNA, 15 bp, Homo sapiens
ggtctcttggcaaag

SEQ ID NO: 31244 - DNA, 15 bp, Homo sapiens
aggtctcttggcaaa

SEQ ID NO: 31245 - DNA, 15 bp, Homo sapiens
taggtctcttggcaa

SEQ ID NO: 31246 - DNA, 15 bp, Homo sapiens
gtaggtctcttggca

SEQ ID NO: 31247 - DNA, 15 bp, Homo sapiens
cgtaggtctcttggc

SEQ ID NO: 31248 - DNA, 15 bp, Homo sapiens
ccgtaggtctcttgg

SEQ ID NO: 31249 - DNA, 15 bp, Homo sapiens
gccgtaggtctcttg

SEQ ID NO: 31250 - DNA, 15 bp, Homo sapiens
agccgtaggtctctt

SEQ ID NO: 31251 - DNA, 15 bp, Homo sapiens
gagccgtaggtctct

SEQ ID NO: 31252 - DNA, 15 bp, Homo sapiens
agagccgtaggtctc

SEQ ID NO: 31253 - DNA, 15 bp, Homo sapiens
tagagccgtaggtct

SEQ ID NO: 31254 - DNA, 15 bp, Homo sapiens
atagagccgtaggtc

SEQ ID NO: 31255 - DNA, 15 bp, Homo sapiens
aatagagccgtaggt

SEQ ID NO: 31256 - DNA, 15 bp, Homo sapiens
gaatagagccgtagg

SEQ ID NO: 31257 - DNA, 15 bp, Homo sapiens
tgaatagagccgtag

SEQ ID NO: 31258 - DNA, 15 bp, Homo sapiens
atgaatagagccgta

SEQ ID NO: 31259 - DNA, 15 bp, Homo sapiens
aatgaatagagccgt

SEQ ID NO: 31260 - DNA, 15 bp, Homo sapiens
aaatgaatagagccg

SEQ ID NO: 31261 - DNA, 15 bp, Homo sapiens
aaaatgaatagagcc

SEQ ID NO: 31262 - DNA, 15 bp, Homo sapiens
gaaaatgaatagagc

SEQ ID NO: 31263 - DNA, 15 bp, Homo sapiens
ggaaaatgaatagag

SEQ ID NO: 31264 - DNA, 15 bp, Homo sapiens
aggaaaatgaataga

SEQ ID NO: 31265 - DNA, 15 bp, Homo sapiens
gaggaaaatgaatag

SEQ ID NO: 31266 - DNA, 15 bp, Homo sapiens
ggaggaaaatgaata

SEQ ID NO: 31267 - DNA, 15 bp, Homo sapiens
aggaggaaaatgaat

SEQ ID NO: 31268 - DNA, 15 bp, Homo sapiens
caggaggaaaatgaa

SEQ ID NO: 31269 - DNA, 15 bp, Homo sapiens
gcaggaggaaaatga

SEQ ID NO: 31270 - DNA, 15 bp, Homo sapiens
agcaggaggaaaatg

SEQ ID NO: 31271 - DNA, 15 bp, Homo sapiens
aagcaggaggaaaat

SEQ ID NO: 31272 - DNA, 15 bp, Homo sapiens
gaagcaggaggaaaa

SEQ ID NO: 31273 - DNA, 15 bp, Homo sapiens
ggaagcaggaggaaa

SEQ ID NO: 31274 - DNA, 15 bp, Homo sapiens
gggaagcaggaggaa

SEQ ID NO: 31275 - DNA, 15 bp, Homo sapiens
tgggaagcaggagga

SEQ ID NO: 31276 - DNA, 15 bp, Homo sapiens
atgggaagcaggagg

SEQ ID NO: 31277 - DNA, 15 bp, Homo sapiens
aatgggaagcaggag

SEQ ID NO: 31278 - DNA, 15 bp, Homo sapiens
gaatgggaagcagga

SEQ ID NO: 31279 - DNA, 15 bp, Homo sapiens
tgaatgggaagcagg

SEQ ID NO: 31280 - DNA, 15 bp, Homo sapiens
ctgaatgggaagcag

SEQ ID NO: 31281 - DNA, 15 bp, Homo sapiens
actgaatgggaagca

SEQ ID NO: 31282 - DNA, 15 bp, Homo sapiens
cactgaatgggaagc

SEQ ID NO: 31283 - DNA, 15 bp, Homo sapiens
ccactgaatgggaag

SEQ ID NO: 31284 - DNA, 15 bp, Homo sapiens
cccactgaatgggaa

SEQ ID NO: 31285 - DNA, 15 bp, Homo sapiens
gcccactgaatggga

SEQ ID NO: 31286 - DNA, 15 bp, Homo sapiens
agcccactgaatggg

SEQ ID NO: 31287 - DNA, 15 bp, Homo sapiens
aagcccactgaatgg

SEQ ID NO: 31288 - DNA, 15 bp, Homo sapiens
aaagcccactgaatg

SEQ ID NO: 31289 - DNA, 15 bp, Homo sapiens
aaaagcccactgaat

SEQ ID NO: 31290 - DNA, 15 bp, Homo sapiens
caaaagcccactgaa

SEQ ID NO: 31291 - DNA, 15 bp, Homo sapiens
gcaaaagcccactga

SEQ ID NO: 31292 - DNA, 15 bp, Homo sapiens
ggcaaaagcccactg

SEQ ID NO: 31293 - DNA, 15 bp, Homo sapiens
aggcaaaagcccact

SEQ ID NO: 31294 - DNA, 15 bp, Homo sapiens
taggcaaaagcccac

SEQ ID NO: 31295 - DNA, 15 bp, Homo sapiens
ctaggcaaaagccca

SEQ ID NO: 31296 - DNA, 15 bp, Homo sapiens
cctaggcaaaagccc

SEQ ID NO: 31297 - DNA, 15 bp, Homo sapiens
ccctaggcaaaagcc

SEQ ID NO: 31298 - DNA, 15 bp, Homo sapiens
cccctaggcaaaagc

SEQ ID NO: 31299 - DNA, 15 bp, Homo sapiens
acccctaggcaaaag

SEQ ID NO: 31300 - DNA, 15 bp, Homo sapiens
tacccctaggcaaaa

SEQ ID NO: 31301 - DNA, 15 bp, Homo sapiens
atacccctaggcaaa

SEQ ID NO: 31302 - DNA, 15 bp, Homo sapiens
catacccctaggcaa

SEQ ID NO: 31303 - DNA, 15 bp, Homo sapiens
tcatacccctaggca

SEQ ID NO: 31304 - DNA, 15 bp, Homo sapiens
ttcatacccctaggc

SEQ ID NO: 31305 - DNA, 15 bp, Homo sapiens
attcatacccctagg

SEQ ID NO: 31306 - DNA, 15 bp, Homo sapiens
cattcatacccctag

SEQ ID NO: 31307 - DNA, 15 bp, Homo sapiens
acattcataccccta

SEQ ID NO: 31308 - DNA, 15 bp, Homo sapiens
cacattcatacccct

SEQ ID NO: 31309 - DNA, 15 bp, Homo sapiens
ccacattcatacccc

SEQ ID NO: 31310 - DNA, 15 bp, Homo sapiens
gccacattcataccc

SEQ ID NO: 31311 - DNA, 15 bp, Homo sapiens
tgccacattcatacc

SEQ ID NO: 31312 - DNA, 15 bp, Homo sapiens
atgccacattcatac

SEQ ID NO: 31313 - DNA, 15 bp, Homo sapiens
catgccacattcata

SEQ ID NO: 31314 - DNA, 15 bp, Homo sapiens
gcatgccacattcat

SEQ ID NO: 31315 - DNA, 15 bp, Homo sapiens
ggcatgccacattca

SEQ ID NO: 31316 - DNA, 15 bp, Homo sapiens
tggcatgccacattc

SEQ ID NO: 31317 - DNA, 15 bp, Homo sapiens
ctggcatgccacatt

SEQ ID NO: 31318 - DNA, 15 bp, Homo sapiens
actggcatgccacat

SEQ ID NO: 31319 - DNA, 15 bp, Homo sapiens
aactggcatgccaca

SEQ ID NO: 31320 - DNA, 15 bp, Homo sapiens
caactggcatgccac

SEQ ID NO: 31321 - DNA, 15 bp, Homo sapiens
ccaactggcatgcca

SEQ ID NO: 31322 - DNA, 15 bp, Homo sapiens
gccaactggcatgcc

SEQ ID NO: 31323 - DNA, 15 bp, Homo sapiens
agccaactggcatgc

SEQ ID NO: 31324 - DNA, 15 bp, Homo sapiens
cagccaactggcatg

SEQ ID NO: 31325 - DNA, 15 bp, Homo sapiens
tcagccaactggcat

SEQ ID NO: 31326 - DNA, 15 bp, Homo sapiens
gtcagccaactggca

SEQ ID NO: 31327 - DNA, 15 bp, Homo sapiens
ggtcagccaactggc

SEQ ID NO: 31328 - DNA, 15 bp, Homo sapiens
gggtcagccaactgg

SEQ ID NO: 31329 - DNA, 15 bp, Homo sapiens
tgggtcagccaactg

SEQ ID NO: 31330 - DNA, 15 bp, Homo sapiens
ttgggtcagccaact

SEQ ID NO: 31331 - DNA, 15 bp, Homo sapiens
gttgggtcagccaac

SEQ ID NO: 31332 - DNA, 15 bp, Homo sapiens
ggttgggtcagccaa

SEQ ID NO: 31333 - DNA, 15 bp, Homo sapiens
tggttgggtcagcca

SEQ ID NO: 31334 - DNA, 15 bp, Homo sapiens
atggttgggtcagcc

SEQ ID NO: 31335 - DNA, 15 bp, Homo sapiens
aatggttgggtcagc

SEQ ID NO: 31336 - DNA, 15 bp, Homo sapiens
caatggttgggtcag

SEQ ID NO: 31337 - DNA, 15 bp, Homo sapiens
gcaatggttgggtca

SEQ ID NO: 31338 - DNA, 15 bp, Homo sapiens
agcaatggttgggtc

SEQ ID NO: 31339 - DNA, 15 bp, Homo sapiens
aagcaatggttgggt

SEQ ID NO: 31340 - DNA, 15 bp, Homo sapiens
aaagcaatggttggg

SEQ ID NO: 31341 - DNA, 15 bp, Homo sapiens
gaaagcaatggttgg

SEQ ID NO: 31342 - DNA, 15 bp, Homo sapiens
ggaaagcaatggttg

SEQ ID NO: 31343 - DNA, 15 bp, Homo sapiens
gggaaagcaatggtt

SEQ ID NO: 31344 - DNA, 15 bp, Homo sapiens
agggaaagcaatggt

SEQ ID NO: 31345 - DNA, 15 bp, Homo sapiens
aagggaaagcaatgg

SEQ ID NO: 31346 - DNA, 15 bp, Homo sapiens
aaagggaaagcaatg

SEQ ID NO: 31347 - DNA, 15 bp, Homo sapiens
gaaagggaaagcaat

SEQ ID NO: 31348 - DNA, 15 bp, Homo sapiens
tgaaagggaaagcaa

SEQ ID NO: 31349 - DNA, 15 bp, Homo sapiens
ctgaaagggaaagca

SEQ ID NO: 31350 - DNA, 15 bp, Homo sapiens
tctgaaagggaaagc

SEQ ID NO: 31351 - DNA, 15 bp, Homo sapiens
gtctgaaagggaaag

SEQ ID NO: 31352 - DNA, 15 bp, Homo sapiens
agtctgaaagggaaa

SEQ ID NO: 31353 - DNA, 15 bp, Homo sapiens
cagtctgaaagggaa

SEQ ID NO: 31354 - DNA, 15 bp, Homo sapiens
ccagtctgaaaggga

SEQ ID NO: 31355 - DNA, 15 bp, Homo sapiens
gccagtctgaaaggg

SEQ ID NO: 31356 - DNA, 15 bp, Homo sapiens
cgccagtctgaaagg

SEQ ID NO: 31357 - DNA, 15 bp, Homo sapiens
tcgccagtctgaaag

SEQ ID NO: 31358 - DNA, 15 bp, Homo sapiens
atcgccagtctgaaa

SEQ ID NO: 31359 - DNA, 15 bp, Homo sapiens
catcgccagtctgaa

SEQ ID NO: 31360 - DNA, 15 bp, Homo sapiens
ccatcgccagtctga

SEQ ID NO: 31361 - DNA, 15 bp, Homo sapiens
gccatcgccagtctg

SEQ ID NO: 31362 - DNA, 15 bp, Homo sapiens
cgccatcgccagtct

SEQ ID NO: 31363 - DNA, 15 bp, Homo sapiens
acgccatcgccagtc

SEQ ID NO: 31364 - DNA, 15 bp, Homo sapiens
cacgccatcgccagt

SEQ ID NO: 31365 - DNA, 15 bp, Homo sapiens
tcacgccatcgccag

SEQ ID NO: 31366 - DNA, 15 bp, Homo sapiens
ttcacgccatcgcca

SEQ ID NO: 31367 - DNA, 15 bp, Homo sapiens
gttcacgccatcgcc

SEQ ID NO: 31368 - DNA, 15 bp, Homo sapiens
cgttcacgccatcgc

SEQ ID NO: 31369 - DNA, 15 bp, Homo sapiens
tcgttcacgccatcg

SEQ ID NO: 31370 - DNA, 15 bp, Homo sapiens
atcgttcacgccatc

SEQ ID NO: 31371 - DNA, 15 bp, Homo sapiens
catcgttcacgccat

SEQ ID NO: 31372 - DNA, 15 bp, Homo sapiens
gcatcgttcacgcca

SEQ ID NO: 31373 - DNA, 15 bp, Homo sapiens
agcatcgttcacgcc

SEQ ID NO: 31374 - DNA, 15 bp, Homo sapiens
gagcatcgttcacgc

SEQ ID NO: 31375 - DNA, 15 bp, Homo sapiens
ggagcatcgttcacg

SEQ ID NO: 31376 - DNA, 15 bp, Homo sapiens
aggagcatcgttcac

SEQ ID NO: 31377 - DNA, 15 bp, Homo sapiens
caggagcatcgttca

SEQ ID NO: 31378 - DNA, 15 bp, Homo sapiens
gcaggagcatcgttc

SEQ ID NO: 31379 - DNA, 15 bp, Homo sapiens
agcaggagcatcgtt

SEQ ID NO: 31380 - DNA, 15 bp, Homo sapiens
gagcaggagcatcgt

SEQ ID NO: 31381 - DNA, 15 bp, Homo sapiens
agagcaggagcatcg

SEQ ID NO: 31382 - DNA, 15 bp, Homo sapiens
cagagcaggagcatc

SEQ ID NO: 31383 - DNA, 15 bp, Homo sapiens
tcagagcaggagcat

SEQ ID NO: 31384 - DNA, 15 bp, Homo sapiens
ttcagagcaggagca

SEQ ID NO: 31385 - DNA, 15 bp, Homo sapiens
cttcagagcaggagc

SEQ ID NO: 31386 - DNA, 15 bp, Homo sapiens
tcttcagagcaggag

SEQ ID NO: 31387 - DNA, 15 bp, Homo sapiens
ttcttcagagcagga

SEQ ID NO: 31388 - DNA, 15 bp, Homo sapiens
tttcttcagagcagg

SEQ ID NO: 31389 - DNA, 15 bp, Homo sapiens
ctttcttcagagcag

SEQ ID NO: 31390 - DNA, 15 bp, Homo sapiens
gctttcttcagagca

SEQ ID NO: 31391 - DNA, 15 bp, Homo sapiens
ggctttcttcagagc

SEQ ID NO: 31392 - DNA, 15 bp, Homo sapiens
cggctttcttcagag

SEQ ID NO: 31393 - DNA, 15 bp, Homo sapiens
tcggctttcttcaga

SEQ ID NO: 31394 - DNA, 15 bp, Homo sapiens
ctcggctttcttcag

SEQ ID NO: 31395 - DNA, 15 bp, Homo sapiens
tctcggctttcttca

SEQ ID NO: 31396 - DNA, 15 bp, Homo sapiens
atctcggctttcttc

SEQ ID NO: 31397 - DNA, 15 bp, Homo sapiens
aatctcggctttctt

SEQ ID NO: 31398 - DNA, 15 bp, Homo sapiens
caatctcggctttct

SEQ ID NO: 31399 - DNA, 15 bp, Homo sapiens
ccaatctcggctttc

SEQ ID NO: 31400 - DNA, 15 bp, Homo sapiens
gccaatctcggcttt

SEQ ID NO: 31401 - DNA, 15 bp, Homo sapiens
tgccaatctcggctt

SEQ ID NO: 31402 - DNA, 15 bp, Homo sapiens
atgccaatctcggct

SEQ ID NO: 31403 - DNA, 15 bp, Homo sapiens
aatgccaatctcggc

SEQ ID NO: 31404 - DNA, 15 bp, Homo sapiens
caatgccaatctcgg

SEQ ID NO: 31405 - DNA, 15 bp, Homo sapiens
gcaatgccaatctcg

SEQ ID NO: 31406 - DNA, 15 bp, Homo sapiens
agcaatgccaatctc

SEQ ID NO: 31407 - DNA, 15 bp, Homo sapiens
tagcaatgccaatct

SEQ ID NO: 31408 - DNA, 15 bp, Homo sapiens
atagcaatgccaatc

SEQ ID NO: 31409 - DNA, 15 bp, Homo sapiens
catagcaatgccaat

SEQ ID NO: 31410 - DNA, 15 bp, Homo sapiens
ccatagcaatgccaa

SEQ ID NO: 31411 - DNA, 15 bp, Homo sapiens
cccatagcaatgcca

SEQ ID NO: 31412 - DNA, 15 bp, Homo sapiens
gcccatagcaatgcc

SEQ ID NO: 31413 - DNA, 15 bp, Homo sapiens
agcccatagcaatgc

SEQ ID NO: 31414 - DNA, 15 bp, Homo sapiens
gagcccatagcaatg

SEQ ID NO: 31415 - DNA, 15 bp, Homo sapiens
agagcccatagcaat

SEQ ID NO: 31416 - DNA, 15 bp, Homo sapiens
cagagcccatagcaa

SEQ ID NO: 31417 - DNA, 15 bp, Homo sapiens
ccagagcccatagca

SEQ ID NO: 31418 - DNA, 15 bp, Homo sapiens
gccagagcccatagc

SEQ ID NO: 31419 - DNA, 15 bp, Homo sapiens
tgccagagcccatag

SEQ ID NO: 31420 - DNA, 15 bp, Homo sapiens
gtgccagagcccata

SEQ ID NO: 31421 - DNA, 15 bp, Homo sapiens
agtgccagagcccat

SEQ ID NO: 31422 - DNA, 15 bp, Homo sapiens
cagtgccagagccca

SEQ ID NO: 31423 - DNA, 15 bp, Homo sapiens
gcagtgccagagccc

SEQ ID NO: 31424 - DNA, 15 bp, Homo sapiens
cgcagtgccagagcc

SEQ ID NO: 31425 - DNA, 15 bp, Homo sapiens
ccgcagtgccagagc

SEQ ID NO: 31426 - DNA, 15 bp, Homo sapiens
accgcagtgccagag

SEQ ID NO: 31427 - DNA, 15 bp, Homo sapiens
caccgcagtgccaga

SEQ ID NO: 31428 - DNA, 15 bp, Homo sapiens
ccaccgcagtgccag

SEQ ID NO: 31429 - DNA, 15 bp, Homo sapiens
gccaccgcagtgcca

SEQ ID NO: 31430 - DNA, 15 bp, Homo sapiens
agccaccgcagtgcc

SEQ ID NO: 31431 - DNA, 15 bp, Homo sapiens
tagccaccgcagtgc

SEQ ID NO: 31432 - DNA, 15 bp, Homo sapiens
ttagccaccgcagtg

SEQ ID NO: 31433 - DNA, 15 bp, Homo sapiens
tttagccaccgcagt

SEQ ID NO: 31434 - DNA, 15 bp, Homo sapiens
ttttagccaccgcag

SEQ ID NO: 31435 - DNA, 15 bp, Homo sapiens
gttttagccaccgca

SEQ ID NO: 31436 - DNA, 15 bp, Homo sapiens
ggttttagccaccgc

SEQ ID NO: 31437 - DNA, 15 bp, Homo sapiens
cggttttagccaccg

SEQ ID NO: 31438 - DNA, 15 bp, Homo sapiens
gcggttttagccacc

SEQ ID NO: 31439 - DNA, 15 bp, Homo sapiens
ggcggttttagccac

SEQ ID NO: 31440 - DNA, 15 bp, Homo sapiens
aggcggttttagcca

SEQ ID NO: 31441 - DNA, 15 bp, Homo sapiens
gaggcggttttagcc

SEQ ID NO: 31442 - DNA, 15 bp, Homo sapiens
agaggcggttttagc

SEQ ID NO: 31443 - DNA, 15 bp, Homo sapiens
cagaggcggttttag

SEQ ID NO: 31444 - DNA, 15 bp, Homo sapiens
tcagaggcggtttta

SEQ ID NO: 31445 - DNA, 15 bp, Homo sapiens
ctcagaggcggtttt

SEQ ID NO: 31446 - DNA, 15 bp, Homo sapiens
tctcagaggcggttt

SEQ ID NO: 31447 - DNA, 15 bp, Homo sapiens
atctcagaggcggtt

SEQ ID NO: 31448 - DNA, 15 bp, Homo sapiens
catctcagaggcggt

SEQ ID NO: 31449 - DNA, 15 bp, Homo sapiens
ccatctcagaggcgg

SEQ ID NO: 31450 - DNA, 15 bp, Homo sapiens
accatctcagaggcg

SEQ ID NO: 31451 - DNA, 15 bp, Homo sapiens
gaccatctcagaggc

SEQ ID NO: 31452 - DNA, 15 bp, Homo sapiens
ggaccatctcagagg

SEQ ID NO: 31453 - DNA, 15 bp, Homo sapiens
aggaccatctcagag

SEQ ID NO: 31454 - DNA, 15 bp, Homo sapiens
caggaccatctcaga

SEQ ID NO: 31455 - DNA, 15 bp, Homo sapiens
ccaggaccatctcag

SEQ ID NO: 31456 - DNA, 15 bp, Homo sapiens
gccaggaccatctca

SEQ ID NO: 31457 - DNA, 15 bp, Homo sapiens
cgccaggaccatctc

SEQ ID NO: 31458 - DNA, 15 bp, Homo sapiens
ccgccaggaccatct

SEQ ID NO: 31459 - DNA, 15 bp, Homo sapiens
tccgccaggaccatc

SEQ ID NO: 31460 - DNA, 15 bp, Homo sapiens
atccgccaggaccat

SEQ ID NO: 31461 - DNA, 15 bp, Homo sapiens
catccgccaggacca

SEQ ID NO: 31462 - DNA, 15 bp, Homo sapiens
tcatccgccaggacc

SEQ ID NO: 31463 - DNA, 15 bp, Homo sapiens
gtcatccgccaggac

SEQ ID NO: 31464 - DNA, 15 bp, Homo sapiens
tgtcatccgccagga

SEQ ID NO: 31465 - DNA, 15 bp, Homo sapiens
ttgtcatccgccagg

SEQ ID NO: 31466 - DNA, 15 bp, Homo sapiens
gttgtcatccgccag

SEQ ID NO: 31467 - DNA, 15 bp, Homo sapiens
agttgtcatccgcca

SEQ ID NO: 31468 - DNA, 15 bp, Homo sapiens
aagttgtcatccgcc

SEQ ID NO: 31469 - DNA, 15 bp, Homo sapiens
gaagttgtcatccgc

SEQ ID NO: 31470 - DNA, 15 bp, Homo sapiens
agaagttgtcatccg

SEQ ID NO: 31471 - DNA, 15 bp, Homo sapiens
gagaagttgtcatcc

SEQ ID NO: 31472 - DNA, 15 bp, Homo sapiens
ggagaagttgtcatc

SEQ ID NO: 31473 - DNA, 15 bp, Homo sapiens
tggagaagttgtcat

SEQ ID NO: 31474 - DNA, 15 bp, Homo sapiens
gtggagaagttgtca

SEQ ID NO: 31475 - DNA, 15 bp, Homo sapiens
ggtggagaagttgtc

SEQ ID NO: 31476 - DNA, 15 bp, Homo sapiens
tggtggagaagttgt

SEQ ID NO: 31477 - DNA, 15 bp, Homo sapiens
atggtggagaagttg

SEQ ID NO: 31478 - DNA, 15 bp, Homo sapiens
aatggtggagaagtt

SEQ ID NO: 31479 - DNA, 15 bp, Homo sapiens
caatggtggagaagt

SEQ ID NO: 31480 - DNA, 15 bp, Homo sapiens
acaatggtggagaag

SEQ ID NO: 31481 - DNA, 15 bp, Homo sapiens
cacaatggtggagaa

SEQ ID NO: 31482 - DNA, 15 bp, Homo sapiens
ccacaatggtggaga

SEQ ID NO: 31483 - DNA, 15 bp, Homo sapiens
gccacaatggtggag

SEQ ID NO: 31484 - DNA, 15 bp, Homo sapiens
agccacaatggtgga

SEQ ID NO: 31485 - DNA, 15 bp, Homo sapiens
cagccacaatggtgg

SEQ ID NO: 31486 - DNA, 15 bp, Homo sapiens
gcagccacaatggtg

SEQ ID NO: 31487 - DNA, 15 bp, Homo sapiens
ggcagccacaatggt

SEQ ID NO: 31488 - DNA, 15 bp, Homo sapiens
cggcagccacaatgg

SEQ ID NO: 31489 - DNA, 15 bp, Homo sapiens
acggcagccacaatg

SEQ ID NO: 31490 - DNA, 15 bp, Homo sapiens
aacggcagccacaat

SEQ ID NO: 31491 - DNA, 15 bp, Homo sapiens
caacggcagccacaa

SEQ ID NO: 31492 - DNA, 15 bp, Homo sapiens
tcaacggcagccaca

SEQ ID NO: 31493 - DNA, 15 bp, Homo sapiens
ctcaacggcagccac

SEQ ID NO: 31494 - DNA, 15 bp, Homo sapiens
cctcaacggcagcca

SEQ ID NO: 31495 - DNA, 15 bp, Homo sapiens
tcctcaacggcagcc

SEQ ID NO: 31496 - DNA, 15 bp, Homo sapiens
ctcctcaacggcagc

SEQ ID NO: 31497 - DNA, 15 bp, Homo sapiens
cctcctcaacggcag

SEQ ID NO: 31498 - DNA, 15 bp, Homo sapiens
ccctcctcaacggca

SEQ ID NO: 31499 - DNA, 15 bp, Homo sapiens
cccctcctcaacggc

SEQ ID NO: 31500 - DNA, 15 bp, Homo sapiens
gcccctcctcaacgg

SEQ ID NO: 31501 - DNA, 15 bp, Homo sapiens
cgcccctcctcaacg

SEQ ID NO: 31502 - DNA, 15 bp, Homo sapiens
ccgcccctcctcaac

SEQ ID NO: 31503 - DNA, 15 bp, Homo sapiens
cccgcccctcctcaa

SEQ ID NO: 31504 - DNA, 15 bp, Homo sapiens
gcccgcccctcctca

SEQ ID NO: 31505 - DNA, 15 bp, Homo sapiens
tgcccgcccctcctc

SEQ ID NO: 31506 - DNA, 15 bp, Homo sapiens
ttgcccgcccctcct

SEQ ID NO: 31507 - DNA, 15 bp, Homo sapiens
attgcccgcccctcc

SEQ ID NO: 31508 - DNA, 15 bp, Homo sapiens
gattgcccgcccctc

SEQ ID NO: 31509 - DNA, 15 bp, Homo sapiens
agattgcccgcccct

SEQ ID NO: 31510 - DNA, 15 bp, Homo sapiens
tagattgcccgcccc

SEQ ID NO: 31511 - DNA, 15 bp, Homo sapiens
gtagattgcccgccc

SEQ ID NO: 31512 - DNA, 15 bp, Homo sapiens
tgtagattgcccgcc

SEQ ID NO: 31513 - DNA, 15 bp, Homo sapiens
ttgtagattgcccgc

SEQ ID NO: 31514 - DNA, 15 bp, Homo sapiens
gttgtagattgcccg

SEQ ID NO: 31515 - DNA, 15 bp, Homo sapiens
tgttgtagattgccc

SEQ ID NO: 31516 - DNA, 15 bp, Homo sapiens
ttgttgtagattgcc

SEQ ID NO: 31517 - DNA, 15 bp, Homo sapiens
gttgttgtagattgc

SEQ ID NO: 31518 - DNA, 15 bp, Homo sapiens
tgttgttgtagattg

SEQ ID NO: 31519 - DNA, 15 bp, Homo sapiens
atgttgttgtagatt

SEQ ID NO: 31520 - DNA, 15 bp, Homo sapiens
catgttgttgtagat

SEQ ID NO: 31521 - DNA, 15 bp, Homo sapiens
tcatgttgttgtaga

SEQ ID NO: 31522 - DNA, 15 bp, Homo sapiens
ttcatgttgttgtag

SEQ ID NO: 31523 - DNA, 15 bp, Homo sapiens
tttcatgttgttgta

SEQ ID NO: 31524 - DNA, 15 bp, Homo sapiens
gtttcatgttgttgt

SEQ ID NO: 31525 - DNA, 15 bp, Homo sapiens
tgtttcatgttgttg

SEQ ID NO: 31526 - DNA, 15 bp, Homo sapiens
ctgtttcatgttgtt

SEQ ID NO: 31527 - DNA, 15 bp, Homo sapiens
actgtttcatgttgt

SEQ ID NO: 31528 - DNA, 15 bp, Homo sapiens
aactgtttcatgttg

SEQ ID NO: 31529 - DNA, 15 bp, Homo sapiens
gaactgtttcatgtt

SEQ ID NO: 31530 - DNA, 15 bp, Homo sapiens
tgaactgtttcatgt

SEQ ID NO: 31531 - DNA, 15 bp, Homo sapiens
atgaactgtttcatg

SEQ ID NO: 31532 - DNA, 15 bp, Homo sapiens
gatgaactgtttcat

SEQ ID NO: 31533 - DNA, 15 bp, Homo sapiens
ggatgaactgtttca

SEQ ID NO: 31534 - DNA, 15 bp, Homo sapiens
cggatgaactgtttc

SEQ ID NO: 31535 - DNA, 15 bp, Homo sapiens
gcggatgaactgttt

SEQ ID NO: 31536 - DNA, 15 bp, Homo sapiens
agcggatgaactgtt

SEQ ID NO: 31537 - DNA, 15 bp, Homo sapiens
tagcggatgaactgt

SEQ ID NO: 31538 - DNA, 15 bp, Homo sapiens
gtagcggatgaactg

SEQ ID NO: 31539 - DNA, 15 bp, Homo sapiens
ggtagcggatgaact

SEQ ID NO: 31540 - DNA, 15 bp, Homo sapiens
aggtagcggatgaac

SEQ ID NO: 31541 - DNA, 15 bp, Homo sapiens
gaggtagcggatgaa

SEQ ID NO: 31542 - DNA, 15 bp, Homo sapiens
tgaggtagcggatga

SEQ ID NO: 31543 - DNA, 15 bp, Homo sapiens
atgaggtagcggatg

SEQ ID NO: 31544 - DNA, 15 bp, Homo sapiens
gatgaggtagcggat

SEQ ID NO: 31545 - DNA, 15 bp, Homo sapiens
agatgaggtagcgga

SEQ ID NO: 31546 - DNA, 15 bp, Homo sapiens
gagatgaggtagcgg

SEQ ID NO: 31547 - DNA, 15 bp, Homo sapiens
cgagatgaggtagcg

SEQ ID NO: 31548 - DNA, 15 bp, Homo sapiens
acgagatgaggtagc

SEQ ID NO: 31549 - DNA, 15 bp, Homo sapiens
gacgagatgaggtag

SEQ ID NO: 31550 - DNA, 15 bp, Homo sapiens
ggacgagatgaggta

SEQ ID NO: 31551 - DNA, 15 bp, Homo sapiens
tggacgagatgaggt

SEQ ID NO: 31552 - DNA, 15 bp, Homo sapiens
ttggacgagatgagg

SEQ ID NO: 31553 - DNA, 15 bp, Homo sapiens
gttggacgagatgag

SEQ ID NO: 31554 - DNA, 15 bp, Homo sapiens
cgttggacgagatga

SEQ ID NO: 31555 - DNA, 15 bp, Homo sapiens
acgttggacgagatg

SEQ ID NO: 31556 - DNA, 15 bp, Homo sapiens
gacgttggacgagat

SEQ ID NO: 31557 - DNA, 15 bp, Homo sapiens
cgacgttggacgaga

SEQ ID NO: 31558 - DNA, 15 bp, Homo sapiens
ccgacgttggacgag

SEQ ID NO: 31559 - DNA, 15 bp, Homo sapiens
cccgacgttggacga

SEQ ID NO: 31560 - DNA, 15 bp, Homo sapiens
ccccgacgttggacg

SEQ ID NO: 31561 - DNA, 15 bp, Homo sapiens
tccccgacgttggac

SEQ ID NO: 31562 - DNA, 15 bp, Homo sapiens
ttccccgacgttgga

SEQ ID NO: 31563 - DNA, 15 bp, Homo sapiens
cttccccgacgttgg

SEQ ID NO: 31564 - DNA, 15 bp, Homo sapiens
acttccccgacgttg

SEQ ID NO: 31565 - DNA, 15 bp, Homo sapiens
aacttccccgacgtt

SEQ ID NO: 31566 - DNA, 15 bp, Homo sapiens
caacttccccgacgt

SEQ ID NO: 31567 - DNA, 15 bp, Homo sapiens
acaacttccccgacg

SEQ ID NO: 31568 - DNA, 15 bp, Homo sapiens
gacaacttccccgac

SEQ ID NO: 31569 - DNA, 15 bp, Homo sapiens
agacaacttccccga

SEQ ID NO: 31570 - DNA, 15 bp, Homo sapiens
cagacaacttccccg

SEQ ID NO: 31571 - DNA, 15 bp, Homo sapiens
ccagacaacttcccc

SEQ ID NO: 31572 - DNA, 15 bp, Homo sapiens
accagacaacttccc

SEQ ID NO: 31573 - DNA, 15 bp, Homo sapiens
taccagacaacttcc

SEQ ID NO: 31574 - DNA, 15 bp, Homo sapiens
ctaccagacaacttc

SEQ ID NO: 31575 - DNA, 15 bp, Homo sapiens
cctaccagacaactt

SEQ ID NO: 31576 - DNA, 15 bp, Homo sapiens
acctaccagacaact

SEQ ID NO: 31577 - DNA, 15 bp, Homo sapiens
gacctaccagacaac

SEQ ID NO: 31578 - DNA, 15 bp, Homo sapiens
agacctaccagacaa

SEQ ID NO: 31579 - DNA, 15 bp, Homo sapiens
gagacctaccagaca

SEQ ID NO: 31580 - DNA, 15 bp, Homo sapiens
agagacctaccagac

SEQ ID NO: 31581 - DNA, 15 bp, Homo sapiens
cagagacctaccaga

SEQ ID NO: 31582 - DNA, 15 bp, Homo sapiens
acagagacctaccag

SEQ ID NO: 31583 - DNA, 15 bp, Homo sapiens
cacagagacctacca

SEQ ID NO: 31584 - DNA, 15 bp, Homo sapiens
tcacagagacctacc

SEQ ID NO: 31585 - DNA, 15 bp, Homo sapiens
gtcacagagacctac

SEQ ID NO: 31586 - DNA, 15 bp, Homo sapiens
tgtcacagagaccta

SEQ ID NO: 31587 - DNA, 15 bp, Homo sapiens
ctgtcacagagacct

SEQ ID NO: 31588 - DNA, 15 bp, Homo sapiens
gctgtcacagagacc

SEQ ID NO: 31589 - DNA, 15 bp, Homo sapiens
tgctgtcacagagac

SEQ ID NO: 31590 - DNA, 15 bp, Homo sapiens
atgctgtcacagaga

SEQ ID NO: 31591 - DNA, 15 bp, Homo sapiens
gatgctgtcacagag

SEQ ID NO: 31592 - DNA, 15 bp, Homo sapiens
tgatgctgtcacaga

SEQ ID NO: 31593 - DNA, 15 bp, Homo sapiens
gtgatgctgtcacag

SEQ ID NO: 31594 - DNA, 15 bp, Homo sapiens
agtgatgctgtcaca

SEQ ID NO: 31595 - DNA, 15 bp, Homo sapiens
aagtgatgctgtcac

SEQ ID NO: 31596 - DNA, 15 bp, Homo sapiens
taagtgatgctgtca

SEQ ID NO: 31597 - DNA, 15 bp, Homo sapiens
gtaagtgatgctgtc

SEQ ID NO: 31598 - DNA, 15 bp, Homo sapiens
agtaagtgatgctgt

SEQ ID NO: 31599 - DNA, 15 bp, Homo sapiens
cagtaagtgatgctg

SEQ ID NO: 31600 - DNA, 15 bp, Homo sapiens
acagtaagtgatgct

SEQ ID NO: 31601 - DNA, 15 bp, Homo sapiens
tacagtaagtgatgc

SEQ ID NO: 31602 - DNA, 15 bp, Homo sapiens
gtacagtaagtgatg

SEQ ID NO: 31603 - DNA, 15 bp, Homo sapiens
cgtacagtaagtgat

SEQ ID NO: 31604 - DNA, 15 bp, Homo sapiens
gcgtacagtaagtga

SEQ ID NO: 31605 - DNA, 15 bp, Homo sapiens
ggcgtacagtaagtg

SEQ ID NO: 31606 - DNA, 15 bp, Homo sapiens
aggcgtacagtaagt

SEQ ID NO: 31607 - DNA, 15 bp, Homo sapiens
aaggcgtacagtaag

SEQ ID NO: 31608 - DNA, 15 bp, Homo sapiens
aaaggcgtacagtaa

SEQ ID NO: 31609 - DNA, 15 bp, Homo sapiens
taaaggcgtacagta

SEQ ID NO: 31610 - DNA, 15 bp, Homo sapiens
ataaaggcgtacagt

SEQ ID NO: 31611 - DNA, 15 bp, Homo sapiens
gataaaggcgtacag

SEQ ID NO: 31612 - DNA, 15 bp, Homo sapiens
agataaaggcgtaca

SEQ ID NO: 31613 - DNA, 15 bp, Homo sapiens
tagataaaggcgtac

SEQ ID NO: 31614 - DNA, 15 bp, Homo sapiens
ttagataaaggcgta

SEQ ID NO: 31615 - DNA, 15 bp, Homo sapiens
tttagataaaggcgt

SEQ ID NO: 31616 - DNA, 15 bp, Homo sapiens
atttagataaaggcg

SEQ ID NO: 31617 - DNA, 15 bp, Homo sapiens
catttagataaaggc

SEQ ID NO: 31618 - DNA, 15 bp, Homo sapiens
ccatttagataaagg

SEQ ID NO: 31619 - DNA, 15 bp, Homo sapiens
cccatttagataaag

SEQ ID NO: 31620 - DNA, 15 bp, Homo sapiens
acccatttagataaa

SEQ ID NO: 31621 - DNA, 15 bp, Homo sapiens
gacccatttagataa

SEQ ID NO: 31622 - DNA, 15 bp, Homo sapiens
tgacccatttagata

SEQ ID NO: 31623 - DNA, 15 bp, Homo sapiens
atgacccatttagat

SEQ ID NO: 31624 - DNA, 15 bp, Homo sapiens
catgacccatttaga

SEQ ID NO: 31625 - DNA, 15 bp, Homo sapiens
ccatgacccatttag

SEQ ID NO: 31626 - DNA, 15 bp, Homo sapiens
tccatgacccattta

SEQ ID NO: 31627 - DNA, 15 bp, Homo sapiens
ctccatgacccattt

SEQ ID NO: 31628 - DNA, 15 bp, Homo sapiens
gctccatgacccatt

SEQ ID NO: 31629 - DNA, 15 bp, Homo sapiens
ggctccatgacccat

SEQ ID NO: 31630 - DNA, 15 bp, Homo sapiens
gggctccatgaccca

SEQ ID NO: 31631 - DNA, 15 bp, Homo sapiens
tgggctccatgaccc

SEQ ID NO: 31632 - DNA, 15 bp, Homo sapiens
ctgggctccatgacc

SEQ ID NO: 31633 - DNA, 15 bp, Homo sapiens
actgggctccatgac

SEQ ID NO: 31634 - DNA, 15 bp, Homo sapiens
aactgggctccatga

SEQ ID NO: 31635 - DNA, 15 bp, Homo sapiens
gaactgggctccatg

SEQ ID NO: 31636 - DNA, 15 bp, Homo sapiens
agaactgggctccat

SEQ ID NO: 31637 - DNA, 15 bp, Homo sapiens
gagaactgggctcca

SEQ ID NO: 31638 - DNA, 15 bp, Homo sapiens
cgagaactgggctcc

SEQ ID NO: 31639 - DNA, 15 bp, Homo sapiens
gcgagaactgggctc

SEQ ID NO: 31640 - DNA, 15 bp, Homo sapiens
tgcgagaactgggct

SEQ ID NO: 31641 - DNA, 15 bp, Homo sapiens
ctgcgagaactgggc

SEQ ID NO: 31642 - DNA, 15 bp, Homo sapiens
actgcgagaactggg

SEQ ID NO: 31643 - DNA, 15 bp, Homo sapiens
aactgcgagaactgg

SEQ ID NO: 31644 - DNA, 15 bp, Homo sapiens
aaactgcgagaactg

SEQ ID NO: 31645 - DNA, 15 bp, Homo sapiens
caaactgcgagaact

SEQ ID NO: 31646 - DNA, 15 bp, Homo sapiens
gcaaactgcgagaac

SEQ ID NO: 31647 - DNA, 15 bp, Homo sapiens
agcaaactgcgagaa

SEQ ID NO: 31648 - DNA, 15 bp, Homo sapiens
gagcaaactgcgaga

SEQ ID NO: 31649 - DNA, 15 bp, Homo sapiens
agagcaaactgcgag

SEQ ID NO: 31650 - DNA, 15 bp, Homo sapiens
gagagcaaactgcga

SEQ ID NO: 31651 - DNA, 15 bp, Homo sapiens
ggagagcaaactgcg

SEQ ID NO: 31652 - DNA, 15 bp, Homo sapiens
tggagagcaaactgc

SEQ ID NO: 31653 - DNA, 15 bp, Homo sapiens
ctggagagcaaactg

SEQ ID NO: 31654 - DNA, 15 bp, Homo sapiens
tctggagagcaaact

SEQ ID NO: 31655 - DNA, 15 bp, Homo sapiens
atctggagagcaaac

SEQ ID NO: 31656 - DNA, 15 bp, Homo sapiens
aatctggagagcaaa

SEQ ID NO: 31657 - DNA, 15 bp, Homo sapiens
caatctggagagcaa

SEQ ID NO: 31658 - DNA, 15 bp, Homo sapiens
gcaatctggagagca

SEQ ID NO: 31659 - DNA, 15 bp, Homo sapiens
tgcaatctggagagc

SEQ ID NO: 31660 - DNA, 15 bp, Homo sapiens
ctgcaatctggagag

SEQ ID NO: 31661 - DNA, 15 bp, Homo sapiens
gctgcaatctggaga

SEQ ID NO: 31662 - DNA, 15 bp, Homo sapiens
tgctgcaatctggag

SEQ ID NO: 31663 - DNA, 15 bp, Homo sapiens
ctgctgcaatctgga

SEQ ID NO: 31664 - DNA, 15 bp, Homo sapiens
gctgctgcaatctgg

SEQ ID NO: 31665 - DNA, 15 bp, Homo sapiens
agctgctgcaatctg

SEQ ID NO: 31666 - DNA, 15 bp, Homo sapiens
aagctgctgcaatct

SEQ ID NO: 31667 - DNA, 15 bp, Homo sapiens
aaagctgctgcaatc

SEQ ID NO: 31668 - DNA, 15 bp, Homo sapiens
caaagctgctgcaat

SEQ ID NO: 31669 - DNA, 15 bp, Homo sapiens
ccaaagctgctgcaa

SEQ ID NO: 31670 - DNA, 15 bp, Homo sapiens
accaaagctgctgca

SEQ ID NO: 31671 - DNA, 15 bp, Homo sapiens
gaccaaagctgctgc

SEQ ID NO: 31672 - DNA, 15 bp, Homo sapiens
agaccaaagctgctg

SEQ ID NO: 31673 - DNA, 15 bp, Homo sapiens
aagaccaaagctgct

SEQ ID NO: 31674 - DNA, 15 bp, Homo sapiens
aaagaccaaagctgc

SEQ ID NO: 31675 - DNA, 15 bp, Homo sapiens
caaagaccaaagctg

SEQ ID NO: 31676 - DNA, 15 bp, Homo sapiens
acaaagaccaaagct

SEQ ID NO: 31677 - DNA, 15 bp, Homo sapiens
cacaaagaccaaagc

SEQ ID NO: 31678 - DNA, 15 bp, Homo sapiens
gcacaaagaccaaag

SEQ ID NO: 31679 - DNA, 15 bp, Homo sapiens
ggcacaaagaccaaa

SEQ ID NO: 31680 - DNA, 15 bp, Homo sapiens
aggcacaaagaccaa

SEQ ID NO: 31681 - DNA, 15 bp, Homo sapiens
caggcacaaagacca

SEQ ID NO: 31682 - DNA, 15 bp, Homo sapiens
tcaggcacaaagacc

SEQ ID NO: 31683 - DNA, 15 bp, Homo sapiens
ctcaggcacaaagac

SEQ ID NO: 31684 - DNA, 15 bp, Homo sapiens
actcaggcacaaaga

SEQ ID NO: 31685 - DNA, 15 bp, Homo sapiens
aactcaggcacaaag

SEQ ID NO: 31686 - DNA, 15 bp, Homo sapiens
caactcaggcacaaa

SEQ ID NO: 31687 - DNA, 15 bp, Homo sapiens
ccaactcaggcacaa

SEQ ID NO: 31688 - DNA, 15 bp, Homo sapiens
tccaactcaggcaca

SEQ ID NO: 31689 - DNA, 15 bp, Homo sapiens
ttccaactcaggcac

SEQ ID NO: 31690 - DNA, 15 bp, Homo sapiens
cttccaactcaggca

SEQ ID NO: 31691 - DNA, 15 bp, Homo sapiens
tcttccaactcaggc

SEQ ID NO: 31692 - DNA, 15 bp, Homo sapiens
ctcttccaactcagg

SEQ ID NO: 31693 - DNA, 15 bp, Homo sapiens
cctcttccaactcag

SEQ ID NO: 31694 - DNA, 15 bp, Homo sapiens
ccctcttccaactca

SEQ ID NO: 31695 - DNA, 15 bp, Homo sapiens
cccctcttccaactc

SEQ ID NO: 31696 - DNA, 15 bp, Homo sapiens
tcccctcttccaact

SEQ ID NO: 31697 - DNA, 15 bp, Homo sapiens
ctcccctcttccaac

SEQ ID NO: 31698 - DNA, 15 bp, Homo sapiens
actcccctcttccaa

SEQ ID NO: 31699 - DNA, 15 bp, Homo sapiens
cactcccctcttcca

SEQ ID NO: 31700 - DNA, 15 bp, Homo sapiens
ccactcccctcttcc

SEQ ID NO: 31701 - DNA, 15 bp, Homo sapiens
cccactcccctcttc

SEQ ID NO: 31702 - DNA, 15 bp, Homo sapiens
gcccactcccctctt

SEQ ID NO: 31703 - DNA, 15 bp, Homo sapiens
tgcccactcccctct

SEQ ID NO: 31704 - DNA, 15 bp, Homo sapiens
ttgcccactcccctc

SEQ ID NO: 31705 - DNA, 15 bp, Homo sapiens
cttgcccactcccct

SEQ ID NO: 31706 - DNA, 15 bp, Homo sapiens
tcttgcccactcccc

SEQ ID NO: 31707 - DNA, 15 bp, Homo sapiens
gtcttgcccactccc

SEQ ID NO: 31708 - DNA, 15 bp, Homo sapiens
tgtcttgcccactcc

SEQ ID NO: 31709 - DNA, 15 bp, Homo sapiens
ctgtcttgcccactc

SEQ ID NO: 31710 - DNA, 15 bp, Homo sapiens
tctgtcttgcccact

SEQ ID NO: 31711 - DNA, 15 bp, Homo sapiens
ttctgtcttgcccac

SEQ ID NO: 31712 - DNA, 15 bp, Homo sapiens
tttctgtcttgccca

SEQ ID NO: 31713 - DNA, 15 bp, Homo sapiens
atttctgtcttgccc

SEQ ID NO: 31714 - DNA, 15 bp, Homo sapiens
catttctgtcttgcc

SEQ ID NO: 31715 - DNA, 15 bp, Homo sapiens
gcatttctgtcttgc

SEQ ID NO: 31716 - DNA, 15 bp, Homo sapiens
ggcatttctgtcttg

SEQ ID NO: 31717 - DNA, 15 bp, Homo sapiens
aggcatttctgtctt

SEQ ID NO: 31718 - DNA, 15 bp, Homo sapiens
aaggcatttctgtct

SEQ ID NO: 31719 - DNA, 15 bp, Homo sapiens
taaggcatttctgtc

SEQ ID NO: 31720 - DNA, 15 bp, Homo sapiens
ataaggcatttctgt

SEQ ID NO: 31721 - DNA, 15 bp, Homo sapiens
cataaggcatttctg

SEQ ID NO: 31722 - DNA, 15 bp, Homo sapiens
ccataaggcatttct

SEQ ID NO: 31723 - DNA, 15 bp, Homo sapiens
tccataaggcatttc

SEQ ID NO: 31724 - DNA, 15 bp, Homo sapiens
ttccataaggcattt

SEQ ID NO: 31725 - DNA, 15 bp, Homo sapiens
cttccataaggcatt

SEQ ID NO: 31726 - DNA, 15 bp, Homo sapiens
gcttccataaggcat

SEQ ID NO: 31727 - DNA, 15 bp, Homo sapiens
tgcttccataaggca

SEQ ID NO: 31728 - DNA, 15 bp, Homo sapiens
ctgcttccataaggc

SEQ ID NO: 31729 - DNA, 15 bp, Homo sapiens
actgcttccataagg

SEQ ID NO: 31730 - DNA, 15 bp, Homo sapiens
cactgcttccataag

SEQ ID NO: 31731 - DNA, 15 bp, Homo sapiens
ccactgcttccataa

SEQ ID NO: 31732 - DNA, 15 bp, Homo sapiens
accactgcttccata

SEQ ID NO: 31733 - DNA, 15 bp, Homo sapiens
caccactgcttccat

SEQ ID NO: 31734 - DNA, 15 bp, Homo sapiens
gcaccactgcttcca

SEQ ID NO: 31735 - DNA, 15 bp, Homo sapiens
agcaccactgcttcc

SEQ ID NO: 31736 - DNA, 15 bp, Homo sapiens
aagcaccactgcttc

SEQ ID NO: 31737 - DNA, 15 bp, Homo sapiens
aaagcaccactgctt

SEQ ID NO: 31738 - DNA, 15 bp, Homo sapiens
caaagcaccactgct

SEQ ID NO: 31739 - DNA, 15 bp, Homo sapiens
ccaaagcaccactgc

SEQ ID NO: 31740 - DNA, 15 bp, Homo sapiens
gccaaagcaccactg

SEQ ID NO: 31741 - DNA, 15 bp, Homo sapiens
ggccaaagcaccact

SEQ ID NO: 31742 - DNA, 15 bp, Homo sapiens
gggccaaagcaccac

SEQ ID NO: 31743 - DNA, 15 bp, Homo sapiens
agggccaaagcacca

SEQ ID NO: 31744 - DNA, 15 bp, Homo sapiens
gagggccaaagcacc

SEQ ID NO: 31745 - DNA, 15 bp, Homo sapiens
cgagggccaaagcac

SEQ ID NO: 31746 - DNA, 15 bp, Homo sapiens
ccgagggccaaagca

SEQ ID NO: 31747 - DNA, 15 bp, Homo sapiens
cccgagggccaaagc

SEQ ID NO: 31748 - DNA, 15 bp, Homo sapiens
tcccgagggccaaag

SEQ ID NO: 31749 - DNA, 15 bp, Homo sapiens
ctcccgagggccaaa

SEQ ID NO: 31750 - DNA, 15 bp, Homo sapiens
cctcccgagggccaa

SEQ ID NO: 31751 - DNA, 15 bp, Homo sapiens
ccctcccgagggcca

SEQ ID NO: 31752 - DNA, 15 bp, Homo sapiens
accctcccgagggcc

SEQ ID NO: 31753 - DNA, 15 bp, Homo sapiens
aaccctcccgagggc

SEQ ID NO: 31754 - DNA, 15 bp, Homo sapiens
caaccctcccgaggg

SEQ ID NO: 31755 - DNA, 15 bp, Homo sapiens
acaaccctcccgagg

SEQ ID NO: 31756 - DNA, 15 bp, Homo sapiens
gacaaccctcccgag

SEQ ID NO: 31757 - DNA, 15 bp, Homo sapiens
agacaaccctcccga

SEQ ID NO: 31758 - DNA, 15 bp, Homo sapiens
cagacaaccctcccg

SEQ ID NO: 31759 - DNA, 15 bp, Homo sapiens
gcagacaaccctccc

SEQ ID NO: 31760 - DNA, 15 bp, Homo sapiens
tgcagacaaccctcc

SEQ ID NO: 31761 - DNA, 15 bp, Homo sapiens
ctgcagacaaccctc

SEQ ID NO: 31762 - DNA, 15 bp, Homo sapiens
gctgcagacaaccct

SEQ ID NO: 31763 - DNA, 15 bp, Homo sapiens
agctgcagacaaccc

SEQ ID NO: 31764 - DNA, 15 bp, Homo sapiens
cagctgcagacaacc

SEQ ID NO: 31765 - DNA, 15 bp, Homo sapiens
gcagctgcagacaac

SEQ ID NO: 31766 - DNA, 15 bp, Homo sapiens
ggcagctgcagacaa

SEQ ID NO: 31767 - DNA, 15 bp, Homo sapiens
gggcagctgcagaca

SEQ ID NO: 31768 - DNA, 15 bp, Homo sapiens
ggggcagctgcagac

SEQ ID NO: 31769 - DNA, 15 bp, Homo sapiens
tggggcagctgcaga

SEQ ID NO: 31770 - DNA, 15 bp, Homo sapiens
ttggggcagctgcag

SEQ ID NO: 31771 - DNA, 15 bp, Homo sapiens
attggggcagctgca

SEQ ID NO: 31772 - DNA, 15 bp, Homo sapiens
cattggggcagctgc

SEQ ID NO: 31773 - DNA, 15 bp, Homo sapiens
acattggggcagctg

SEQ ID NO: 31774 - DNA, 15 bp, Homo sapiens
cacattggggcagct

SEQ ID NO: 31775 - DNA, 15 bp, Homo sapiens
gcacattggggcagc

SEQ ID NO: 31776 - DNA, 15 bp, Homo sapiens
tgcacattggggcag

SEQ ID NO: 31777 - DNA, 15 bp, Homo sapiens
ttgcacattggggca

SEQ ID NO: 31778 - DNA, 15 bp, Homo sapiens
tttgcacattggggc

SEQ ID NO: 31779 - DNA, 15 bp, Homo sapiens
ctttgcacattgggg

SEQ ID NO: 31780 - DNA, 15 bp, Homo sapiens
tctttgcacattggg

SEQ ID NO: 31781 - DNA, 15 bp, Homo sapiens
ttctttgcacattgg

SEQ ID NO: 31782 - DNA, 15 bp, Homo sapiens
attctttgcacattg

SEQ ID NO: 31783 - DNA, 15 bp, Homo sapiens
gattctttgcacatt

SEQ ID NO: 31784 - DNA, 15 bp, Homo sapiens
ggattctttgcacat

SEQ ID NO: 31785 - DNA, 15 bp, Homo sapiens
aggattctttgcaca

SEQ ID NO: 31786 - DNA, 15 bp, Homo sapiens
gaggattctttgcac

SEQ ID NO: 31787 - DNA, 15 bp, Homo sapiens
agaggattctttgca

SEQ ID NO: 31788 - DNA, 15 bp, Homo sapiens
aagaggattctttgc

SEQ ID NO: 31789 - DNA, 15 bp, Homo sapiens
aaagaggattctttg

SEQ ID NO: 31790 - DNA, 15 bp, Homo sapiens
taaagaggattcttt

SEQ ID NO: 31791 - DNA, 15 bp, Homo sapiens
ttaaagaggattctt

SEQ ID NO: 31792 - DNA, 15 bp, Homo sapiens
gttaaagaggattct

SEQ ID NO: 31793 - DNA, 15 bp, Homo sapiens
cgttaaagaggattc

SEQ ID NO: 31794 - DNA, 15 bp, Homo sapiens
acgttaaagaggatt

SEQ ID NO: 31795 - DNA, 15 bp, Homo sapiens
cacgttaaagaggat

SEQ ID NO: 31796 - DNA, 15 bp, Homo sapiens
tcacgttaaagagga

SEQ ID NO: 31797 - DNA, 15 bp, Homo sapiens
ctcacgttaaagagg

SEQ ID NO: 31798 - DNA, 15 bp, Homo sapiens
tctcacgttaaagag

SEQ ID NO: 31799 - DNA, 15 bp, Homo sapiens
gtctcacgttaaaga

SEQ ID NO: 31800 - DNA, 15 bp, Homo sapiens
agtctcacgttaaag

SEQ ID NO: 31801 - DNA, 15 bp, Homo sapiens
cagtctcacgttaaa

SEQ ID NO: 31802 - DNA, 15 bp, Homo sapiens
tcagtctcacgttaa

SEQ ID NO: 31803 - DNA, 15 bp, Homo sapiens
ctcagtctcacgtta

SEQ ID NO: 31804 - DNA, 15 bp, Homo sapiens
gctcagtctcacgtt

SEQ ID NO: 31805 - DNA, 15 bp, Homo sapiens
agctcagtctcacgt

SEQ ID NO: 31806 - DNA, 15 bp, Homo sapiens
tagctcagtctcacg

SEQ ID NO: 31807 - DNA, 15 bp, Homo sapiens
ttagctcagtctcac

SEQ ID NO: 31808 - DNA, 15 bp, Homo sapiens
gttagctcagtctca

SEQ ID NO: 31809 - DNA, 15 bp, Homo sapiens
tgttagctcagtctc

SEQ ID NO: 31810 - DNA, 15 bp, Homo sapiens
atgttagctcagtct

SEQ ID NO: 31811 - DNA, 15 bp, Homo sapiens
aatgttagctcagtc

SEQ ID NO: 31812 - DNA, 15 bp, Homo sapiens
taatgttagctcagt

SEQ ID NO: 31813 - DNA, 15 bp, Homo sapiens
ttaatgttagctcag

SEQ ID NO: 31814 - DNA, 15 bp, Homo sapiens
gttaatgttagctca

SEQ ID NO: 31815 - DNA, 15 bp, Homo sapiens
ggttaatgttagctc

SEQ ID NO: 31816 - DNA, 15 bp, Homo sapiens
tggttaatgttagct

SEQ ID NO: 31817 - DNA, 15 bp, Homo sapiens
ctggttaatgttagc

SEQ ID NO: 31818 - DNA, 15 bp, Homo sapiens
cctggttaatgttag

SEQ ID NO: 31819 - DNA, 15 bp, Homo sapiens
acctggttaatgtta

SEQ ID NO: 31820 - DNA, 15 bp, Homo sapiens
tacctggttaatgtt

SEQ ID NO: 31821 - DNA, 15 bp, Homo sapiens
ctacctggttaatgt

SEQ ID NO: 31822 - DNA, 15 bp, Homo sapiens
actacctggttaatg

SEQ ID NO: 31823 - DNA, 15 bp, Homo sapiens
gactacctggttaat

SEQ ID NO: 31824 - DNA, 15 bp, Homo sapiens
tgactacctggttaa

SEQ ID NO: 31825 - DNA, 15 bp, Homo sapiens
gtgactacctggtta

SEQ ID NO: 31826 - DNA, 15 bp, Homo sapiens
tgtgactacctggtt

SEQ ID NO: 31827 - DNA, 15 bp, Homo sapiens
atgtgactacctggt

SEQ ID NO: 31828 - DNA, 15 bp, Homo sapiens
catgtgactacctgg

SEQ ID NO: 31829 - DNA, 15 bp, Homo sapiens
tcatgtgactacctg

SEQ ID NO: 31830 - DNA, 15 bp, Homo sapiens
ttcatgtgactacct

SEQ ID NO: 31831 - DNA, 15 bp, Homo sapiens
tttcatgtgactacc

SEQ ID NO: 31832 - DNA, 15 bp, Homo sapiens
atttcatgtgactac

SEQ ID NO: 31833 - DNA, 15 bp, Homo sapiens
aatttcatgtgacta

SEQ ID NO: 31834 - DNA, 15 bp, Homo sapiens
gaatttcatgtgact

SEQ ID NO: 31835 - DNA, 15 bp, Homo sapiens
agaatttcatgtgac

SEQ ID NO: 31836 - DNA, 15 bp, Homo sapiens
aagaatttcatgtga

SEQ ID NO: 31837 - DNA, 15 bp, Homo sapiens
caagaatttcatgtg

SEQ ID NO: 31838 - DNA, 15 bp, Homo sapiens
gcaagaatttcatgt

SEQ ID NO: 31839 - DNA, 15 bp, Homo sapiens
ggcaagaatttcatg

SEQ ID NO: 31840 - DNA, 15 bp, Homo sapiens
gggcaagaatttcat

SEQ ID NO: 31841 - DNA, 15 bp, Homo sapiens
agggcaagaatttca

SEQ ID NO: 31842 - DNA, 15 bp, Homo sapiens
gagggcaagaatttc

SEQ ID NO: 31843 - DNA, 15 bp, Homo sapiens
ggagggcaagaattt

SEQ ID NO: 31844 - DNA, 15 bp, Homo sapiens
tggagggcaagaatt

SEQ ID NO: 31845 - DNA, 15 bp, Homo sapiens
ttggagggcaagaat

SEQ ID NO: 31846 - DNA, 15 bp, Homo sapiens
tttggagggcaagaa

SEQ ID NO: 31847 - DNA, 15 bp, Homo sapiens
ttttggagggcaaga

SEQ ID NO: 31848 - DNA, 15 bp, Homo sapiens
cttttggagggcaag

SEQ ID NO: 31849 - DNA, 15 bp, Homo sapiens
acttttggagggcaa

SEQ ID NO: 31850 - DNA, 15 bp, Homo sapiens
aacttttggagggca

SEQ ID NO: 31851 - DNA, 15 bp, Homo sapiens
caacttttggagggc

SEQ ID NO: 31852 - DNA, 15 bp, Homo sapiens
ccaacttttggaggg

SEQ ID NO: 31853 - DNA, 15 bp, Homo sapiens
gccaacttttggagg

SEQ ID NO: 31854 - DNA, 15 bp, Homo sapiens
agccaacttttggag

SEQ ID NO: 31855 - DNA, 15 bp, Homo sapiens
aagccaacttttgga

SEQ ID NO: 31856 - DNA, 15 bp, Homo sapiens
aaagccaacttttgg

SEQ ID NO: 31857 - DNA, 15 bp, Homo sapiens
taaagccaacttttg

SEQ ID NO: 31858 - DNA, 15 bp, Homo sapiens
ataaagccaactttt

SEQ ID NO: 31859 - DNA, 15 bp, Homo sapiens
gataaagccaacttt

SEQ ID NO: 31860 - DNA, 15 bp, Homo sapiens
agataaagccaactt

SEQ ID NO: 31861 - DNA, 15 bp, Homo sapiens
gagataaagccaact

SEQ ID NO: 31862 - DNA, 15 bp, Homo sapiens
tgagataaagccaac

SEQ ID NO: 31863 - DNA, 15 bp, Homo sapiens
ctgagataaagccaa

SEQ ID NO: 31864 - DNA, 15 bp, Homo sapiens
actgagataaagcca

SEQ ID NO: 31865 - DNA, 15 bp, Homo sapiens
gactgagataaagcc

SEQ ID NO: 31866 - DNA, 15 bp, Homo sapiens
tgactgagataaagc

SEQ ID NO: 31867 - DNA, 15 bp, Homo sapiens
ctgactgagataaag

SEQ ID NO: 31868 - DNA, 15 bp, Homo sapiens
gctgactgagataaa

SEQ ID NO: 31869 - DNA, 15 bp, Homo sapiens
agctgactgagataa

SEQ ID NO: 31870 - DNA, 15 bp, Homo sapiens
aagctgactgagata

SEQ ID NO: 31871 - DNA, 15 bp, Homo sapiens
taagctgactgagat

SEQ ID NO: 31872 - DNA, 15 bp, Homo sapiens
ttaagctgactgaga

SEQ ID NO: 31873 - DNA, 15 bp, Homo sapiens
attaagctgactgag

SEQ ID NO: 31874 - DNA, 15 bp, Homo sapiens
tattaagctgactga

SEQ ID NO: 31875 - DNA, 15 bp, Homo sapiens
ttattaagctgactg

SEQ ID NO: 31876 - DNA, 15 bp, Homo sapiens
attattaagctgact

SEQ ID NO: 31877 - DNA, 15 bp, Homo sapiens
aattattaagctgac

SEQ ID NO: 31878 - DNA, 15 bp, Homo sapiens
aaattattaagctga

SEQ ID NO: 31879 - DNA, 15 bp, Homo sapiens
aaaattattaagctg

SEQ ID NO: 31880 - DNA, 15 bp, Homo sapiens
aaaaattattaagct

SEQ ID NO: 31881 - DNA, 15 bp, Homo sapiens
aaaaaattattaagc

SEQ ID NO: 31882 - DNA, 15 bp, Homo sapiens
aaaaaaattattaag

SEQ ID NO: 31883 - DNA, 15 bp, Homo sapiens
taaaaaaattattaa

SEQ ID NO: 31884 - DNA, 15 bp, Homo sapiens
ataaaaaaattatta

SEQ ID NO: 31885 - DNA, 15 bp, Homo sapiens
aataaaaaaattatt

SEQ ID NO: 31886 - DNA, 15 bp, Homo sapiens
aaataaaaaaattat

SEQ ID NO: 31887 - DNA, 15 bp, Homo sapiens
aaaataaaaaaatta

SEQ ID NO: 31888 - DNA, 15 bp, Homo sapiens
aaaaataaaaaaatt

SEQ ID NO: 31889 - DNA, 15 bp, Homo sapiens
taaaaataaaaaaat

SEQ ID NO: 31890 - DNA, 15 bp, Homo sapiens
ataaaaataaaaaaa

SEQ ID NO: 31891 - DNA, 15 bp, Homo sapiens
aataaaaataaaaaa

SEQ ID NO: 31892 - DNA, 15 bp, Homo sapiens
aaataaaaataaaaa

SEQ ID NO: 31893 - DNA, 15 bp, Homo sapiens
taaataaaaataaaa

SEQ ID NO: 31894 - DNA, 15 bp, Homo sapiens
ataaataaaaataaa

SEQ ID NO: 31895 - DNA, 15 bp, Homo sapiens
aataaataaaaataa

SEQ ID NO: 31896 - DNA, 15 bp, Homo sapiens
aaataaataaaaata

SEQ ID NO: 31897 - DNA, 15 bp, Homo sapiens
aaaataaataaaaat

SEQ ID NO: 31898 - DNA, 15 bp, Homo sapiens
aaaaataaataaaaa

SEQ ID NO: 31899 - DNA, 15 bp, Homo sapiens
aaaaaataaataaaa

SEQ ID NO: 31900 - DNA, 15 bp, Homo sapiens
aaaaaaataaataaa

SEQ ID NO: 31901 - DNA, 15 bp, Homo sapiens
caaaaaaataaataa

SEQ ID NO: 31902 - DNA, 15 bp, Homo sapiens
tcaaaaaaataaata

SEQ ID NO: 31903 - DNA, 15 bp, Homo sapiens
ctcaaaaaaataaat

SEQ ID NO: 31904 - DNA, 15 bp, Homo sapiens
tctcaaaaaaataaa

SEQ ID NO: 31905 - DNA, 15 bp, Homo sapiens
gtctcaaaaaaataa

SEQ ID NO: 31906 - DNA, 15 bp, Homo sapiens
tgtctcaaaaaaata

SEQ ID NO: 31907 - DNA, 15 bp, Homo sapiens
ctgtctcaaaaaaat

SEQ ID NO: 31908 - DNA, 15 bp, Homo sapiens
actgtctcaaaaaaa

SEQ ID NO: 31909 - DNA, 15 bp, Homo sapiens
gactgtctcaaaaaa

SEQ ID NO: 31910 - DNA, 15 bp, Homo sapiens
agactgtctcaaaaa

SEQ ID NO: 31911 - DNA, 15 bp, Homo sapiens
gagactgtctcaaaa

SEQ ID NO: 31912 - DNA, 15 bp, Homo sapiens
cgagactgtctcaaa

SEQ ID NO: 31913 - DNA, 15 bp, Homo sapiens
gcgagactgtctcaa

SEQ ID NO: 31914 - DNA, 15 bp, Homo sapiens
agcgagactgtctca

SEQ ID NO: 31915 - DNA, 15 bp, Homo sapiens
cagcgagactgtctc

SEQ ID NO: 31916 - DNA, 15 bp, Homo sapiens
acagcgagactgtct

SEQ ID NO: 31917 - DNA, 15 bp, Homo sapiens
gacagcgagactgtc

SEQ ID NO: 31918 - DNA, 15 bp, Homo sapiens
cgacagcgagactgt

SEQ ID NO: 31919 - DNA, 15 bp, Homo sapiens
gcgacagcgagactg

SEQ ID NO: 31920 - DNA, 15 bp, Homo sapiens
ggcgacagcgagact

SEQ ID NO: 31921 - DNA, 15 bp, Homo sapiens
gggcgacagcgagac

SEQ ID NO: 31922 - DNA, 15 bp, Homo sapiens
tgggcgacagcgaga

SEQ ID NO: 31923 - DNA, 15 bp, Homo sapiens
ctgggcgacagcgag

SEQ ID NO: 31924 - DNA, 15 bp, Homo sapiens
cctgggcgacagcga

SEQ ID NO: 31925 - DNA, 15 bp, Homo sapiens
gcctgggcgacagcg

SEQ ID NO: 31926 - DNA, 15 bp, Homo sapiens
agcctgggcgacagc

SEQ ID NO: 31927 - DNA, 15 bp, Homo sapiens
aagcctgggcgacag

SEQ ID NO: 31928 - DNA, 15 bp, Homo sapiens
gaagcctgggcgaca

SEQ ID NO: 31929 - DNA, 15 bp, Homo sapiens
cgaagcctgggcgac

SEQ ID NO: 31930 - DNA, 15 bp, Homo sapiens
ccgaagcctgggcga

SEQ ID NO: 31931 - DNA, 15 bp, Homo sapiens
cccgaagcctgggcg

SEQ ID NO: 31932 - DNA, 15 bp, Homo sapiens
gcccgaagcctgggc

SEQ ID NO: 31933 - DNA, 15 bp, Homo sapiens
tgcccgaagcctggg

SEQ ID NO: 31934 - DNA, 15 bp, Homo sapiens
ctgcccgaagcctgg

SEQ ID NO: 31935 - DNA, 15 bp, Homo sapiens
actgcccgaagcctg

SEQ ID NO: 31936 - DNA, 15 bp, Homo sapiens
cactgcccgaagcct

SEQ ID NO: 31937 - DNA, 15 bp, Homo sapiens
ccactgcccgaagcc

SEQ ID NO: 31938 - DNA, 15 bp, Homo sapiens
gccactgcccgaagc

SEQ ID NO: 31939 - DNA, 15 bp, Homo sapiens
tgccactgcccgaag

SEQ ID NO: 31940 - DNA, 15 bp, Homo sapiens
gtgccactgcccgaa

SEQ ID NO: 31941 - DNA, 15 bp, Homo sapiens
cgtgccactgcccga

SEQ ID NO: 31942 - DNA, 15 bp, Homo sapiens
tcgtgccactgcccg

SEQ ID NO: 31943 - DNA, 15 bp, Homo sapiens
atcgtgccactgccc

SEQ ID NO: 31944 - DNA, 15 bp, Homo sapiens
gatcgtgccactgcc

SEQ ID NO: 31945 - DNA, 15 bp, Homo sapiens
tgagatcgtgccact

SEQ ID NO: 31946 - DNA, 15 bp, Homo sapiens
ctgagatcgtgccac

SEQ ID NO: 31947 - DNA, 15 bp, Homo sapiens
gctgagatcgtgcca

SEQ ID NO: 31948 - DNA, 15 bp, Homo sapiens
agctgagatcgtgcc

SEQ ID NO: 31949 - DNA, 15 bp, Homo sapiens
gagctgagatcgtgc

SEQ ID NO: 31950 - DNA, 15 bp, Homo sapiens
tgagctgagatcgtg

SEQ ID NO: 31951 - DNA, 15 bp, Homo sapiens
gtgagctgagatcgt

SEQ ID NO: 31952 - DNA, 15 bp, Homo sapiens
acagtgagctgagat

SEQ ID NO: 31953 - DNA, 15 bp, Homo sapiens
gacagtgagctgaga

SEQ ID NO: 31954 - DNA, 15 bp, Homo sapiens
ggacagtgagctgag

SEQ ID NO: 31955 - DNA, 15 bp, Homo sapiens
gggacagtgagctga

SEQ ID NO: 31956 - DNA, 15 bp, Homo sapiens
ggggacagtgagctg

SEQ ID NO: 31957 - DNA, 15 bp, Homo sapiens
aggggacagtgagct

SEQ ID NO: 31958 - DNA, 15 bp, Homo sapiens
gaggggacagtgagc

SEQ ID NO: 31959 - DNA, 15 bp, Homo sapiens
ggaggggacagtgag

SEQ ID NO: 31960 - DNA, 15 bp, Homo sapiens
tggaggggacagtga

SEQ ID NO: 31961 - DNA, 15 bp, Homo sapiens
gtggaggggacagtg

SEQ ID NO: 31962 - DNA, 15 bp, Homo sapiens
ggtggaggggacagt

SEQ ID NO: 31963 - DNA, 15 bp, Homo sapiens
aggtggaggggacag

SEQ ID NO: 31964 - DNA, 15 bp, Homo sapiens
gaggtggaggggaca

SEQ ID NO: 31965 - DNA, 15 bp, Homo sapiens
ggaggtggaggggac

SEQ ID NO: 31966 - DNA, 15 bp, Homo sapiens
aggaggtggagggga

SEQ ID NO: 31967 - DNA, 15 bp, Homo sapiens
caggaggtggagggg

SEQ ID NO: 31968 - DNA, 15 bp, Homo sapiens
ccaggaggtggaggg

SEQ ID NO: 31969 - DNA, 15 bp, Homo sapiens
aggcttgaacccagg

SEQ ID NO: 31970 - DNA, 15 bp, Homo sapiens
gaggcttgaacccag

SEQ ID NO: 31971 - DNA, 15 bp, Homo sapiens
ggaggcttgaaccca

SEQ ID NO: 31972 - DNA, 15 bp, Homo sapiens
gggaggcttgaaccc

SEQ ID NO: 31973 - DNA, 15 bp, Homo sapiens
cgggaggcttgaacc

SEQ ID NO: 31974 - DNA, 15 bp, Homo sapiens
tcgggaggcttgaac

SEQ ID NO: 31975 - DNA, 15 bp, Homo sapiens
ttcgggaggcttgaa

SEQ ID NO: 31976 - DNA, 15 bp, Homo sapiens
gttcgggaggcttga

SEQ ID NO: 31977 - DNA, 15 bp, Homo sapiens
tgttcgggaggcttg

SEQ ID NO: 31978 - DNA, 15 bp, Homo sapiens
ctgttcgggaggctt

SEQ ID NO: 31979 - DNA, 15 bp, Homo sapiens
gctgttcgggaggct

SEQ ID NO: 31980 - DNA, 15 bp, Homo sapiens
agctgttcgggaggc

SEQ ID NO: 31981 - DNA, 15 bp, Homo sapiens
cagctgttcgggagg

SEQ ID NO: 31982 - DNA, 15 bp, Homo sapiens
ccagctgttcgggag

SEQ ID NO: 31983 - DNA, 15 bp, Homo sapiens
cccagctgttcggga

SEQ ID NO: 31984 - DNA, 15 bp, Homo sapiens
tcccagctgttcggg

SEQ ID NO: 31985 - DNA, 15 bp, Homo sapiens
atcccagctgttcgg

SEQ ID NO: 31986 - DNA, 15 bp, Homo sapiens
aatcccagctgttcg

SEQ ID NO: 31987 - DNA, 15 bp, Homo sapiens
taatcccagctgttc

SEQ ID NO: 31988 - DNA, 15 bp, Homo sapiens
gtaatcccagctgtt

SEQ ID NO: 31989 - DNA, 15 bp, Homo sapiens
tgtaatcccagctgt

SEQ ID NO: 31990 - DNA, 15 bp, Homo sapiens
ctgtaatcccagctg

SEQ ID NO: 31991 - DNA, 15 bp, Homo sapiens
gtggcgcatgcctgt

SEQ ID NO: 31992 - DNA, 15 bp, Homo sapiens
ggtggcgcatgcctg

SEQ ID NO: 31993 - DNA, 15 bp, Homo sapiens
tggtggcgcatgcct

SEQ ID NO: 31994 - DNA, 15 bp, Homo sapiens
gtggtggcgcatgcc

SEQ ID NO: 31995 - DNA, 15 bp, Homo sapiens
agtggtggcgcatgc

SEQ ID NO: 31996 - DNA, 15 bp, Homo sapiens
gagtggtggcgcatg

SEQ ID NO: 31997 - DNA, 15 bp, Homo sapiens
ggagtggtggcgcat

SEQ ID NO: 31998 - DNA, 15 bp, Homo sapiens
gggagtggtggcgca

SEQ ID NO: 31999 - DNA, 15 bp, Homo sapiens
agggagtggtggcgc

SEQ ID NO: 32000 - DNA, 15 bp, Homo sapiens
cagggagtggtggcg

SEQ ID NO: 32001 - DNA, 15 bp, Homo sapiens
gcagggagtggtggc

SEQ ID NO: 32002 - DNA, 15 bp, Homo sapiens
ggcagggagtggtgg

SEQ ID NO: 32003 - DNA, 15 bp, Homo sapiens
tggcagggagtggtg

SEQ ID NO: 32004 - DNA, 15 bp, Homo sapiens
atggcagggagtggt

SEQ ID NO: 32005 - DNA, 15 bp, Homo sapiens
aatggcagggagtgg

SEQ ID NO: 32006 - DNA, 15 bp, Homo sapiens
aaatggcagggagtg

SEQ ID NO: 32007 - DNA, 15 bp, Homo sapiens
aaaatggcagggagt

SEQ ID NO: 32008 - DNA, 15 bp, Homo sapiens
aaaaatggcagggag

SEQ ID NO: 32009 - DNA, 15 bp, Homo sapiens
aaaaaatggcaggga

SEQ ID NO: 32010 - DNA, 15 bp, Homo sapiens
aaaaaaatggcaggg

SEQ ID NO: 32011 - DNA, 15 bp, Homo sapiens
caaaaaaatggcagg

SEQ ID NO: 32012 - DNA, 15 bp, Homo sapiens
acaaaaaaatggcag

SEQ ID NO: 32013 - DNA, 15 bp, Homo sapiens
cacaaaaaaatggca

SEQ ID NO: 32014 - DNA, 15 bp, Homo sapiens
acacaaaaaaatggc

SEQ ID NO: 32015 - DNA, 15 bp, Homo sapiens
aacacaaaaaaatgg

SEQ ID NO: 32016 - DNA, 15 bp, Homo sapiens
aaacacaaaaaaatg

SEQ ID NO: 32017 - DNA, 15 bp, Homo sapiens
aaaacacaaaaaaat

SEQ ID NO: 32018 - DNA, 15 bp, Homo sapiens
taaaacacaaaaaaa

SEQ ID NO: 32019 - DNA, 15 bp, Homo sapiens
ctaaaacacaaaaaa

SEQ ID NO: 32020 - DNA, 15 bp, Homo sapiens
actaaaacacaaaaa

SEQ ID NO: 32021 - DNA, 15 bp, Homo sapiens
tactaaaacacaaaa

SEQ ID NO: 32022 - DNA, 15 bp, Homo sapiens
ctactaaaacacaaa

SEQ ID NO: 32023 - DNA, 15 bp, Homo sapiens
tctactaaaacacaa

SEQ ID NO: 32024 - DNA, 15 bp, Homo sapiens
ttctactaaaacaca

SEQ ID NO: 32025 - DNA, 15 bp, Homo sapiens
tttctactaaaacac

SEQ ID NO: 32026 - DNA, 15 bp, Homo sapiens
atttctactaaaaca

SEQ ID NO: 32027 - DNA, 15 bp, Homo sapiens
catttctactaaaac

SEQ ID NO: 32028 - DNA, 15 bp, Homo sapiens
tcatttctactaaaa

SEQ ID NO: 32029 - DNA, 15 bp, Homo sapiens
ctcatttctactaaa

SEQ ID NO: 32030 - DNA, 15 bp, Homo sapiens
cctcatttctactaa

SEQ ID NO: 32031 - DNA, 15 bp, Homo sapiens
acctcatttctacta

SEQ ID NO: 32032 - DNA, 15 bp, Homo sapiens
aacctcatttctact

SEQ ID NO: 32033 - DNA, 15 bp, Homo sapiens
aaacctcatttctac

SEQ ID NO: 32034 - DNA, 15 bp, Homo sapiens
gaaacctcatttcta

SEQ ID NO: 32035 - DNA, 15 bp, Homo sapiens
tgaaacctcatttct

SEQ ID NO: 32036 - DNA, 15 bp, Homo sapiens
gtgaaacctcatttc

SEQ ID NO: 32037 - DNA, 15 bp, Homo sapiens
ggtgaaacctcattt

SEQ ID NO: 32038 - DNA, 15 bp, Homo sapiens
tggtgaaacctcatt

SEQ ID NO: 32039 - DNA, 15 bp, Homo sapiens
atggtgaaacctcat

SEQ ID NO: 32040 - DNA, 15 bp, Homo sapiens
catggtgaaacctca

SEQ ID NO: 32041 - DNA, 15 bp, Homo sapiens
acatggtgaaacctc

SEQ ID NO: 32042 - DNA, 15 bp, Homo sapiens
aacatggtgaaacct

SEQ ID NO: 32043 - DNA, 15 bp, Homo sapiens
gcaacatggtgaaac

SEQ ID NO: 32044 - DNA, 15 bp, Homo sapiens
ggcaacatggtgaaa

SEQ ID NO: 32045 - DNA, 15 bp, Homo sapiens
gggcaacatggtgaa

SEQ ID NO: 32046 - DNA, 15 bp, Homo sapiens
aagagaccagcctgg

SEQ ID NO: 32047 - DNA, 15 bp, Homo sapiens
taagagaccagcctg

SEQ ID NO: 32048 - DNA, 15 bp, Homo sapiens
ttaagagaccagcct

SEQ ID NO: 32049 - DNA, 15 bp, Homo sapiens
gttaagagaccagcc

SEQ ID NO: 32050 - DNA, 15 bp, Homo sapiens
agttaagagaccagc

SEQ ID NO: 32051 - DNA, 15 bp, Homo sapiens
cagttaagagaccag

SEQ ID NO: 32052 - DNA, 15 bp, Homo sapiens
gcagttaagagacca

SEQ ID NO: 32053 - DNA, 15 bp, Homo sapiens
agcagttaagagacc

SEQ ID NO: 32054 - DNA, 15 bp, Homo sapiens
cagcagttaagagac

SEQ ID NO: 32055 - DNA, 15 bp, Homo sapiens
tcagcagttaagaga

SEQ ID NO: 32056 - DNA, 15 bp, Homo sapiens
ctcagcagttaagag

SEQ ID NO: 32057 - DNA, 15 bp, Homo sapiens
gctcagcagttaaga

SEQ ID NO: 32058 - DNA, 15 bp, Homo sapiens
agctcagcagttaag

SEQ ID NO: 32059 - DNA, 15 bp, Homo sapiens
gagctcagcagttaa

SEQ ID NO: 32060 - DNA, 15 bp, Homo sapiens
tgagctcagcagtta

SEQ ID NO: 32061 - DNA, 15 bp, Homo sapiens
ctgagctcagcagtt

SEQ ID NO: 32062 - DNA, 15 bp, Homo sapiens
gctgagctcagcagt

SEQ ID NO: 32063 - DNA, 15 bp, Homo sapiens
ggctgagctcagcag

SEQ ID NO: 32064 - DNA, 15 bp, Homo sapiens
tggctgagctcagca

SEQ ID NO: 32065 - DNA, 15 bp, Homo sapiens
ctggctgagctcagc

SEQ ID NO: 32066 - DNA, 15 bp, Homo sapiens
actggctgagctcag

SEQ ID NO: 32067 - DNA, 15 bp, Homo sapiens
gactggctgagctca

SEQ ID NO: 32068 - DNA, 15 bp, Homo sapiens
agactggctgagctc

SEQ ID NO: 32069 - DNA, 15 bp, Homo sapiens
cagactggctgagct

SEQ ID NO: 32070 - DNA, 15 bp, Homo sapiens
gcagactggctgagc

SEQ ID NO: 32071 - DNA, 15 bp, Homo sapiens
ggcagactggctgag

SEQ ID NO: 32072 - DNA, 15 bp, Homo sapiens
gggcagactggctga

SEQ ID NO: 32073 - DNA, 15 bp, Homo sapiens
tgggcagactggctg

SEQ ID NO: 32074 - DNA, 15 bp, Homo sapiens
gtgggcagactggct

SEQ ID NO: 32075 - DNA, 15 bp, Homo sapiens
ggtgggcagactggc

SEQ ID NO: 32076 - DNA, 15 bp, Homo sapiens
aggtgggcagactgg

SEQ ID NO: 32077 - DNA, 15 bp, Homo sapiens
aaggtgggcagactg

SEQ ID NO: 32078 - DNA, 15 bp, Homo sapiens
caaggtgggcagact

SEQ ID NO: 32079 - DNA, 15 bp, Homo sapiens
ccaaggtgggcagac

SEQ ID NO: 32080 - DNA, 15 bp, Homo sapiens
gccaaggtgggcaga

SEQ ID NO: 32081 - DNA, 15 bp, Homo sapiens
agccaaggtgggcag

SEQ ID NO: 32082 - DNA, 15 bp, Homo sapiens
aagccaaggtgggca

SEQ ID NO: 32083 - DNA, 15 bp, Homo sapiens
gaagccaaggtgggc

SEQ ID NO: 32084 - DNA, 15 bp, Homo sapiens
ggaagccaaggtggg

SEQ ID NO: 32085 - DNA, 15 bp, Homo sapiens
gggaagccaaggtgg

SEQ ID NO: 32086 - DNA, 15 bp, Homo sapiens
tgggaagccaaggtg

SEQ ID NO: 32087 - DNA, 15 bp, Homo sapiens
ttgggaagccaaggt

SEQ ID NO: 32088 - DNA, 15 bp, Homo sapiens
tttgggaagccaagg

SEQ ID NO: 32089 - DNA, 15 bp, Homo sapiens
ctttgggaagccaag

SEQ ID NO: 32090 - DNA, 15 bp, Homo sapiens
actttgggaagccaa

SEQ ID NO: 32091 - DNA, 15 bp, Homo sapiens
cactttgggaagcca

SEQ ID NO: 32092 - DNA, 15 bp, Homo sapiens
gcactttgggaagcc

SEQ ID NO: 32093 - DNA, 15 bp, Homo sapiens
gcggtggcttatgcc

SEQ ID NO: 32094 - DNA, 15 bp, Homo sapiens
tgcggtggcttatgc

SEQ ID NO: 32095 - DNA, 15 bp, Homo sapiens
gtgcggtggcttatg

SEQ ID NO: 32096 - DNA, 15 bp, Homo sapiens
ggtgcggtggcttat

SEQ ID NO: 32097 - DNA, 15 bp, Homo sapiens
aggtgcggtggctta

SEQ ID NO: 32098 - DNA, 15 bp, Homo sapiens
caggtgcggtggctt

SEQ ID NO: 32099 - DNA, 15 bp, Homo sapiens
ccaggtgcggtggct

SEQ ID NO: 32100 - DNA, 15 bp, Homo sapiens
gccaggtgcggtggc

SEQ ID NO: 32101 - DNA, 15 bp, Homo sapiens
ggccaggtgcggtgg

SEQ ID NO: 32102 - DNA, 15 bp, Homo sapiens
aggccaggtgcggtg

SEQ ID NO: 32103 - DNA, 15 bp, Homo sapiens
gaggccaggtgcggt

SEQ ID NO: 32104 - DNA, 15 bp, Homo sapiens
tgaggccaggtgcgg

SEQ ID NO: 32105 - DNA, 15 bp, Homo sapiens
ctgaggccaggtgcg

SEQ ID NO: 32106 - DNA, 15 bp, Homo sapiens
actgaggccaggtgc

SEQ ID NO: 32107 - DNA, 15 bp, Homo sapiens
gactgaggccaggtg

SEQ ID NO: 32108 - DNA, 15 bp, Homo sapiens
tgactgaggccaggt

SEQ ID NO: 32109 - DNA, 15 bp, Homo sapiens
atgactgaggccagg

SEQ ID NO: 32110 - DNA, 15 bp, Homo sapiens
gatgactgaggccag

SEQ ID NO: 32111 - DNA, 15 bp, Homo sapiens
agatgactgaggcca

SEQ ID NO: 32112 - DNA, 15 bp, Homo sapiens
cagatgactgaggcc

SEQ ID NO: 32113 - DNA, 15 bp, Homo sapiens
tcagatgactgaggc

SEQ ID NO: 32114 - DNA, 15 bp, Homo sapiens
ttcagatgactgagg

SEQ ID NO: 32115 - DNA, 15 bp, Homo sapiens
attcagatgactgag

SEQ ID NO: 32116 - DNA, 15 bp, Homo sapiens
aattcagatgactga

SEQ ID NO: 32117 - DNA, 15 bp, Homo sapiens
aaattcagatgactg

SEQ ID NO: 32118 - DNA, 15 bp, Homo sapiens
taaattcagatgact

SEQ ID NO: 32119 - DNA, 15 bp, Homo sapiens
ttaaattcagatgac

SEQ ID NO: 32120 - DNA, 15 bp, Homo sapiens
cttaaattcagatga

SEQ ID NO: 32121 - DNA, 15 bp, Homo sapiens
acttaaattcagatg

SEQ ID NO: 32122 - DNA, 15 bp, Homo sapiens
tacttaaattcagat

SEQ ID NO: 32123 - DNA, 15 bp, Homo sapiens
ttacttaaattcaga

SEQ ID NO: 32124 - DNA, 15 bp, Homo sapiens
attacttaaattcag

SEQ ID NO: 32125 - DNA, 15 bp, Homo sapiens
tattacttaaattca

SEQ ID NO: 32126 - DNA, 15 bp, Homo sapiens
ttattacttaaattc

SEQ ID NO: 32127 - DNA, 15 bp, Homo sapiens
tttattacttaaatt

SEQ ID NO: 32128 - DNA, 15 bp, Homo sapiens
gtttattacttaaat

SEQ ID NO: 32129 - DNA, 15 bp, Homo sapiens
agtttattacttaaa

SEQ ID NO: 32130 - DNA, 15 bp, Homo sapiens
tagtttattacttaa

SEQ ID NO: 32131 - DNA, 15 bp, Homo sapiens
ttagtttattactta

SEQ ID NO: 32132 - DNA, 15 bp, Homo sapiens
cttagtttattactt

SEQ ID NO: 32133 - DNA, 15 bp, Homo sapiens
acttagtttattact

SEQ ID NO: 32134 - DNA, 15 bp, Homo sapiens
tacttagtttattac

SEQ ID NO: 32135 - DNA, 15 bp, Homo sapiens
ttacttagtttatta

SEQ ID NO: 32136 - DNA, 15 bp, Homo sapiens
tttacttagtttatt

SEQ ID NO: 32137 - DNA, 15 bp, Homo sapiens
ttttacttagtttat

SEQ ID NO: 32138 - DNA, 15 bp, Homo sapiens
attttacttagttta

SEQ ID NO: 32139 - DNA, 15 bp, Homo sapiens
aattttacttagttt

SEQ ID NO: 32140 - DNA, 15 bp, Homo sapiens
caattttacttagtt

SEQ ID NO: 32141 - DNA, 15 bp, Homo sapiens
tcaattttacttagt

SEQ ID NO: 32142 - DNA, 15 bp, Homo sapiens
ctcaattttacttag

SEQ ID NO: 32143 - DNA, 15 bp, Homo sapiens
gctcaattttactta

SEQ ID NO: 32144 - DNA, 15 bp, Homo sapiens
agctcaattttactt

SEQ ID NO: 32145 - DNA, 15 bp, Homo sapiens
aagctcaattttact

SEQ ID NO: 32146 - DNA, 15 bp, Homo sapiens
aaagctcaattttac

SEQ ID NO: 32147 - DNA, 15 bp, Homo sapiens
taaagctcaatttta

SEQ ID NO: 32148 - DNA, 15 bp, Homo sapiens
ttaaagctcaatttt

SEQ ID NO: 32149 - DNA, 15 bp, Homo sapiens
attaaagctcaattt

SEQ ID NO: 32150 - DNA, 15 bp, Homo sapiens
aattaaagctcaatt

SEQ ID NO: 32151 - DNA, 15 bp, Homo sapiens
gaattaaagctcaat

SEQ ID NO: 32152 - DNA, 15 bp, Homo sapiens
tgaattaaagctcaa

SEQ ID NO: 32153 - DNA, 15 bp, Homo sapiens
ttgaattaaagctca

SEQ ID NO: 32154 - DNA, 15 bp, Homo sapiens
tttgaattaaagctc

SEQ ID NO: 32155 - DNA, 15 bp, Homo sapiens
ttttgaattaaagct

SEQ ID NO: 32156 - DNA, 15 bp, Homo sapiens
attttgaattaaagc

SEQ ID NO: 32157 - DNA, 15 bp, Homo sapiens
aattttgaattaaag

SEQ ID NO: 32158 - DNA, 15 bp, Homo sapiens
caattttgaattaaa

SEQ ID NO: 32159 - DNA, 15 bp, Homo sapiens
ccaattttgaattaa

SEQ ID NO: 32160 - DNA, 15 bp, Homo sapiens
cccaattttgaatta

SEQ ID NO: 32161 - DNA, 15 bp, Homo sapiens
acccaattttgaatt

SEQ ID NO: 32162 - DNA, 15 bp, Homo sapiens
tacccaattttgaat

SEQ ID NO: 32163 - DNA, 15 bp, Homo sapiens
atacccaattttgaa

SEQ ID NO: 32164 - DNA, 15 bp, Homo sapiens
tatacccaattttga

SEQ ID NO: 32165 - DNA, 15 bp, Homo sapiens
ttatacccaattttg

SEQ ID NO: 32166 - DNA, 15 bp, Homo sapiens
cttatacccaatttt

SEQ ID NO: 32167 - DNA, 15 bp, Homo sapiens
acttatacccaattt

SEQ ID NO: 32168 - DNA, 15 bp, Homo sapiens
tacttatacccaatt

SEQ ID NO: 32169 - DNA, 15 bp, Homo sapiens
atacttatacccaat

SEQ ID NO: 32170 - DNA, 15 bp, Homo sapiens
aatacttatacccaa

SEQ ID NO: 32171 - DNA, 15 bp, Homo sapiens
aaatacttataccca

SEQ ID NO: 32172 - DNA, 15 bp, Homo sapiens
aaaatacttataccc

SEQ ID NO: 32173 - DNA, 15 bp, Homo sapiens
taaaatacttatacc

SEQ ID NO: 32174 - DNA, 15 bp, Homo sapiens
gtaaaatacttatac

SEQ ID NO: 32175 - DNA, 15 bp, Homo sapiens
tgtaaaatacttata

SEQ ID NO: 32176 - DNA, 15 bp, Homo sapiens
ctgtaaaatacttat

SEQ ID NO: 32177 - DNA, 15 bp, Homo sapiens
tctgtaaaatactta

SEQ ID NO: 32178 - DNA, 15 bp, Homo sapiens
atctgtaaaatactt

SEQ ID NO: 32179 - DNA, 15 bp, Homo sapiens
aatctgtaaaatact

SEQ ID NO: 32180 - DNA, 15 bp, Homo sapiens
taatctgtaaaatac

SEQ ID NO: 32181 - DNA, 15 bp, Homo sapiens
gtaatctgtaaaata

SEQ ID NO: 32182 - DNA, 15 bp, Homo sapiens
ggtaatctgtaaaat

SEQ ID NO: 32183 - DNA, 15 bp, Homo sapiens
aggtaatctgtaaaa

SEQ ID NO: 32184 - DNA, 15 bp, Homo sapiens
caggtaatctgtaaa

SEQ ID NO: 32185 - DNA, 15 bp, Homo sapiens
tcaggtaatctgtaa

SEQ ID NO: 32186 - DNA, 15 bp, Homo sapiens
ttcaggtaatctgta

SEQ ID NO: 32187 - DNA, 15 bp, Homo sapiens
cttcaggtaatctgt

SEQ ID NO: 32188 - DNA, 15 bp, Homo sapiens
acttcaggtaatctg

SEQ ID NO: 32189 - DNA, 15 bp, Homo sapiens
aacttcaggtaatct

SEQ ID NO: 32190 - DNA, 15 bp, Homo sapiens
caacttcaggtaatc

SEQ ID NO: 32191 - DNA, 15 bp, Homo sapiens
acaacttcaggtaat

SEQ ID NO: 32192 - DNA, 15 bp, Homo sapiens
aacaacttcaggtaa

SEQ ID NO: 32193 - DNA, 15 bp, Homo sapiens
caacaacttcaggta

SEQ ID NO: 32194 - DNA, 15 bp, Homo sapiens
acaacaacttcaggt

SEQ ID NO: 32195 - DNA, 15 bp, Homo sapiens
gacaacaacttcagg

SEQ ID NO: 32196 - DNA, 15 bp, Homo sapiens
tgacaacaacttcag

SEQ ID NO: 32197 - DNA, 15 bp, Homo sapiens
atgacaacaacttca

SEQ ID NO: 32198 - DNA, 15 bp, Homo sapiens
aatgacaacaacttc

SEQ ID NO: 32199 - DNA, 15 bp, Homo sapiens
aaatgacaacaactt

SEQ ID NO: 32200 - DNA, 15 bp, Homo sapiens
taaatgacaacaact

SEQ ID NO: 32201 - DNA, 15 bp, Homo sapiens
ataaatgacaacaac

SEQ ID NO: 32202 - DNA, 15 bp, Homo sapiens
aataaatgacaacaa

SEQ ID NO: 32203 - DNA, 15 bp, Homo sapiens
aaataaatgacaaca

SEQ ID NO: 32204 - DNA, 15 bp, Homo sapiens
aaaataaatgacaac

SEQ ID NO: 32205 - DNA, 15 bp, Homo sapiens
aaaaataaatgacaa

SEQ ID NO: 32206 - DNA, 15 bp, Homo sapiens
gaaaaataaatgaca

SEQ ID NO: 32207 - DNA, 15 bp, Homo sapiens
agaaaaataaatgac

SEQ ID NO: 32208 - DNA, 15 bp, Homo sapiens
cagaaaaataaatga

SEQ ID NO: 32209 - DNA, 15 bp, Homo sapiens
ccagaaaaataaatg

SEQ ID NO: 32210 - DNA, 15 bp, Homo sapiens
tccagaaaaataaat

SEQ ID NO: 32211 - DNA, 15 bp, Homo sapiens
ctccagaaaaataaa

SEQ ID NO: 32212 - DNA, 15 bp, Homo sapiens
cctccagaaaaataa

SEQ ID NO: 32213 - DNA, 15 bp, Homo sapiens
tcctccagaaaaata

SEQ ID NO: 32214 - DNA, 15 bp, Homo sapiens
ctcctccagaaaaat

SEQ ID NO: 32215 - DNA, 15 bp, Homo sapiens
cctcctccagaaaaa

SEQ ID NO: 32216 - DNA, 15 bp, Homo sapiens
ccctcctccagaaaa

SEQ ID NO: 32217 - DNA, 15 bp, Homo sapiens
gccctcctccagaaa

SEQ ID NO: 32218 - DNA, 15 bp, Homo sapiens
cgccctcctccagaa

SEQ ID NO: 32219 - DNA, 15 bp, Homo sapiens
ccgccctcctccaga

SEQ ID NO: 32220 - DNA, 15 bp, Homo sapiens
cccgccctcctccag

SEQ ID NO: 32221 - DNA, 15 bp, Homo sapiens
acccgccctcctcca

SEQ ID NO: 32222 - DNA, 15 bp, Homo sapiens
aacccgccctcctcc

SEQ ID NO: 32223 - DNA, 15 bp, Homo sapiens
caacccgccctcctc

SEQ ID NO: 32224 - DNA, 15 bp, Homo sapiens
tcaacccgccctcct

SEQ ID NO: 32225 - DNA, 15 bp, Homo sapiens
atcaacccgccctcc

SEQ ID NO: 32226 - DNA, 15 bp, Homo sapiens
catcaacccgccctc

SEQ ID NO: 32227 - DNA, 15 bp, Homo sapiens
tcatcaacccgccct

SEQ ID NO: 32228 - DNA, 15 bp, Homo sapiens
atcatcaacccgccc

SEQ ID NO: 32229 - DNA, 15 bp, Homo sapiens
catcatcaacccgcc

SEQ ID NO: 32230 - DNA, 15 bp, Homo sapiens
gcatcatcaacccgc

SEQ ID NO: 32231 - DNA, 15 bp, Homo sapiens
agcatcatcaacccg

SEQ ID NO: 32232 - DNA, 15 bp, Homo sapiens
gagcatcatcaaccc

SEQ ID NO: 32233 - DNA, 15 bp, Homo sapiens
agagcatcatcaacc

SEQ ID NO: 32234 - DNA, 15 bp, Homo sapiens
aagagcatcatcaac

SEQ ID NO: 32235 - DNA, 15 bp, Homo sapiens
aaagagcatcatcaa

SEQ ID NO: 32236 - DNA, 15 bp, Homo sapiens
taaagagcatcatca

SEQ ID NO: 32237 - DNA, 15 bp, Homo sapiens
ttaaagagcatcatc

SEQ ID NO: 32238 - DNA, 15 bp, Homo sapiens
tttaaagagcatcat

SEQ ID NO: 32239 - DNA, 15 bp, Homo sapiens
atttaaagagcatca

SEQ ID NO: 32240 - DNA, 15 bp, Homo sapiens
tatttaaagagcatc

SEQ ID NO: 32241 - DNA, 15 bp, Homo sapiens
ctatttaaagagcat

SEQ ID NO: 32242 - DNA, 15 bp, Homo sapiens
actatttaaagagca

SEQ ID NO: 32243 - DNA, 15 bp, Homo sapiens
cactatttaaagagc

SEQ ID NO: 32244 - DNA, 15 bp, Homo sapiens
ccactatttaaagag

SEQ ID NO: 32245 - DNA, 15 bp, Homo sapiens
gccactatttaaaga

SEQ ID NO: 32246 - DNA, 15 bp, Homo sapiens
ggccactatttaaag

SEQ ID NO: 32247 - DNA, 15 bp, Homo sapiens
tggccactatttaaa

SEQ ID NO: 32248 - DNA, 15 bp, Homo sapiens
ctggccactatttaa

SEQ ID NO: 32249 - DNA, 15 bp, Homo sapiens
tctggccactattta

SEQ ID NO: 32250 - DNA, 15 bp, Homo sapiens
ttctggccactattt

SEQ ID NO: 32251 - DNA, 15 bp, Homo sapiens
cttctggccactatt

SEQ ID NO: 32252 - DNA, 15 bp, Homo sapiens
acttctggccactat

SEQ ID NO: 32253 - DNA, 15 bp, Homo sapiens
gacttctggccacta

SEQ ID NO: 32254 - DNA, 15 bp, Homo sapiens
tgacttctggccact

SEQ ID NO: 32255 - DNA, 15 bp, Homo sapiens
atgacttctggccac

SEQ ID NO: 32256 - DNA, 15 bp, Homo sapiens
aatgacttctggcca

SEQ ID NO: 32257 - DNA, 15 bp, Homo sapiens
aaatgacttctggcc

SEQ ID NO: 32258 - DNA, 15 bp, Homo sapiens
caaatgacttctggc

SEQ ID NO: 32259 - DNA, 15 bp, Homo sapiens
ccaaatgacttctgg

SEQ ID NO: 32260 - DNA, 15 bp, Homo sapiens
cccaaatgacttctg

SEQ ID NO: 32261 - DNA, 15 bp, Homo sapiens
gcccaaatgacttct

SEQ ID NO: 32262 - DNA, 15 bp, Homo sapiens
agcccaaatgacttc

SEQ ID NO: 32263 - DNA, 15 bp, Homo sapiens
gagcccaaatgactt

SEQ ID NO: 32264 - DNA, 15 bp, Homo sapiens
agagcccaaatgact

SEQ ID NO: 32265 - DNA, 15 bp, Homo sapiens
gagagcccaaatgac

SEQ ID NO: 32266 - DNA, 15 bp, Homo sapiens
agagagcccaaatga

SEQ ID NO: 32267 - DNA, 15 bp, Homo sapiens
aagagagcccaaatg

SEQ ID NO: 32268 - DNA, 15 bp, Homo sapiens
aaagagagcccaaat

SEQ ID NO: 32269 - DNA, 15 bp, Homo sapiens
caaagagagcccaaa

SEQ ID NO: 32270 - DNA, 15 bp, Homo sapiens
acaaagagagcccaa

SEQ ID NO: 32271 - DNA, 15 bp, Homo sapiens
gacaaagagagccca

SEQ ID NO: 32272 - DNA, 15 bp, Homo sapiens
agacaaagagagccc

SEQ ID NO: 32273 - DNA, 15 bp, Homo sapiens
aagacaaagagagcc

SEQ ID NO: 32274 - DNA, 15 bp, Homo sapiens
gaagacaaagagagc

SEQ ID NO: 32275 - DNA, 15 bp, Homo sapiens
agaagacaaagagag

SEQ ID NO: 32276 - DNA, 15 bp, Homo sapiens
aagaagacaaagaga

SEQ ID NO: 32277 - DNA, 15 bp, Homo sapiens
aaagaagacaaagag

SEQ ID NO: 32278 - DNA, 15 bp, Homo sapiens
aaaagaagacaaaga

SEQ ID NO: 32279 - DNA, 15 bp, Homo sapiens
gaaaagaagacaaag

SEQ ID NO: 32280 - DNA, 15 bp, Homo sapiens
agaaaagaagacaaa

SEQ ID NO: 32281 - DNA, 15 bp, Homo sapiens
aagaaaagaagacaa

SEQ ID NO: 32282 - DNA, 15 bp, Homo sapiens
caagaaaagaagaca

SEQ ID NO: 32283 - DNA, 15 bp, Homo sapiens
tcaagaaaagaagac

SEQ ID NO: 32284 - DNA, 15 bp, Homo sapiens
atcaagaaaagaaga

SEQ ID NO: 32285 - DNA, 15 bp, Homo sapiens
aatcaagaaaagaag

SEQ ID NO: 32286 - DNA, 15 bp, Homo sapiens
caatcaagaaaagaa

SEQ ID NO: 32287 - DNA, 15 bp, Homo sapiens
ccaatcaagaaaaga

SEQ ID NO: 32288 - DNA, 15 bp, Homo sapiens
tccaatcaagaaaag

SEQ ID NO: 32289 - DNA, 15 bp, Homo sapiens
ttccaatcaagaaaa

SEQ ID NO: 32290 - DNA, 15 bp, Homo sapiens
tttccaatcaagaaa

SEQ ID NO: 32291 - DNA, 15 bp, Homo sapiens
gtttccaatcaagaa

SEQ ID NO: 32292 - DNA, 15 bp, Homo sapiens
tgtttccaatcaaga

SEQ ID NO: 32293 - DNA, 15 bp, Homo sapiens
ctgtttccaatcaag

SEQ ID NO: 32294 - DNA, 15 bp, Homo sapiens
actgtttccaatcaa

SEQ ID NO: 32295 - DNA, 15 bp, Homo sapiens
tactgtttccaatca

SEQ ID NO: 32296 - DNA, 15 bp, Homo sapiens
atactgtttccaatc

SEQ ID NO: 32297 - DNA, 15 bp, Homo sapiens
aatactgtttccaat

SEQ ID NO: 32298 - DNA, 15 bp, Homo sapiens
aaatactgtttccaa

SEQ ID NO: 32299 - DNA, 15 bp, Homo sapiens
aaaatactgtttcca

SEQ ID NO: 32300 - DNA, 15 bp, Homo sapiens
gaaaatactgtttcc

SEQ ID NO: 32301 - DNA, 15 bp, Homo sapiens
ggaaaatactgtttc

SEQ ID NO: 32302 - DNA, 15 bp, Homo sapiens
aggaaaatactgttt

SEQ ID NO: 32303 - DNA, 15 bp, Homo sapiens
caggaaaatactgtt

SEQ ID NO: 32304 - DNA, 15 bp, Homo sapiens
tcaggaaaatactgt

SEQ ID NO: 32305 - DNA, 15 bp, Homo sapiens
gtcaggaaaatactg

SEQ ID NO: 32306 - DNA, 15 bp, Homo sapiens
tgtcaggaaaatact

SEQ ID NO: 32307 - DNA, 15 bp, Homo sapiens
ctgtcaggaaaatac

SEQ ID NO: 32308 - DNA, 15 bp, Homo sapiens
gctgtcaggaaaata

SEQ ID NO: 32309 - DNA, 15 bp, Homo sapiens
tgctgtcaggaaaat

SEQ ID NO: 32310 - DNA, 15 bp, Homo sapiens
ctgctgtcaggaaaa

SEQ ID NO: 32311 - DNA, 15 bp, Homo sapiens
gctgctgtcaggaaa

SEQ ID NO: 32312 - DNA, 15 bp, Homo sapiens
ggctgctgtcaggaa

SEQ ID NO: 32313 - DNA, 15 bp, Homo sapiens
gggctgctgtcagga

SEQ ID NO: 32314 - DNA, 15 bp, Homo sapiens
agggctgctgtcagg

SEQ ID NO: 32315 - DNA, 15 bp, Homo sapiens
aagggctgctgtcag

SEQ ID NO: 32316 - DNA, 15 bp, Homo sapiens
caagggctgctgtca

SEQ ID NO: 32317 - DNA, 15 bp, Homo sapiens
ccaagggctgctgtc

SEQ ID NO: 32318 - DNA, 15 bp, Homo sapiens
tccaagggctgctgt

SEQ ID NO: 32319 - DNA, 15 bp, Homo sapiens
atccaagggctgctg

SEQ ID NO: 32320 - DNA, 15 bp, Homo sapiens
aatccaagggctgct

SEQ ID NO: 32321 - DNA, 15 bp, Homo sapiens
aaatccaagggctgc

SEQ ID NO: 32322 - DNA, 15 bp, Homo sapiens
gaaatccaagggctg

SEQ ID NO: 32323 - DNA, 15 bp, Homo sapiens
ggaaatccaagggct

SEQ ID NO: 32324 - DNA, 15 bp, Homo sapiens
gggaaatccaagggc

SEQ ID NO: 32325 - DNA, 15 bp, Homo sapiens
cgggaaatccaaggg

SEQ ID NO: 32326 - DNA, 15 bp, Homo sapiens
tcgggaaatccaagg

SEQ ID NO: 32327 - DNA, 15 bp, Homo sapiens
ctcgggaaatccaag

SEQ ID NO: 32328 - DNA, 15 bp, Homo sapiens
cctcgggaaatccaa

SEQ ID NO: 32329 - DNA, 15 bp, Homo sapiens
gcctcgggaaatcca

SEQ ID NO: 32330 - DNA, 15 bp, Homo sapiens
agcctcgggaaatcc

SEQ ID NO: 32331 - DNA, 15 bp, Homo sapiens
aagcctcgggaaatc

SEQ ID NO: 32332 - DNA, 15 bp, Homo sapiens
aaagcctcgggaaat

SEQ ID NO: 32333 - DNA, 15 bp, Homo sapiens
caaagcctcgggaaa

SEQ ID NO: 32334 - DNA, 15 bp, Homo sapiens
tcaaagcctcgggaa

SEQ ID NO: 32335 - DNA, 15 bp, Homo sapiens
atcaaagcctcggga

SEQ ID NO: 32336 - DNA, 15 bp, Homo sapiens
aatcaaagcctcggg

SEQ ID NO: 32337 - DNA, 15 bp, Homo sapiens
gaatcaaagcctcgg

SEQ ID NO: 32338 - DNA, 15 bp, Homo sapiens
ggaatcaaagcctcg

SEQ ID NO: 32339 - DNA, 15 bp, Homo sapiens
aggaatcaaagcctc

SEQ ID NO: 32340 - DNA, 15 bp, Homo sapiens
caggaatcaaagcct

SEQ ID NO: 32341 - DNA, 15 bp, Homo sapiens
acaggaatcaaagcc

SEQ ID NO: 32342 - DNA, 15 bp, Homo sapiens
aacaggaatcaaagc

SEQ ID NO: 32343 - DNA, 15 bp, Homo sapiens
gaacaggaatcaaag

SEQ ID NO: 32344 - DNA, 15 bp, Homo sapiens
tgaacaggaatcaaa

SEQ ID NO: 32345 - DNA, 15 bp, Homo sapiens
ctgaacaggaatcaa

SEQ ID NO: 32346 - DNA, 15 bp, Homo sapiens
gctgaacaggaatca

SEQ ID NO: 32347 - DNA, 15 bp, Homo sapiens
agctgaacaggaatc

SEQ ID NO: 32348 - DNA, 15 bp, Homo sapiens
cagctgaacaggaat

SEQ ID NO: 32349 - DNA, 15 bp, Homo sapiens
gcagctgaacaggaa

SEQ ID NO: 32350 - DNA, 15 bp, Homo sapiens
agcagctgaacagga

SEQ ID NO: 32351 - DNA, 15 bp, Homo sapiens
gagcagctgaacagg

SEQ ID NO: 32352 - DNA, 15 bp, Homo sapiens
agagcagctgaacag

SEQ ID NO: 32353 - DNA, 15 bp, Homo sapiens
cagagcagctgaaca

SEQ ID NO: 32354 - DNA, 15 bp, Homo sapiens
ccagagcagctgaac

SEQ ID NO: 32355 - DNA, 15 bp, Homo sapiens
cccagagcagctgaa

SEQ ID NO: 32356 - DNA, 15 bp, Homo sapiens
acccagagcagctga

SEQ ID NO: 32357 - DNA, 15 bp, Homo sapiens
gacccagagcagctg

SEQ ID NO: 32358 - DNA, 15 bp, Homo sapiens
tgacccagagcagct

SEQ ID NO: 32359 - DNA, 15 bp, Homo sapiens
ttgacccagagcagc

SEQ ID NO: 32360 - DNA, 15 bp, Homo sapiens
attgacccagagcag

SEQ ID NO: 32361 - DNA, 15 bp, Homo sapiens
gattgacccagagca

SEQ ID NO: 32362 - DNA, 15 bp, Homo sapiens
agattgacccagagc

SEQ ID NO: 32363 - DNA, 15 bp, Homo sapiens
cagattgacccagag

SEQ ID NO: 32364 - DNA, 15 bp, Homo sapiens
ccagattgacccaga

SEQ ID NO: 32365 - DNA, 15 bp, Homo sapiens
accagattgacccag

SEQ ID NO: 32366 - DNA, 15 bp, Homo sapiens
caccagattgaccca

SEQ ID NO: 32367 - DNA, 15 bp, Homo sapiens
tcaccagattgaccc

SEQ ID NO: 32368 - DNA, 15 bp, Homo sapiens
gtcaccagattgacc

SEQ ID NO: 32369 - DNA, 15 bp, Homo sapiens
tgtcaccagattgac

SEQ ID NO: 32370 - DNA, 15 bp, Homo sapiens
ctgtcaccagattga

SEQ ID NO: 32371 - DNA, 15 bp, Homo sapiens
atctgtcaccagatt

SEQ ID NO: 32372 - DNA, 15 bp, Homo sapiens
catctgtcaccagat

SEQ ID NO: 32373 - DNA, 15 bp, Homo sapiens
ccatctgtcaccaga

SEQ ID NO: 32374 - DNA, 15 bp, Homo sapiens
gccatctgtcaccag

SEQ ID NO: 32375 - DNA, 15 bp, Homo sapiens
ggccatctgtcacca

SEQ ID NO: 32376 - DNA, 15 bp, Homo sapiens
aggccatctgtcacc

SEQ ID NO: 32377 - DNA, 15 bp, Homo sapiens
caggccatctgtcac

SEQ ID NO: 32378 - DNA, 15 bp, Homo sapiens
gcaggccatctgtca

SEQ ID NO: 32379 - DNA, 15 bp, Homo sapiens
ggcaggccatctgtc

SEQ ID NO: 32380 - DNA, 15 bp, Homo sapiens
aggcaggccatctgt

SEQ ID NO: 32381 - DNA, 15 bp, Homo sapiens
caggcaggccatctg

SEQ ID NO: 32382 - DNA, 15 bp, Homo sapiens
gcaggcaggccatct

SEQ ID NO: 32383 - DNA, 15 bp, Homo sapiens
ggcaggcaggccatc

SEQ ID NO: 32384 - DNA, 15 bp, Homo sapiens
tggcaggcaggccat

SEQ ID NO: 32385 - DNA, 15 bp, Homo sapiens
gtggcaggcaggcca

SEQ ID NO: 32386 - DNA, 15 bp, Homo sapiens
agtggcaggcaggcc

SEQ ID NO: 32387 - DNA, 15 bp, Homo sapiens
cagtggcaggcaggc

SEQ ID NO: 32388 - DNA, 15 bp, Homo sapiens
gcagtggcaggcagg

SEQ ID NO: 32389 - DNA, 15 bp, Homo sapiens
tgcagtggcaggcag

SEQ ID NO: 32390 - DNA, 15 bp, Homo sapiens
gtgcagtggcaggca

SEQ ID NO: 32391 - DNA, 15 bp, Homo sapiens
agtgcagtggcaggc

SEQ ID NO: 32392 - DNA, 15 bp, Homo sapiens
cagtgcagtggcagg

SEQ ID NO: 32393 - DNA, 15 bp, Homo sapiens
ccagtgcagtggcag

SEQ ID NO: 32394 - DNA, 15 bp, Homo sapiens
cccagtgcagtggca

SEQ ID NO: 32395 - DNA, 15 bp, Homo sapiens
ccccagtgcagtggc

SEQ ID NO: 32396 - DNA, 15 bp, Homo sapiens
accccagtgcagtgg

SEQ ID NO: 32397 - DNA, 15 bp, Homo sapiens
aaccccagtgcagtg

SEQ ID NO: 32398 - DNA, 15 bp, Homo sapiens
gaaccccagtgcagt

SEQ ID NO: 32399 - DNA, 15 bp, Homo sapiens
tgaaccccagtgcag

SEQ ID NO: 32400 - DNA, 15 bp, Homo sapiens
ttgaaccccagtgca

SEQ ID NO: 32401 - DNA, 15 bp, Homo sapiens
gttgaaccccagtgc

SEQ ID NO: 32402 - DNA, 15 bp, Homo sapiens
ggttgaaccccagtg

SEQ ID NO: 32403 - DNA, 15 bp, Homo sapiens
gggttgaaccccagt

SEQ ID NO: 32404 - DNA, 15 bp, Homo sapiens
agggttgaaccccag

SEQ ID NO: 32405 - DNA, 15 bp, Homo sapiens
gagggttgaacccca

SEQ ID NO: 32406 - DNA, 15 bp, Homo sapiens
ggagggttgaacccc

SEQ ID NO: 32407 - DNA, 15 bp, Homo sapiens
aggagggttgaaccc

SEQ ID NO: 32408 - DNA, 15 bp, Homo sapiens
caggagggttgaacc

SEQ ID NO: 32409 - DNA, 15 bp, Homo sapiens
tcaggagggttgaac

SEQ ID NO: 32410 - DNA, 15 bp, Homo sapiens
atcaggagggttgaa

SEQ ID NO: 32411 - DNA, 15 bp, Homo sapiens
gatcaggagggttga

SEQ ID NO: 32412 - DNA, 15 bp, Homo sapiens
agatcaggagggttg

SEQ ID NO: 32413 - DNA, 15 bp, Homo sapiens
cagatcaggagggtt

SEQ ID NO: 32414 - DNA, 15 bp, Homo sapiens
ccagatcaggagggt

SEQ ID NO: 32415 - DNA, 15 bp, Homo sapiens
tccagatcaggaggg

SEQ ID NO: 32416 - DNA, 15 bp, Homo sapiens
gtccagatcaggagg

SEQ ID NO: 32417 - DNA, 15 bp, Homo sapiens
tgtccagatcaggag

SEQ ID NO: 32418 - DNA, 15 bp, Homo sapiens
atgtccagatcagga

SEQ ID NO: 32419 - DNA, 15 bp, Homo sapiens
gatgtccagatcagg

SEQ ID NO: 32420 - DNA, 15 bp, Homo sapiens
tgatgtccagatcag

SEQ ID NO: 32421 - DNA, 15 bp, Homo sapiens
atgatgtccagatca

SEQ ID NO: 32422 - DNA, 15 bp, Homo sapiens
catgatgtccagatc

SEQ ID NO: 32423 - DNA, 15 bp, Homo sapiens
tcatgatgtccagat

SEQ ID NO: 32424 - DNA, 15 bp, Homo sapiens
ttcatgatgtccaga

SEQ ID NO: 32425 - DNA, 15 bp, Homo sapiens
attcatgatgtccag

SEQ ID NO: 32426 - DNA, 15 bp, Homo sapiens
tattcatgatgtcca

SEQ ID NO: 32427 - DNA, 15 bp, Homo sapiens
ttattcatgatgtcc

SEQ ID NO: 32428 - DNA, 15 bp, Homo sapiens
tttattcatgatgtc

SEQ ID NO: 32429 - DNA, 15 bp, Homo sapiens
gtttattcatgatgt

SEQ ID NO: 32430 - DNA, 15 bp, Homo sapiens
ggtttattcatgatg

SEQ ID NO: 32431 - DNA, 15 bp, Homo sapiens
aggtttattcatgat

SEQ ID NO: 32432 - DNA, 15 bp, Homo sapiens
gaggtttattcatga

SEQ ID NO: 32433 - DNA, 15 bp, Homo sapiens
ggaggtttattcatg

SEQ ID NO: 32434 - DNA, 15 bp, Homo sapiens
gggaggtttattcat

SEQ ID NO: 32435 - DNA, 15 bp, Homo sapiens
ggggaggtttattca

SEQ ID NO: 32436 - DNA, 15 bp, Homo sapiens
cggggaggtttattc

SEQ ID NO: 32437 - DNA, 15 bp, Homo sapiens
ccggggaggtttatt

SEQ ID NO: 32438 - DNA, 15 bp, Homo sapiens
tccggggaggtttat

SEQ ID NO: 32439 - DNA, 15 bp, Homo sapiens
ttccggggaggttta

SEQ ID NO: 32440 - DNA, 15 bp, Homo sapiens
gttccggggaggttt

SEQ ID NO: 32441 - DNA, 15 bp, Homo sapiens
ggttccggggaggtt

SEQ ID NO: 32442 - DNA, 15 bp, Homo sapiens
gggttccggggaggt

SEQ ID NO: 32443 - DNA, 15 bp, Homo sapiens
tgggttccggggagg

SEQ ID NO: 32444 - DNA, 15 bp, Homo sapiens
ttgggttccggggag

SEQ ID NO: 32445 - DNA, 15 bp, Homo sapiens
tttgggttccgggga

SEQ ID NO: 32446 - DNA, 15 bp, Homo sapiens
ctttgggttccgggg

SEQ ID NO: 32447 - DNA, 15 bp, Homo sapiens
cctttgggttccggg

SEQ ID NO: 32448 - DNA, 15 bp, Homo sapiens
tcctttgggttccgg

SEQ ID NO: 32449 - DNA, 15 bp, Homo sapiens
ttcctttgggttccg

SEQ ID NO: 32450 - DNA, 15 bp, Homo sapiens
gttcctttgggttcc

SEQ ID NO: 32451 - DNA, 15 bp, Homo sapiens
ggttcctttgggttc

SEQ ID NO: 32452 - DNA, 15 bp, Homo sapiens
tggttcctttgggtt

SEQ ID NO: 32453 - DNA, 15 bp, Homo sapiens
atggttcctttgggt

SEQ ID NO: 32454 - DNA, 15 bp, Homo sapiens
aatggttcctttggg

SEQ ID NO: 32455 - DNA, 15 bp, Homo sapiens
caatggttcctttgg

SEQ ID NO: 32456 - DNA, 15 bp, Homo sapiens
tcaatggttcctttg

SEQ ID NO: 32457 - DNA, 15 bp, Homo sapiens
atcaatggttccttt

SEQ ID NO: 32458 - DNA, 15 bp, Homo sapiens
gatcaatggttcctt

SEQ ID NO: 32459 - DNA, 15 bp, Homo sapiens
tgatcaatggttcct

SEQ ID NO: 32460 - DNA, 15 bp, Homo sapiens
ctgatcaatggttcc

SEQ ID NO: 32461 - DNA, 15 bp, Homo sapiens
gctgatcaatggttc

SEQ ID NO: 32462 - DNA, 15 bp, Homo sapiens
cgctgatcaatggtt

SEQ ID NO: 32463 - DNA, 15 bp, Homo sapiens
ccgctgatcaatggt

SEQ ID NO: 32464 - DNA, 15 bp, Homo sapiens
cccgctgatcaatgg

SEQ ID NO: 32465 - DNA, 15 bp, Homo sapiens
acccgctgatcaatg

SEQ ID NO: 32466 - DNA, 15 bp, Homo sapiens
cacccgctgatcaat

SEQ ID NO: 32467 - DNA, 15 bp, Homo sapiens
ccacccgctgatcaa

SEQ ID NO: 32468 - DNA, 15 bp, Homo sapiens
gccacccgctgatca

SEQ ID NO: 32469 - DNA, 15 bp, Homo sapiens
agccacccgctgatc

SEQ ID NO: 32470 - DNA, 15 bp, Homo sapiens
gagccacccgctgat

SEQ ID NO: 32471 - DNA, 15 bp, Homo sapiens
agagccacccgctga

SEQ ID NO: 32472 - DNA, 15 bp, Homo sapiens
aagagccacccgctg

SEQ ID NO: 32473 - DNA, 15 bp, Homo sapiens
aaagagccacccgct

SEQ ID NO: 32474 - DNA, 15 bp, Homo sapiens
aaaagagccacccgc

SEQ ID NO: 32475 - DNA, 15 bp, Homo sapiens
aaaaagagccacccg

SEQ ID NO: 32476 - DNA, 15 bp, Homo sapiens
gaaaaagagccaccc

SEQ ID NO: 32477 - DNA, 15 bp, Homo sapiens
ggaaaaagagccacc

SEQ ID NO: 32478 - DNA, 15 bp, Homo sapiens
cggaaaaagagccac

SEQ ID NO: 32479 - DNA, 15 bp, Homo sapiens
acggaaaaagagcca

SEQ ID NO: 32480 - DNA, 15 bp, Homo sapiens
aacggaaaaagagcc

SEQ ID NO: 32481 - DNA, 15 bp, Homo sapiens
taacggaaaaagagc

SEQ ID NO: 32482 - DNA, 15 bp, Homo sapiens
gtaacggaaaaagag

SEQ ID NO: 32483 - DNA, 15 bp, Homo sapiens
agtaacggaaaaaga

SEQ ID NO: 32484 - DNA, 15 bp, Homo sapiens
aagtaacggaaaaag

SEQ ID NO: 32485 - DNA, 15 bp, Homo sapiens
caagtaacggaaaaa

SEQ ID NO: 32486 - DNA, 15 bp, Homo sapiens
ccaagtaacggaaaa

SEQ ID NO: 32487 - DNA, 15 bp, Homo sapiens
gccaagtaacggaaa

SEQ ID NO: 32488 - DNA, 15 bp, Homo sapiens
agccaagtaacggaa

SEQ ID NO: 32489 - DNA, 15 bp, Homo sapiens
tagccaagtaacgga

SEQ ID NO: 32490 - DNA, 15 bp, Homo sapiens
atagccaagtaacgg

SEQ ID NO: 32491 - DNA, 15 bp, Homo sapiens
aatagccaagtaacg

SEQ ID NO: 32492 - DNA, 15 bp, Homo sapiens
caatagccaagtaac

SEQ ID NO: 32493 - DNA, 15 bp, Homo sapiens
ccaatagccaagtaa

SEQ ID NO: 32494 - DNA, 15 bp, Homo sapiens
gccaatagccaagta

SEQ ID NO: 32495 - DNA, 15 bp, Homo sapiens
agccaatagccaagt

SEQ ID NO: 32496 - DNA, 15 bp, Homo sapiens
cagccaatagccaag

SEQ ID NO: 32497 - DNA, 15 bp, Homo sapiens
acagccaatagccaa

SEQ ID NO: 32498 - DNA, 15 bp, Homo sapiens
cacagccaatagcca

SEQ ID NO: 32499 - DNA, 15 bp, Homo sapiens
tcacagccaatagcc

SEQ ID NO: 32500 - DNA, 15 bp, Homo sapiens
ctcacagccaatagc

SEQ ID NO: 32501 - DNA, 15 bp, Homo sapiens
actcacagccaatag

SEQ ID NO: 32502 - DNA, 15 bp, Homo sapiens
tactcacagccaata

SEQ ID NO: 32503 - DNA, 15 bp, Homo sapiens
gtactcacagccaat

SEQ ID NO: 32504 - DNA, 15 bp, Homo sapiens
tgtactcacagccaa

SEQ ID NO: 32505 - DNA, 15 bp, Homo sapiens
ttgtactcacagcca

SEQ ID NO: 32506 - DNA, 15 bp, Homo sapiens
attgtactcacagcc

SEQ ID NO: 32507 - DNA, 15 bp, Homo sapiens
aattgtactcacagc

SEQ ID NO: 32508 - DNA, 15 bp, Homo sapiens
aaattgtactcacag

SEQ ID NO: 32509 - DNA, 15 bp, Homo sapiens
aaaattgtactcaca

SEQ ID NO: 32510 - DNA, 15 bp, Homo sapiens
aaaaattgtactcac

SEQ ID NO: 32511 - DNA, 15 bp, Homo sapiens
aaaaaattgtactca

SEQ ID NO: 32512 - DNA, 15 bp, Homo sapiens
aaaaaaattgtactc

SEQ ID NO: 32513 - DNA, 15 bp, Homo sapiens
taaaaaaattgtact

SEQ ID NO: 32514 - DNA, 15 bp, Homo sapiens
ataaaaaaattgtac

SEQ ID NO: 32515 - DNA, 15 bp, Homo sapiens
tataaaaaaattgta

SEQ ID NO: 32516 - DNA, 15 bp, Homo sapiens
atataaaaaaattgt

SEQ ID NO: 32517 - DNA, 15 bp, Homo sapiens
aatataaaaaaattg

SEQ ID NO: 32518 - DNA, 15 bp, Homo sapiens
taatataaaaaaatt

SEQ ID NO: 32519 - DNA, 15 bp, Homo sapiens
gtaatataaaaaaat

SEQ ID NO: 32520 - DNA, 15 bp, Homo sapiens
agtaatataaaaaaa

SEQ ID NO: 32521 - DNA, 15 bp, Homo sapiens
cagtaatataaaaaa

SEQ ID NO: 32522 - DNA, 15 bp, Homo sapiens
tcagtaatataaaaa

SEQ ID NO: 32523 - DNA, 15 bp, Homo sapiens
atcagtaatataaaa

SEQ ID NO: 32524 - DNA, 15 bp, Homo sapiens
aatcagtaatataaa

SEQ ID NO: 32525 - DNA, 15 bp, Homo sapiens
aaatcagtaatataa

SEQ ID NO: 32526 - DNA, 15 bp, Homo sapiens
aaaatcagtaatata

SEQ ID NO: 32527 - DNA, 15 bp, Homo sapiens
aaaaatcagtaatat

SEQ ID NO: 32528 - DNA, 15 bp, Homo sapiens
taaaaatcagtaata

SEQ ID NO: 32529 - DNA, 15 bp, Homo sapiens
ttaaaaatcagtaat

SEQ ID NO: 32530 - DNA, 15 bp, Homo sapiens
tttaaaaatcagtaa

SEQ ID NO: 32531 - DNA, 15 bp, Homo sapiens
gtttaaaaatcagta

SEQ ID NO: 32532 - DNA, 15 bp, Homo sapiens
tgtttaaaaatcagt

SEQ ID NO: 32533 - DNA, 15 bp, Homo sapiens
ttgtttaaaaatcag

SEQ ID NO: 32534 - DNA, 15 bp, Homo sapiens
tttgtttaaaaatca

SEQ ID NO: 32535 - DNA, 15 bp, Homo sapiens
ttttgtttaaaaatc

SEQ ID NO: 32536 - DNA, 15 bp, Homo sapiens
attttgtttaaaaat

SEQ ID NO: 32537 - DNA, 15 bp, Homo sapiens
cattttgtttaaaaa

SEQ ID NO: 32538 - DNA, 15 bp, Homo sapiens
acattttgtttaaaa

SEQ ID NO: 32539 - DNA, 15 bp, Homo sapiens
aacattttgtttaaa

SEQ ID NO: 32540 - DNA, 15 bp, Homo sapiens
aaacattttgtttaa

SEQ ID NO: 32541 - DNA, 15 bp, Homo sapiens
caaacattttgttta

SEQ ID NO: 32542 - DNA, 15 bp, Homo sapiens
acaaacattttgttt

SEQ ID NO: 32543 - DNA, 15 bp, Homo sapiens
cacaaacattttgtt

SEQ ID NO: 32544 - DNA, 15 bp, Homo sapiens
tcacaaacattttgt

SEQ ID NO: 32545 - DNA, 15 bp, Homo sapiens
ctcacaaacattttg

SEQ ID NO: 32546 - DNA, 15 bp, Homo sapiens
gctcacaaacatttt

SEQ ID NO: 32547 - DNA, 15 bp, Homo sapiens
agctcacaaacattt

SEQ ID NO: 32548 - DNA, 15 bp, Homo sapiens
cagctcacaaacatt

SEQ ID NO: 32549 - DNA, 15 bp, Homo sapiens
tcagctcacaaacat

SEQ ID NO: 32550 - DNA, 15 bp, Homo sapiens
ttcagctcacaaaca

SEQ ID NO: 32551 - DNA, 15 bp, Homo sapiens
tttcagctcacaaac

SEQ ID NO: 32552 - DNA, 15 bp, Homo sapiens
atttcagctcacaaa

SEQ ID NO: 32553 - DNA, 15 bp, Homo sapiens
aatttcagctcacaa

SEQ ID NO: 32554 - DNA, 15 bp, Homo sapiens
aaatttcagctcaca

SEQ ID NO: 32555 - DNA, 15 bp, Homo sapiens
aaaatttcagctcac

SEQ ID NO: 32556 - DNA, 15 bp, Homo sapiens
caaaatttcagctca

SEQ ID NO: 32557 - DNA, 15 bp, Homo sapiens
acaaaatttcagctc

SEQ ID NO: 32558 - DNA, 15 bp, Homo sapiens
tacaaaatttcagct

SEQ ID NO: 32559 - DNA, 15 bp, Homo sapiens
ttacaaaatttcagc

SEQ ID NO: 32560 - DNA, 15 bp, Homo sapiens
tttacaaaatttcag

SEQ ID NO: 32561 - DNA, 15 bp, Homo sapiens
atttacaaaatttca

SEQ ID NO: 32562 - DNA, 15 bp, Homo sapiens
aatttacaaaatttc

SEQ ID NO: 32563 - DNA, 15 bp, Homo sapiens
gaatttacaaaattt

SEQ ID NO: 32564 - DNA, 15 bp, Homo sapiens
tgaatttacaaaatt

SEQ ID NO: 32565 - DNA, 15 bp, Homo sapiens
atgaatttacaaaat

SEQ ID NO: 32566 - DNA, 15 bp, Homo sapiens
gatgaatttacaaaa

SEQ ID NO: 32567 - DNA, 15 bp, Homo sapiens
ggatgaatttacaaa

SEQ ID NO: 32568 - DNA, 15 bp, Homo sapiens
gggatgaatttacaa

SEQ ID NO: 32569 - DNA, 15 bp, Homo sapiens
agggatgaatttaca

SEQ ID NO: 32570 - DNA, 15 bp, Homo sapiens
aagggatgaatttac

SEQ ID NO: 32571 - DNA, 15 bp, Homo sapiens
taagggatgaattta

SEQ ID NO: 32572 - DNA, 15 bp, Homo sapiens
ttaagggatgaattt

SEQ ID NO: 32573 - DNA, 15 bp, Homo sapiens
tttaagggatgaatt

SEQ ID NO: 32574 - DNA, 15 bp, Homo sapiens
ttttaagggatgaat

SEQ ID NO: 32575 - DNA, 15 bp, Homo sapiens
cttttaagggatgaa

SEQ ID NO: 32576 - DNA, 15 bp, Homo sapiens
gcttttaagggatga

SEQ ID NO: 32577 - DNA, 15 bp, Homo sapiens
cgcttttaagggatg

SEQ ID NO: 32578 - DNA, 15 bp, Homo sapiens
acgcttttaagggat

SEQ ID NO: 32579 - DNA, 15 bp, Homo sapiens
cacgcttttaaggga

SEQ ID NO: 32580 - DNA, 15 bp, Homo sapiens
acacgcttttaaggg

SEQ ID NO: 32581 - DNA, 15 bp, Homo sapiens
aacacgcttttaagg

SEQ ID NO: 32582 - DNA, 15 bp, Homo sapiens
aaacacgcttttaag

SEQ ID NO: 32583 - DNA, 15 bp, Homo sapiens
aaaacacgcttttaa

SEQ ID NO: 32584 - DNA, 15 bp, Homo sapiens
aaaaacacgctttta

SEQ ID NO: 32585 - DNA, 15 bp, Homo sapiens
aaaaaacacgctttt

SEQ ID NO: 32586 - DNA, 15 bp, Homo sapiens
gaaaaaacacgcttt

SEQ ID NO: 32587 - DNA, 15 bp, Homo sapiens
agaaaaaacacgctt

SEQ ID NO: 32588 - DNA, 15 bp, Homo sapiens
aagaaaaaacacgct

SEQ ID NO: 32589 - DNA, 15 bp, Homo sapiens
gaagaaaaaacacgc

SEQ ID NO: 32590 - DNA, 15 bp, Homo sapiens
agaagaaaaaacacg

SEQ ID NO: 32591 - DNA, 15 bp, Homo sapiens
tagaagaaaaaacac

SEQ ID NO: 32592 - DNA, 15 bp, Homo sapiens
atagaagaaaaaaca

SEQ ID NO: 32593 - DNA, 15 bp, Homo sapiens
gatagaagaaaaaac

SEQ ID NO: 32594 - DNA, 15 bp, Homo sapiens
ggatagaagaaaaaa

SEQ ID NO: 32595 - DNA, 15 bp, Homo sapiens
gggatagaagaaaaa

SEQ ID NO: 32596 - DNA, 15 bp, Homo sapiens
ggggatagaagaaaa

SEQ ID NO: 32597 - DNA, 15 bp, Homo sapiens
cggggatagaagaaa

SEQ ID NO: 32598 - DNA, 15 bp, Homo sapiens
acggggatagaagaa

SEQ ID NO: 32599 - DNA, 15 bp, Homo sapiens
tacggggatagaaga

SEQ ID NO: 32600 - DNA, 15 bp, Homo sapiens
atacggggatagaag

SEQ ID NO: 32601 - DNA, 15 bp, Homo sapiens
tatacggggatagaa

SEQ ID NO: 32602 - DNA, 15 bp, Homo sapiens
ctatacggggataga

SEQ ID NO: 32603 - DNA, 15 bp, Homo sapiens
cctatacggggatag

SEQ ID NO: 32604 - DNA, 15 bp, Homo sapiens
ccctatacggggata

SEQ ID NO: 32605 - DNA, 15 bp, Homo sapiens
accctatacggggat

SEQ ID NO: 32606 - DNA, 15 bp, Homo sapiens
taccctatacgggga

SEQ ID NO: 32607 - DNA, 15 bp, Homo sapiens
ctaccctatacgggg

SEQ ID NO: 32608 - DNA, 15 bp, Homo sapiens
gctaccctatacggg

SEQ ID NO: 32609 - DNA, 15 bp, Homo sapiens
tgctaccctatacgg

SEQ ID NO: 32610 - DNA, 15 bp, Homo sapiens
ttgctaccctatacg

SEQ ID NO: 32611 - DNA, 15 bp, Homo sapiens
tttgctaccctatac

SEQ ID NO: 32612 - DNA, 15 bp, Homo sapiens
ttttgctaccctata

SEQ ID NO: 32613 - DNA, 15 bp, Homo sapiens
cttttgctaccctat

SEQ ID NO: 32614 - DNA, 15 bp, Homo sapiens
tcttttgctacccta

SEQ ID NO: 32615 - DNA, 15 bp, Homo sapiens
gtcttttgctaccct

SEQ ID NO: 32616 - DNA, 15 bp, Homo sapiens
tgtcttttgctaccc

SEQ ID NO: 32617 - DNA, 15 bp, Homo sapiens
ctgtcttttgctacc

SEQ ID NO: 32618 - DNA, 15 bp, Homo sapiens
tctgtcttttgctac

SEQ ID NO: 32619 - DNA, 15 bp, Homo sapiens
ctctgtcttttgcta

SEQ ID NO: 32620 - DNA, 15 bp, Homo sapiens
tctctgtcttttgct

SEQ ID NO: 32621 - DNA, 15 bp, Homo sapiens
atctctgtcttttgc

SEQ ID NO: 32622 - DNA, 15 bp, Homo sapiens
catctctgtcttttg

SEQ ID NO: 32623 - DNA, 15 bp, Homo sapiens
gcatctctgtctttt

SEQ ID NO: 32624 - DNA, 15 bp, Homo sapiens
ggcatctctgtcttt

SEQ ID NO: 32625 - DNA, 15 bp, Homo sapiens
gggcatctctgtctt

SEQ ID NO: 32626 - DNA, 15 bp, Homo sapiens
agggcatctctgtct

SEQ ID NO: 32627 - DNA, 15 bp, Homo sapiens
gagggcatctctgtc

SEQ ID NO: 32628 - DNA, 15 bp, Homo sapiens
agagggcatctctgt

SEQ ID NO: 32629 - DNA, 15 bp, Homo sapiens
aagagggcatctctg

SEQ ID NO: 32630 - DNA, 15 bp, Homo sapiens
taagagggcatctct

SEQ ID NO: 32631 - DNA, 15 bp, Homo sapiens
gtaagagggcatctc

SEQ ID NO: 32632 - DNA, 15 bp, Homo sapiens
tgtaagagggcatct

SEQ ID NO: 32633 - DNA, 15 bp, Homo sapiens
ctgtaagagggcatc

SEQ ID NO: 32634 - DNA, 15 bp, Homo sapiens
actgtaagagggcat

SEQ ID NO: 32635 - DNA, 15 bp, Homo sapiens
aactgtaagagggca

SEQ ID NO: 32636 - DNA, 15 bp, Homo sapiens
gaactgtaagagggc

SEQ ID NO: 32637 - DNA, 15 bp, Homo sapiens
cgaactgtaagaggg

SEQ ID NO: 32638 - DNA, 15 bp, Homo sapiens
tcgaactgtaagagg

SEQ ID NO: 32639 - DNA, 15 bp, Homo sapiens
atcgaactgtaagag

SEQ ID NO: 32640 - DNA, 15 bp, Homo sapiens
catcgaactgtaaga

SEQ ID NO: 32641 - DNA, 15 bp, Homo sapiens
tcatcgaactgtaag

SEQ ID NO: 32642 - DNA, 15 bp, Homo sapiens
ttcatcgaactgtaa

SEQ ID NO: 32643 - DNA, 15 bp, Homo sapiens
gttcatcgaactgta

SEQ ID NO: 32644 - DNA, 15 bp, Homo sapiens
agttcatcgaactgt

SEQ ID NO: 32645 - DNA, 15 bp, Homo sapiens
tagttcatcgaactg

SEQ ID NO: 32646 - DNA, 15 bp, Homo sapiens
atagttcatcgaact

SEQ ID NO: 32647 - DNA, 15 bp, Homo sapiens
tatagttcatcgaac

SEQ ID NO: 32648 - DNA, 15 bp, Homo sapiens
gtatagttcatcgaa

SEQ ID NO: 32649 - DNA, 15 bp, Homo sapiens
tgtatagttcatcga

SEQ ID NO: 32650 - DNA, 15 bp, Homo sapiens
atgtatagttcatcg

SEQ ID NO: 32651 - DNA, 15 bp, Homo sapiens
gatgtatagttcatc

SEQ ID NO: 32652 - DNA, 15 bp, Homo sapiens
ggatgtatagttcat

SEQ ID NO: 32653 - DNA, 15 bp, Homo sapiens
tggatgtatagttca

SEQ ID NO: 32654 - DNA, 15 bp, Homo sapiens
ttggatgtatagttc

SEQ ID NO: 32655 - DNA, 15 bp, Homo sapiens
attggatgtatagtt

SEQ ID NO: 32656 - DNA, 15 bp, Homo sapiens
aattggatgtatagt

SEQ ID NO: 32657 - DNA, 15 bp, Homo sapiens
aaattggatgtatag

SEQ ID NO: 32658 - DNA, 15 bp, Homo sapiens
taaattggatgtata

SEQ ID NO: 32659 - DNA, 15 bp, Homo sapiens
gtaaattggatgtat

SEQ ID NO: 32660 - DNA, 15 bp, Homo sapiens
ggtaaattggatgta

SEQ ID NO: 32661 - DNA, 15 bp, Homo sapiens
tggtaaattggatgt

SEQ ID NO: 32662 - DNA, 15 bp, Homo sapiens
ctggtaaattggatg

SEQ ID NO: 32663 - DNA, 15 bp, Homo sapiens
tctggtaaattggat

SEQ ID NO: 32664 - DNA, 15 bp, Homo sapiens
ctctggtaaattgga

SEQ ID NO: 32665 - DNA, 15 bp, Homo sapiens
actctggtaaattgg

SEQ ID NO: 32666 - DNA, 15 bp, Homo sapiens
gactctggtaaattg

SEQ ID NO: 32667 - DNA, 15 bp, Homo sapiens
ggactctggtaaatt

SEQ ID NO: 32668 - DNA, 15 bp, Homo sapiens
aggactctggtaaat

SEQ ID NO: 32669 - DNA, 15 bp, Homo sapiens
aaggactctggtaaa

SEQ ID NO: 32670 - DNA, 15 bp, Homo sapiens
aaaggactctggtaa

SEQ ID NO: 32671 - DNA, 15 bp, Homo sapiens
gaaaggactctggta

SEQ ID NO: 32672 - DNA, 15 bp, Homo sapiens
tgaaaggactctggt

SEQ ID NO: 32673 - DNA, 15 bp, Homo sapiens
gtgaaaggactctgg

SEQ ID NO: 32674 - DNA, 15 bp, Homo sapiens
tgtgaaaggactctg

SEQ ID NO: 32675 - DNA, 15 bp, Homo sapiens
ctgtgaaaggactct

SEQ ID NO: 32676 - DNA, 15 bp, Homo sapiens
actgtgaaaggactc

SEQ ID NO: 32677 - DNA, 15 bp, Homo sapiens
aactgtgaaaggact

SEQ ID NO: 32678 - DNA, 15 bp, Homo sapiens
taactgtgaaaggac

SEQ ID NO: 32679 - DNA, 15 bp, Homo sapiens
ctaactgtgaaagga

SEQ ID NO: 32680 - DNA, 15 bp, Homo sapiens
actaactgtgaaagg

SEQ ID NO: 32681 - DNA, 15 bp, Homo sapiens
aactaactgtgaaag

SEQ ID NO: 32682 - DNA, 15 bp, Homo sapiens
gaactaactgtgaaa

SEQ ID NO: 32683 - DNA, 15 bp, Homo sapiens
ggaactaactgtgaa

SEQ ID NO: 32684 - DNA, 15 bp, Homo sapiens
tggaactaactgtga

SEQ ID NO: 32685 - DNA, 15 bp, Homo sapiens
ctggaactaactgtg

SEQ ID NO: 32686 - DNA, 15 bp, Homo sapiens
actggaactaactgt

SEQ ID NO: 32687 - DNA, 15 bp, Homo sapiens
aactggaactaactg

SEQ ID NO: 32688 - DNA, 15 bp, Homo sapiens
aaactggaactaact

SEQ ID NO: 32689 - DNA, 15 bp, Homo sapiens
aaaactggaactaac

SEQ ID NO: 32690 - DNA, 15 bp, Homo sapiens
taaaactggaactaa

SEQ ID NO: 32691 - DNA, 15 bp, Homo sapiens
ctaaaactggaacta

SEQ ID NO: 32692 - DNA, 15 bp, Homo sapiens
gctaaaactggaact

SEQ ID NO: 32693 - DNA, 15 bp, Homo sapiens
tgctaaaactggaac

SEQ ID NO: 32694 - DNA, 15 bp, Homo sapiens
atgctaaaactggaa

SEQ ID NO: 32695 - DNA, 15 bp, Homo sapiens
gatgctaaaactgga

SEQ ID NO: 32696 - DNA, 15 bp, Homo sapiens
ggatgctaaaactgg

SEQ ID NO: 32697 - DNA, 15 bp, Homo sapiens
aggatgctaaaactg

SEQ ID NO: 32698 - DNA, 15 bp, Homo sapiens
caggatgctaaaact

SEQ ID NO: 32699 - DNA, 15 bp, Homo sapiens
gcaggatgctaaaac

SEQ ID NO: 32700 - DNA, 15 bp, Homo sapiens
ggcaggatgctaaaa

SEQ ID NO: 32701 - DNA, 15 bp, Homo sapiens
gggcaggatgctaaa

SEQ ID NO: 32702 - DNA, 15 bp, Homo sapiens
agggcaggatgctaa

SEQ ID NO: 32703 - DNA, 15 bp, Homo sapiens
aagggcaggatgcta

SEQ ID NO: 32704 - DNA, 15 bp, Homo sapiens
taagggcaggatgct

SEQ ID NO: 32705 - DNA, 15 bp, Homo sapiens
gtaagggcaggatgc

SEQ ID NO: 32706 - DNA, 15 bp, Homo sapiens
agtaagggcaggatg

SEQ ID NO: 32707 - DNA, 15 bp, Homo sapiens
aagtaagggcaggat

SEQ ID NO: 32708 - DNA, 15 bp, Homo sapiens
caagtaagggcagga

SEQ ID NO: 32709 - DNA, 15 bp, Homo sapiens
ccaagtaagggcagg

SEQ ID NO: 32710 - DNA, 15 bp, Homo sapiens
cccaagtaagggcag

SEQ ID NO: 32711 - DNA, 15 bp, Homo sapiens
gcccaagtaagggca

SEQ ID NO: 32712 - DNA, 15 bp, Homo sapiens
agcccaagtaagggc

SEQ ID NO: 32713 - DNA, 15 bp, Homo sapiens
aagcccaagtaaggg

SEQ ID NO: 32714 - DNA, 15 bp, Homo sapiens
aaagcccaagtaagg

SEQ ID NO: 32715 - DNA, 15 bp, Homo sapiens
aaaagcccaagtaag

SEQ ID NO: 32716 - DNA, 15 bp, Homo sapiens
gaaaagcccaagtaa

SEQ ID NO: 32717 - DNA, 15 bp, Homo sapiens
agaaaagcccaagta

SEQ ID NO: 32718 - DNA, 15 bp, Homo sapiens
cagaaaagcccaagt

SEQ ID NO: 32719 - DNA, 15 bp, Homo sapiens
tcagaaaagcccaag

SEQ ID NO: 32720 - DNA, 15 bp, Homo sapiens
ttcagaaaagcccaa

SEQ ID NO: 32721 - DNA, 15 bp, Homo sapiens
attcagaaaagccca

SEQ ID NO: 32722 - DNA, 15 bp, Homo sapiens
cattcagaaaagccc

SEQ ID NO: 32723 - DNA, 15 bp, Homo sapiens
tcattcagaaaagcc

SEQ ID NO: 32724 - DNA, 15 bp, Homo sapiens
ctcattcagaaaagc

SEQ ID NO: 32725 - DNA, 15 bp, Homo sapiens
gctcattcagaaaag

SEQ ID NO: 32726 - DNA, 15 bp, Homo sapiens
tgctcattcagaaaa

SEQ ID NO: 32727 - DNA, 15 bp, Homo sapiens
ttgctcattcagaaa

SEQ ID NO: 32728 - DNA, 15 bp, Homo sapiens
attgctcattcagaa

SEQ ID NO: 32729 - DNA, 15 bp, Homo sapiens
aattgctcattcaga

SEQ ID NO: 32730 - DNA, 15 bp, Homo sapiens
taattgctcattcag

SEQ ID NO: 32731 - DNA, 15 bp, Homo sapiens
ttaattgctcattca

SEQ ID NO: 32732 - DNA, 15 bp, Homo sapiens
tttaattgctcattc

SEQ ID NO: 32733 - DNA, 15 bp, Homo sapiens
gtttaattgctcatt

SEQ ID NO: 32734 - DNA, 15 bp, Homo sapiens
tgtttaattgctcat

SEQ ID NO: 32735 - DNA, 15 bp, Homo sapiens
atgtttaattgctca

SEQ ID NO: 32736 - DNA, 15 bp, Homo sapiens
gatgtttaattgctc

SEQ ID NO: 32737 - DNA, 15 bp, Homo sapiens
tgatgtttaattgct

SEQ ID NO: 32738 - DNA, 15 bp, Homo sapiens
ctgatgtttaattgc

SEQ ID NO: 32739 - DNA, 15 bp, Homo sapiens
cctgatgtttaattg

SEQ ID NO: 32740 - DNA, 15 bp, Homo sapiens
ccctgatgtttaatt

SEQ ID NO: 32741 - DNA, 15 bp, Homo sapiens
accctgatgtttaat

SEQ ID NO: 32742 - DNA, 15 bp, Homo sapiens
aaccctgatgtttaa

SEQ ID NO: 32743 - DNA, 15 bp, Homo sapiens
aaaccctgatgttta

SEQ ID NO: 32744 - DNA, 15 bp, Homo sapiens
aaaaccctgatgttt

SEQ ID NO: 32745 - DNA, 15 bp, Homo sapiens
gaaaaccctgatgtt

SEQ ID NO: 32746 - DNA, 15 bp, Homo sapiens
tgaaaaccctgatgt

SEQ ID NO: 32747 - DNA, 15 bp, Homo sapiens
ctgaaaaccctgatg

SEQ ID NO: 32748 - DNA, 15 bp, Homo sapiens
tctgaaaaccctgat

SEQ ID NO: 32749 - DNA, 15 bp, Homo sapiens
atctgaaaaccctga

SEQ ID NO: 32750 - DNA, 15 bp, Homo sapiens
aatctgaaaaccctg

SEQ ID NO: 32751 - DNA, 15 bp, Homo sapiens
caatctgaaaaccct

SEQ ID NO: 32752 - DNA, 15 bp, Homo sapiens
tcaatctgaaaaccc

SEQ ID NO: 32753 - DNA, 15 bp, Homo sapiens
ctcaatctgaaaacc

SEQ ID NO: 32754 - DNA, 15 bp, Homo sapiens
gctcaatctgaaaac

SEQ ID NO: 32755 - DNA, 15 bp, Homo sapiens
ggctcaatctgaaaa

SEQ ID NO: 32756 - DNA, 15 bp, Homo sapiens
gggctcaatctgaaa

SEQ ID NO: 32757 - DNA, 15 bp, Homo sapiens
agggctcaatctgaa

SEQ ID NO: 32758 - DNA, 15 bp, Homo sapiens
gagggctcaatctga

SEQ ID NO: 32759 - DNA, 15 bp, Homo sapiens
agagggctcaatctg

SEQ ID NO: 32760 - DNA, 15 bp, Homo sapiens
cagagggctcaatct

SEQ ID NO: 32761 - DNA, 15 bp, Homo sapiens
acagagggctcaatc

SEQ ID NO: 32762 - DNA, 15 bp, Homo sapiens
cacagagggctcaat

SEQ ID NO: 32763 - DNA, 15 bp, Homo sapiens
gcacagagggctcaa

SEQ ID NO: 32764 - DNA, 15 bp, Homo sapiens
tgcacagagggctca

SEQ ID NO: 32765 - DNA, 15 bp, Homo sapiens
ttgcacagagggctc

SEQ ID NO: 32766 - DNA, 15 bp, Homo sapiens
tttgcacagagggct

SEQ ID NO: 32767 - DNA, 15 bp, Homo sapiens
ctttgcacagagggc

SEQ ID NO: 32768 - DNA, 15 bp, Homo sapiens
cctttgcacagaggg

SEQ ID NO: 32769 - DNA, 15 bp, Homo sapiens
ccctttgcacagagg

SEQ ID NO: 32770 - DNA, 15 bp, Homo sapiens
tccctttgcacagag

SEQ ID NO: 32771 - DNA, 15 bp, Homo sapiens
atccctttgcacaga

SEQ ID NO: 32772 - DNA, 15 bp, Homo sapiens
tatccctttgcacag

SEQ ID NO: 32773 - DNA, 15 bp, Homo sapiens
ttatccctttgcaca

SEQ ID NO: 32774 - DNA, 15 bp, Homo sapiens
cttatccctttgcac

SEQ ID NO: 32775 - DNA, 15 bp, Homo sapiens
tcttatccctttgca

SEQ ID NO: 32776 - DNA, 15 bp, Homo sapiens
ttcttatccctttgc

SEQ ID NO: 32777 - DNA, 15 bp, Homo sapiens
attcttatccctttg

SEQ ID NO: 32778 - DNA, 15 bp, Homo sapiens
cattcttatcccttt

SEQ ID NO: 32779 - DNA, 15 bp, Homo sapiens
tcattcttatccctt

SEQ ID NO: 32780 - DNA, 15 bp, Homo sapiens
atcattcttatccct

SEQ ID NO: 32781 - DNA, 15 bp, Homo sapiens
aatcattcttatccc

SEQ ID NO: 32782 - DNA, 15 bp, Homo sapiens
gaatcattcttatcc

SEQ ID NO: 32783 - DNA, 15 bp, Homo sapiens
tgaatcattcttatc

SEQ ID NO: 32784 - DNA, 15 bp, Homo sapiens
gtgaatcattcttat

SEQ ID NO: 32785 - DNA, 15 bp, Homo sapiens
cgtgaatcattctta

SEQ ID NO: 32786 - DNA, 15 bp, Homo sapiens
gcgtgaatcattctt

SEQ ID NO: 32787 - DNA, 15 bp, Homo sapiens
agcgtgaatcattct

SEQ ID NO: 32788 - DNA, 15 bp, Homo sapiens
tagcgtgaatcattc

SEQ ID NO: 32789 - DNA, 15 bp, Homo sapiens
ctagcgtgaatcatt

SEQ ID NO: 32790 - DNA, 15 bp, Homo sapiens
cctagcgtgaatcat

SEQ ID NO: 32791 - DNA, 15 bp, Homo sapiens
acctagcgtgaatca

SEQ ID NO: 32792 - DNA, 15 bp, Homo sapiens
aacctagcgtgaatc

SEQ ID NO: 32793 - DNA, 15 bp, Homo sapiens
gaacctagcgtgaat

SEQ ID NO: 32794 - DNA, 15 bp, Homo sapiens
agaacctagcgtgaa

SEQ ID NO: 32795 - DNA, 15 bp, Homo sapiens
cagaacctagcgtga

SEQ ID NO: 32796 - DNA, 15 bp, Homo sapiens
gcagaacctagcgtg

SEQ ID NO: 32797 - DNA, 15 bp, Homo sapiens
ggcagaacctagcgt

SEQ ID NO: 32798 - DNA, 15 bp, Homo sapiens
aggcagaacctagcg

SEQ ID NO: 32799 - DNA, 15 bp, Homo sapiens
aaggcagaacctagc

SEQ ID NO: 32800 - DNA, 15 bp, Homo sapiens
gaaggcagaacctag

SEQ ID NO: 32801 - DNA, 15 bp, Homo sapiens
ggaaggcagaaccta

SEQ ID NO: 32802 - DNA, 15 bp, Homo sapiens
tggaaggcagaacct

SEQ ID NO: 32803 - DNA, 15 bp, Homo sapiens
ttggaaggcagaacc

SEQ ID NO: 32804 - DNA, 15 bp, Homo sapiens
cttggaaggcagaac

SEQ ID NO: 32805 - DNA, 15 bp, Homo sapiens
tcttggaaggcagaa

SEQ ID NO: 32806 - DNA, 15 bp, Homo sapiens
ctcttggaaggcaga

SEQ ID NO: 32807 - DNA, 15 bp, Homo sapiens
actcttggaaggcag

SEQ ID NO: 32808 - DNA, 15 bp, Homo sapiens
aactcttggaaggca

SEQ ID NO: 32809 - DNA, 15 bp, Homo sapiens
gaactcttggaaggc

SEQ ID NO: 32810 - DNA, 15 bp, Homo sapiens
tgaactcttggaagg

SEQ ID NO: 32811 - DNA, 15 bp, Homo sapiens
atgaactcttggaag

SEQ ID NO: 32812 - DNA, 15 bp, Homo sapiens
tatgaactcttggaa

SEQ ID NO: 32813 - DNA, 15 bp, Homo sapiens
ctatgaactcttgga

SEQ ID NO: 32814 - DNA, 15 bp, Homo sapiens
cctatgaactcttgg

SEQ ID NO: 32815 - DNA, 15 bp, Homo sapiens
acctatgaactcttg

SEQ ID NO: 32816 - DNA, 15 bp, Homo sapiens
cacctatgaactctt

SEQ ID NO: 32817 - DNA, 15 bp, Homo sapiens
ccacctatgaactct

SEQ ID NO: 32818 - DNA, 15 bp, Homo sapiens
cccacctatgaactc

SEQ ID NO: 32819 - DNA, 15 bp, Homo sapiens
tcccacctatgaact

SEQ ID NO: 32820 - DNA, 15 bp, Homo sapiens
atcccacctatgaac

SEQ ID NO: 32821 - DNA, 15 bp, Homo sapiens
aatcccacctatgaa

SEQ ID NO: 32822 - DNA, 15 bp, Homo sapiens
aaatcccacctatga

SEQ ID NO: 32823 - DNA, 15 bp, Homo sapiens
taaatcccacctatg

SEQ ID NO: 32824 - DNA, 15 bp, Homo sapiens
ttaaatcccacctat

SEQ ID NO: 32825 - DNA, 15 bp, Homo sapiens
tttaaatcccaccta

SEQ ID NO: 32826 - DNA, 15 bp, Homo sapiens
atttaaatcccacct

SEQ ID NO: 32827 - DNA, 15 bp, Homo sapiens
tatttaaatcccacc

SEQ ID NO: 32828 - DNA, 15 bp, Homo sapiens
ctatttaaatcccac

SEQ ID NO: 32829 - DNA, 15 bp, Homo sapiens
tctatttaaatccca

SEQ ID NO: 32830 - DNA, 15 bp, Homo sapiens
atctatttaaatccc

SEQ ID NO: 32831 - DNA, 15 bp, Homo sapiens
tatctatttaaatcc

SEQ ID NO: 32832 - DNA, 15 bp, Homo sapiens
ttatctatttaaatc

SEQ ID NO: 32833 - DNA, 15 bp, Homo sapiens
attatctatttaaat

SEQ ID NO: 32834 - DNA, 15 bp, Homo sapiens
aattatctatttaaa

SEQ ID NO: 32835 - DNA, 15 bp, Homo sapiens
caattatctatttaa

SEQ ID NO: 32836 - DNA, 15 bp, Homo sapiens
acaattatctattta

SEQ ID NO: 32837 - DNA, 15 bp, Homo sapiens
gacaattatctattt

SEQ ID NO: 32838 - DNA, 15 bp, Homo sapiens
tgacaattatctatt

SEQ ID NO: 32839 - DNA, 15 bp, Homo sapiens
gtgacaattatctat

SEQ ID NO: 32840 - DNA, 15 bp, Homo sapiens
ggtgacaattatcta

SEQ ID NO: 32841 - DNA, 15 bp, Homo sapiens
tggtgacaattatct

SEQ ID NO: 32842 - DNA, 15 bp, Homo sapiens
ttggtgacaattatc

SEQ ID NO: 32843 - DNA, 15 bp, Homo sapiens
cttggtgacaattat

SEQ ID NO: 32844 - DNA, 15 bp, Homo sapiens
acttggtgacaatta

SEQ ID NO: 32845 - DNA, 15 bp, Homo sapiens
aacttggtgacaatt

SEQ ID NO: 32846 - DNA, 15 bp, Homo sapiens
taacttggtgacaat

SEQ ID NO: 32847 - DNA, 15 bp, Homo sapiens
ataacttggtgacaa

SEQ ID NO: 32848 - DNA, 15 bp, Homo sapiens
tataacttggtgaca

SEQ ID NO: 32849 - DNA, 15 bp, Homo sapiens
ttataacttggtgac

SEQ ID NO: 32850 - DNA, 15 bp, Homo sapiens
tttataacttggtga

SEQ ID NO: 32851 - DNA, 15 bp, Homo sapiens
ttttataacttggtg

SEQ ID NO: 32852 - DNA, 15 bp, Homo sapiens
attttataacttggt

SEQ ID NO: 32853 - DNA, 15 bp, Homo sapiens
aattttataacttgg

SEQ ID NO: 32854 - DNA, 15 bp, Homo sapiens
aaattttataacttg

SEQ ID NO: 32855 - DNA, 15 bp, Homo sapiens
taaattttataactt

SEQ ID NO: 32856 - DNA, 15 bp, Homo sapiens
ctaaattttataact

SEQ ID NO: 32857 - DNA, 15 bp, Homo sapiens
actaaattttataac

SEQ ID NO: 32858 - DNA, 15 bp, Homo sapiens
gactaaattttataa

SEQ ID NO: 32859 - DNA, 15 bp, Homo sapiens
ggactaaattttata

SEQ ID NO: 32860 - DNA, 15 bp, Homo sapiens
gggactaaattttat

SEQ ID NO: 32861 - DNA, 15 bp, Homo sapiens
agggactaaatttta

SEQ ID NO: 32862 - DNA, 15 bp, Homo sapiens
cagggactaaatttt

SEQ ID NO: 32863 - DNA, 15 bp, Homo sapiens
acagggactaaattt

SEQ ID NO: 32864 - DNA, 15 bp, Homo sapiens
aacagggactaaatt

SEQ ID NO: 32865 - DNA, 15 bp, Homo sapiens
aaacagggactaaat

SEQ ID NO: 32866 - DNA, 15 bp, Homo sapiens
gaaacagggactaaa

SEQ ID NO: 32867 - DNA, 15 bp, Homo sapiens
ggaaacagggactaa

SEQ ID NO: 32868 - DNA, 15 bp, Homo sapiens
tggaaacagggacta

SEQ ID NO: 32869 - DNA, 15 bp, Homo sapiens
atggaaacagggact

SEQ ID NO: 32870 - DNA, 15 bp, Homo sapiens
tatggaaacagggac

SEQ ID NO: 32871 - DNA, 15 bp, Homo sapiens
ttatggaaacaggga

SEQ ID NO: 32872 - DNA, 15 bp, Homo sapiens
cttatggaaacaggg

SEQ ID NO: 32873 - DNA, 15 bp, Homo sapiens
tcttatggaaacagg

SEQ ID NO: 32874 - DNA, 15 bp, Homo sapiens
ctcttatggaaacag

SEQ ID NO: 32875 - DNA, 15 bp, Homo sapiens
tctcttatggaaaca

SEQ ID NO: 32876 - DNA, 15 bp, Homo sapiens
ttctcttatggaaac

SEQ ID NO: 32877 - DNA, 15 bp, Homo sapiens
cttctcttatggaaa

SEQ ID NO: 32878 - DNA, 15 bp, Homo sapiens
ccttctcttatggaa

SEQ ID NO: 32879 - DNA, 15 bp, Homo sapiens
cccttctcttatgga

SEQ ID NO: 32880 - DNA, 15 bp, Homo sapiens
acccttctcttatgg

SEQ ID NO: 32881 - DNA, 15 bp, Homo sapiens
aacccttctcttatg

SEQ ID NO: 32882 - DNA, 15 bp, Homo sapiens
caacccttctcttat

SEQ ID NO: 32883 - DNA, 15 bp, Homo sapiens
gcaacccttctctta

SEQ ID NO: 32884 - DNA, 15 bp, Homo sapiens
cgcaacccttctctt

SEQ ID NO: 32885 - DNA, 15 bp, Homo sapiens
gcgcaacccttctct

SEQ ID NO: 32886 - DNA, 15 bp, Homo sapiens
tgcgcaacccttctc

SEQ ID NO: 32887 - DNA, 15 bp, Homo sapiens
ctgcgcaacccttct

SEQ ID NO: 32888 - DNA, 15 bp, Homo sapiens
actgcgcaacccttc

SEQ ID NO: 32889 - DNA, 15 bp, Homo sapiens
cactgcgcaaccctt

SEQ ID NO: 32890 - DNA, 15 bp, Homo sapiens
ccactgcgcaaccct

SEQ ID NO: 32891 - DNA, 15 bp, Homo sapiens
gccactgcgcaaccc

SEQ ID NO: 32892 - DNA, 15 bp, Homo sapiens
agccactgcgcaacc

SEQ ID NO: 32893 - DNA, 15 bp, Homo sapiens
cagccactgcgcaac

SEQ ID NO: 32894 - DNA, 15 bp, Homo sapiens
ccagccactgcgcaa

SEQ ID NO: 32895 - DNA, 15 bp, Homo sapiens
accagccactgcgca

SEQ ID NO: 32896 - DNA, 15 bp, Homo sapiens
gaccagccactgcgc

SEQ ID NO: 32897 - DNA, 15 bp, Homo sapiens
ggaccagccactgcg

SEQ ID NO: 32898 - DNA, 15 bp, Homo sapiens
gggaccagccactgc

SEQ ID NO: 32899 - DNA, 15 bp, Homo sapiens
agggaccagccactg

SEQ ID NO: 32900 - DNA, 15 bp, Homo sapiens
aagggaccagccact

SEQ ID NO: 32901 - DNA, 15 bp, Homo sapiens
aaagggaccagccac

SEQ ID NO: 32902 - DNA, 15 bp, Homo sapiens
aaaagggaccagcca

SEQ ID NO: 32903 - DNA, 15 bp, Homo sapiens
taaaagggaccagcc

SEQ ID NO: 32904 - DNA, 15 bp, Homo sapiens
ataaaagggaccagc

SEQ ID NO: 32905 - DNA, 15 bp, Homo sapiens
tataaaagggaccag

SEQ ID NO: 32906 - DNA, 15 bp, Homo sapiens
atataaaagggacca

SEQ ID NO: 32907 - DNA, 15 bp, Homo sapiens
tatataaaagggacc

SEQ ID NO: 32908 - DNA, 15 bp, Homo sapiens
atatataaaagggac

SEQ ID NO: 32909 - DNA, 15 bp, Homo sapiens
tatatataaaaggga

SEQ ID NO: 32910 - DNA, 15 bp, Homo sapiens
ttatatataaaaggg

SEQ ID NO: 32911 - DNA, 15 bp, Homo sapiens
tttatatataaaagg

SEQ ID NO: 32912 - DNA, 15 bp, Homo sapiens
atttatatataaaag

SEQ ID NO: 32913 - DNA, 15 bp, Homo sapiens
gatttatatataaaa

SEQ ID NO: 32914 - DNA, 15 bp, Homo sapiens
tgatttatatataaa

SEQ ID NO: 32915 - DNA, 15 bp, Homo sapiens
atgatttatatataa

SEQ ID NO: 32916 - DNA, 15 bp, Homo sapiens
gatgatttatatata

SEQ ID NO: 32917 - DNA, 15 bp, Homo sapiens
agatgatttatatat

SEQ ID NO: 32918 - DNA, 15 bp, Homo sapiens
gagatgatttatata

SEQ ID NO: 32919 - DNA, 15 bp, Homo sapiens
agagatgatttatat

SEQ ID NO: 32920 - DNA, 15 bp, Homo sapiens
aagagatgatttata

SEQ ID NO: 32921 - DNA, 15 bp, Homo sapiens
aaagagatgatttat

SEQ ID NO: 32922 - DNA, 15 bp, Homo sapiens
taaagagatgattta

SEQ ID NO: 32923 - DNA, 15 bp, Homo sapiens
ctaaagagatgattt

SEQ ID NO: 32924 - DNA, 15 bp, Homo sapiens
gctaaagagatgatt

SEQ ID NO: 32925 - DNA, 15 bp, Homo sapiens
ggctaaagagatgat

SEQ ID NO: 32926 - DNA, 15 bp, Homo sapiens
gggctaaagagatga

SEQ ID NO: 32927 - DNA, 15 bp, Homo sapiens
agggctaaagagatg

SEQ ID NO: 32928 - DNA, 15 bp, Homo sapiens
gagggctaaagagat

SEQ ID NO: 32929 - DNA, 15 bp, Homo sapiens
tgagggctaaagaga

SEQ ID NO: 32930 - DNA, 15 bp, Homo sapiens
atgagggctaaagag

SEQ ID NO: 32931 - DNA, 15 bp, Homo sapiens
gatgagggctaaaga

SEQ ID NO: 32932 - DNA, 15 bp, Homo sapiens
agatgagggctaaag

SEQ ID NO: 32933 - DNA, 15 bp, Homo sapiens
aagatgagggctaaa

SEQ ID NO: 32934 - DNA, 15 bp, Homo sapiens
gaagatgagggctaa

SEQ ID NO: 32935 - DNA, 15 bp, Homo sapiens
ggaagatgagggcta

SEQ ID NO: 32936 - DNA, 15 bp, Homo sapiens
aggaagatgagggct

SEQ ID NO: 32937 - DNA, 15 bp, Homo sapiens
gaggaagatgagggc

SEQ ID NO: 32938 - DNA, 15 bp, Homo sapiens
tgaggaagatgaggg

SEQ ID NO: 32939 - DNA, 15 bp, Homo sapiens
gtgaggaagatgagg

SEQ ID NO: 32940 - DNA, 15 bp, Homo sapiens
ggtgaggaagatgag

SEQ ID NO: 32941 - DNA, 15 bp, Homo sapiens
gggtgaggaagatga

SEQ ID NO: 32942 - DNA, 15 bp, Homo sapiens
ggggtgaggaagatg

SEQ ID NO: 32943 - DNA, 15 bp, Homo sapiens
cggggtgaggaagat

SEQ ID NO: 32944 - DNA, 15 bp, Homo sapiens
ccggggtgaggaaga

SEQ ID NO: 32945 - DNA, 15 bp, Homo sapiens
cccggggtgaggaag

SEQ ID NO: 32946 - DNA, 15 bp, Homo sapiens
acccggggtgaggaa

SEQ ID NO: 32947 - DNA, 15 bp, Homo sapiens
aacccggggtgagga

SEQ ID NO: 32948 - DNA, 15 bp, Homo sapiens
gaacccggggtgagg

SEQ ID NO: 32949 - DNA, 15 bp, Homo sapiens
agaacccggggtgag

SEQ ID NO: 32950 - DNA, 15 bp, Homo sapiens
aagaacccggggtga

SEQ ID NO: 32951 - DNA, 15 bp, Homo sapiens
gaagaacccggggtg

SEQ ID NO: 32952 - DNA, 15 bp, Homo sapiens
ggaagaacccggggt

SEQ ID NO: 32953 - DNA, 15 bp, Homo sapiens
gggaagaacccgggg

SEQ ID NO: 32954 - DNA, 15 bp, Homo sapiens
ggggaagaacccggg

SEQ ID NO: 32955 - DNA, 15 bp, Homo sapiens
tggggaagaacccgg

SEQ ID NO: 32956 - DNA, 15 bp, Homo sapiens
atggggaagaacccg

SEQ ID NO: 32957 - DNA, 15 bp, Homo sapiens
aatggggaagaaccc

SEQ ID NO: 32958 - DNA, 15 bp, Homo sapiens
aaatggggaagaacc

SEQ ID NO: 32959 - DNA, 15 bp, Homo sapiens
gaaatggggaagaac

SEQ ID NO: 32960 - DNA, 15 bp, Homo sapiens
tgaaatggggaagaa

SEQ ID NO: 32961 - DNA, 15 bp, Homo sapiens
atgaaatggggaaga

SEQ ID NO: 32962 - DNA, 15 bp, Homo sapiens
tatgaaatggggaag

SEQ ID NO: 32963 - DNA, 15 bp, Homo sapiens
ctatgaaatggggaa

SEQ ID NO: 32964 - DNA, 15 bp, Homo sapiens
tctatgaaatgggga

SEQ ID NO: 32965 - DNA, 15 bp, Homo sapiens
atctatgaaatgggg

SEQ ID NO: 32966 - DNA, 15 bp, Homo sapiens
aatctatgaaatggg

SEQ ID NO: 32967 - DNA, 15 bp, Homo sapiens
caatctatgaaatgg

SEQ ID NO: 32968 - DNA, 15 bp, Homo sapiens
ccaatctatgaaatg

SEQ ID NO: 32969 - DNA, 15 bp, Homo sapiens
cccaatctatgaaat

SEQ ID NO: 32970 - DNA, 15 bp, Homo sapiens
tcccaatctatgaaa

SEQ ID NO: 32971 - DNA, 15 bp, Homo sapiens
ttcccaatctatgaa

SEQ ID NO: 32972 - DNA, 15 bp, Homo sapiens
tttcccaatctatga

SEQ ID NO: 32973 - DNA, 15 bp, Homo sapiens
ctttcccaatctatg

SEQ ID NO: 32974 - DNA, 15 bp, Homo sapiens
actttcccaatctat

SEQ ID NO: 32975 - DNA, 15 bp, Homo sapiens
cactttcccaatcta

SEQ ID NO: 32976 - DNA, 15 bp, Homo sapiens
tcactttcccaatct

SEQ ID NO: 32977 - DNA, 15 bp, Homo sapiens
ctcactttcccaatc

SEQ ID NO: 32978 - DNA, 15 bp, Homo sapiens
cctcactttcccaat

SEQ ID NO: 32979 - DNA, 15 bp, Homo sapiens
acctcactttcccaa

SEQ ID NO: 32980 - DNA, 15 bp, Homo sapiens
cacctcactttccca

SEQ ID NO: 32981 - DNA, 15 bp, Homo sapiens
tcacctcactttccc

SEQ ID NO: 32982 - DNA, 15 bp, Homo sapiens
ttcacctcactttcc

SEQ ID NO: 32983 - DNA, 15 bp, Homo sapiens
tttcacctcactttc

SEQ ID NO: 32984 - DNA, 15 bp, Homo sapiens
atttcacctcacttt

SEQ ID NO: 32985 - DNA, 15 bp, Homo sapiens
gatttcacctcactt

SEQ ID NO: 32986 - DNA, 15 bp, Homo sapiens
tgatttcacctcact

SEQ ID NO: 32987 - DNA, 15 bp, Homo sapiens
gtgatttcacctcac

SEQ ID NO: 32988 - DNA, 15 bp, Homo sapiens
agtgatttcacctca

SEQ ID NO: 32989 - DNA, 15 bp, Homo sapiens
aagtgatttcacctc

SEQ ID NO: 32990 - DNA, 15 bp, Homo sapiens
gaagtgatttcacct

SEQ ID NO: 32991 - DNA, 15 bp, Homo sapiens
ggaagtgatttcacc

SEQ ID NO: 32992 - DNA, 15 bp, Homo sapiens
gggaagtgatttcac

SEQ ID NO: 32993 - DNA, 15 bp, Homo sapiens
agggaagtgatttca

SEQ ID NO: 32994 - DNA, 15 bp, Homo sapiens
cagggaagtgatttc

SEQ ID NO: 32995 - DNA, 15 bp, Homo sapiens
ccagggaagtgattt

SEQ ID NO: 32996 - DNA, 15 bp, Homo sapiens
cccagggaagtgatt

SEQ ID NO: 32997 - DNA, 15 bp, Homo sapiens
tcccagggaagtgat

SEQ ID NO: 32998 - DNA, 15 bp, Homo sapiens
atcccagggaagtga

SEQ ID NO: 32999 - DNA, 15 bp, Homo sapiens
gatcccagggaagtg

SEQ ID NO: 33000 - DNA, 15 bp, Homo sapiens
ggatcccagggaagt

SEQ ID NO: 33001 - DNA, 15 bp, Homo sapiens
gggatcccagggaag

SEQ ID NO: 33002 - DNA, 15 bp, Homo sapiens
tgggatcccagggaa

SEQ ID NO: 33003 - DNA, 15 bp, Homo sapiens
atgggatcccaggga

SEQ ID NO: 33004 - DNA, 15 bp, Homo sapiens
tatgggatcccaggg

SEQ ID NO: 33005 - DNA, 15 bp, Homo sapiens
ctatgggatcccagg

SEQ ID NO: 33006 - DNA, 15 bp, Homo sapiens
cctatgggatcccag

SEQ ID NO: 33007 - DNA, 15 bp, Homo sapiens
tcctatgggatccca

SEQ ID NO: 33008 - DNA, 15 bp, Homo sapiens
ttcctatgggatccc

SEQ ID NO: 33009 - DNA, 15 bp, Homo sapiens
cttcctatgggatcc

SEQ ID NO: 33010 - DNA, 15 bp, Homo sapiens
ccttcctatgggatc

SEQ ID NO: 33011 - DNA, 15 bp, Homo sapiens
gccttcctatgggat

SEQ ID NO: 33012 - DNA, 15 bp, Homo sapiens
tgccttcctatggga

SEQ ID NO: 33013 - DNA, 15 bp, Homo sapiens
atgccttcctatggg

SEQ ID NO: 33014 - DNA, 15 bp, Homo sapiens
aatgccttcctatgg

SEQ ID NO: 33015 - DNA, 15 bp, Homo sapiens
caatgccttcctatg

SEQ ID NO: 33016 - DNA, 15 bp, Homo sapiens
acaatgccttcctat

SEQ ID NO: 33017 - DNA, 15 bp, Homo sapiens
cacaatgccttccta

SEQ ID NO: 33018 - DNA, 15 bp, Homo sapiens
acacaatgccttcct

SEQ ID NO: 33019 - DNA, 15 bp, Homo sapiens
aacacaatgccttcc

SEQ ID NO: 33020 - DNA, 15 bp, Homo sapiens
aaacacaatgccttc

SEQ ID NO: 33021 - DNA, 15 bp, Homo sapiens
aaaacacaatgcctt

SEQ ID NO: 33022 - DNA, 15 bp, Homo sapiens
gaaaacacaatgcct

SEQ ID NO: 33023 - DNA, 15 bp, Homo sapiens
tgaaaacacaatgcc

SEQ ID NO: 33024 - DNA, 15 bp, Homo sapiens
atgaaaacacaatgc

SEQ ID NO: 33025 - DNA, 15 bp, Homo sapiens
tatgaaaacacaatg

SEQ ID NO: 33026 - DNA, 15 bp, Homo sapiens
ttatgaaaacacaat

SEQ ID NO: 33027 - DNA, 15 bp, Homo sapiens
attatgaaaacacaa

SEQ ID NO: 33028 - DNA, 15 bp, Homo sapiens
tattatgaaaacaca

SEQ ID NO: 33029 - DNA, 15 bp, Homo sapiens
atattatgaaaacac

SEQ ID NO: 33030 - DNA, 15 bp, Homo sapiens
tatattatgaaaaca

SEQ ID NO: 33031 - DNA, 15 bp, Homo sapiens
atatattatgaaaac

SEQ ID NO: 33032 - DNA, 15 bp, Homo sapiens
aatatattatgaaaa

SEQ ID NO: 33033 - DNA, 15 bp, Homo sapiens
gaatatattatgaaa

SEQ ID NO: 33034 - DNA, 15 bp, Homo sapiens
tgaatatattatgaa

SEQ ID NO: 33035 - DNA, 15 bp, Homo sapiens
gtgaatatattatga

SEQ ID NO: 33036 - DNA, 15 bp, Homo sapiens
tgtgaatatattatg

SEQ ID NO: 33037 - DNA, 15 bp, Homo sapiens
atgtgaatatattat

SEQ ID NO: 33038 - DNA, 15 bp, Homo sapiens
catgtgaatatatta

SEQ ID NO: 33039 - DNA, 15 bp, Homo sapiens
tcatgtgaatatatt

SEQ ID NO: 33040 - DNA, 15 bp, Homo sapiens
gtcatgtgaatatat

SEQ ID NO: 33041 - DNA, 15 bp, Homo sapiens
agtcatgtgaatata

SEQ ID NO: 33042 - DNA, 15 bp, Homo sapiens
aagtcatgtgaatat

SEQ ID NO: 33043 - DNA, 15 bp, Homo sapiens
gaagtcatgtgaata

SEQ ID NO: 33044 - DNA, 15 bp, Homo sapiens
tgaagtcatgtgaat

SEQ ID NO: 33045 - DNA, 15 bp, Homo sapiens
ttgaagtcatgtgaa

SEQ ID NO: 33046 - DNA, 15 bp, Homo sapiens
tttgaagtcatgtga

SEQ ID NO: 33047 - DNA, 15 bp, Homo sapiens
atttgaagtcatgtg

SEQ ID NO: 33048 - DNA, 15 bp, Homo sapiens
aatttgaagtcatgt

SEQ ID NO: 33049 - DNA, 15 bp, Homo sapiens
gaatttgaagtcatg

SEQ ID NO: 33050 - DNA, 15 bp, Homo sapiens
tgaatttgaagtcat

SEQ ID NO: 33051 - DNA, 15 bp, Homo sapiens
ttgaatttgaagtca

SEQ ID NO: 33052 - DNA, 15 bp, Homo sapiens
tttgaatttgaagtc

SEQ ID NO: 33053 - DNA, 15 bp, Homo sapiens
ttttgaatttgaagt

SEQ ID NO: 33054 - DNA, 15 bp, Homo sapiens
tttttgaatttgaag

SEQ ID NO: 33055 - DNA, 15 bp, Homo sapiens
ctttttgaatttgaa

SEQ ID NO: 33056 - DNA, 15 bp, Homo sapiens
gctttttgaatttga

SEQ ID NO: 33057 - DNA, 15 bp, Homo sapiens
tgctttttgaatttg

SEQ ID NO: 33058 - DNA, 15 bp, Homo sapiens
gtgctttttgaattt

SEQ ID NO: 33059 - DNA, 15 bp, Homo sapiens
tgtgctttttgaatt

SEQ ID NO: 33060 - DNA, 15 bp, Homo sapiens
gtgtgctttttgaat

SEQ ID NO: 33061 - DNA, 15 bp, Homo sapiens
tgtgtgctttttgaa

SEQ ID NO: 33062 - DNA, 15 bp, Homo sapiens
ttgtgtgctttttga

SEQ ID NO: 33063 - DNA, 15 bp, Homo sapiens
attgtgtgctttttg

SEQ ID NO: 33064 - DNA, 15 bp, Homo sapiens
cattgtgtgcttttt

SEQ ID NO: 33065 - DNA, 15 bp, Homo sapiens
ccattgtgtgctttt

SEQ ID NO: 33066 - DNA, 15 bp, Homo sapiens
gccattgtgtgcttt

SEQ ID NO: 33067 - DNA, 15 bp, Homo sapiens
tgccattgtgtgctt

SEQ ID NO: 33068 - DNA, 15 bp, Homo sapiens
atgccattgtgtgct

SEQ ID NO: 33069 - DNA, 15 bp, Homo sapiens
tatgccattgtgtgc

SEQ ID NO: 33070 - DNA, 15 bp, Homo sapiens
ctatgccattgtgtg

SEQ ID NO: 33071 - DNA, 15 bp, Homo sapiens
tctatgccattgtgt

SEQ ID NO: 33072 - DNA, 15 bp, Homo sapiens
ttctatgccattgtg

SEQ ID NO: 33073 - DNA, 15 bp, Homo sapiens
attctatgccattgt

SEQ ID NO: 33074 - DNA, 15 bp, Homo sapiens
cattctatgccattg

SEQ ID NO: 33075 - DNA, 15 bp, Homo sapiens
ccattctatgccatt

SEQ ID NO: 33076 - DNA, 15 bp, Homo sapiens
tccattctatgccat

SEQ ID NO: 33077 - DNA, 15 bp, Homo sapiens
ttccattctatgcca

SEQ ID NO: 33078 - DNA, 15 bp, Homo sapiens
tttccattctatgcc

SEQ ID NO: 33079 - DNA, 15 bp, Homo sapiens
ctttccattctatgc

SEQ ID NO: 33080 - DNA, 15 bp, Homo sapiens
cctttccattctatg

SEQ ID NO: 33081 - DNA, 15 bp, Homo sapiens
ccctttccattctat

SEQ ID NO: 33082 - DNA, 15 bp, Homo sapiens
accctttccattcta

SEQ ID NO: 33083 - DNA, 15 bp, Homo sapiens
aaccctttccattct

SEQ ID NO: 33084 - DNA, 15 bp, Homo sapiens
aaaccctttccattc

SEQ ID NO: 33085 - DNA, 15 bp, Homo sapiens
caaaccctttccatt

SEQ ID NO: 33086 - DNA, 15 bp, Homo sapiens
ccaaaccctttccat

SEQ ID NO: 33087 - DNA, 15 bp, Homo sapiens
cccaaaccctttcca

SEQ ID NO: 33088 - DNA, 15 bp, Homo sapiens
gcccaaaccctttcc

SEQ ID NO: 33089 - DNA, 15 bp, Homo sapiens
ggcccaaaccctttc

SEQ ID NO: 33090 - DNA, 15 bp, Homo sapiens
tggcccaaacccttt

SEQ ID NO: 33091 - DNA, 15 bp, Homo sapiens
ctggcccaaaccctt

SEQ ID NO: 33092 - DNA, 15 bp, Homo sapiens
actggcccaaaccct

SEQ ID NO: 33093 - DNA, 15 bp, Homo sapiens
gactggcccaaaccc

SEQ ID NO: 33094 - DNA, 15 bp, Homo sapiens
tgactggcccaaacc

SEQ ID NO: 33095 - DNA, 15 bp, Homo sapiens
gtgactggcccaaac

SEQ ID NO: 33096 - DNA, 15 bp, Homo sapiens
agtgactggcccaaa

SEQ ID NO: 33097 - DNA, 15 bp, Homo sapiens
aagtgactggcccaa

SEQ ID NO: 33098 - DNA, 15 bp, Homo sapiens
gaagtgactggccca

SEQ ID NO: 33099 - DNA, 15 bp, Homo sapiens
ggaagtgactggccc

SEQ ID NO: 33100 - DNA, 15 bp, Homo sapiens
gggaagtgactggcc

SEQ ID NO: 33101 - DNA, 15 bp, Homo sapiens
agggaagtgactggc

SEQ ID NO: 33102 - DNA, 15 bp, Homo sapiens
gagggaagtgactgg

SEQ ID NO: 33103 - DNA, 15 bp, Homo sapiens
agagggaagtgactg

SEQ ID NO: 33104 - DNA, 15 bp, Homo sapiens
cagagggaagtgact

SEQ ID NO: 33105 - DNA, 15 bp, Homo sapiens
ccagagggaagtgac

SEQ ID NO: 33106 - DNA, 15 bp, Homo sapiens
gccagagggaagtga

SEQ ID NO: 33107 - DNA, 15 bp, Homo sapiens
cgccagagggaagtg

SEQ ID NO: 33108 - DNA, 15 bp, Homo sapiens
acgccagagggaagt

SEQ ID NO: 33109 - DNA, 15 bp, Homo sapiens
aacgccagagggaag

SEQ ID NO: 33110 - DNA, 15 bp, Homo sapiens
caacgccagagggaa

SEQ ID NO: 33111 - DNA, 15 bp, Homo sapiens
tcaacgccagaggga

SEQ ID NO: 33112 - DNA, 15 bp, Homo sapiens
ctcaacgccagaggg

SEQ ID NO: 33113 - DNA, 15 bp, Homo sapiens
cctcaacgccagagg

SEQ ID NO: 33114 - DNA, 15 bp, Homo sapiens
acctcaacgccagag

SEQ ID NO: 33115 - DNA, 15 bp, Homo sapiens
cacctcaacgccaga

SEQ ID NO: 33116 - DNA, 15 bp, Homo sapiens
gcacctcaacgccag

SEQ ID NO: 33117 - DNA, 15 bp, Homo sapiens
agcacctcaacgcca

SEQ ID NO: 33118 - DNA, 15 bp, Homo sapiens
gagcacctcaacgcc

SEQ ID NO: 33119 - DNA, 15 bp, Homo sapiens
tgagcacctcaacgc

SEQ ID NO: 33120 - DNA, 15 bp, Homo sapiens
atgagcacctcaacg

SEQ ID NO: 33121 - DNA, 15 bp, Homo sapiens
catgagcacctcaac

(The sequence listing continues in the following parts.)

What is claimed is:

1. A single stranded oligonucleotide produced by a process comprising:
   synthesizing a single stranded oligonucleotide that:
   (a) has a sequence 5'-X-Y-Z, wherein X is any nucleotide, Y is a nucleotide sequence of 6 nucleotides in length that is not a seed sequence of a human microRNA, and Z is a nucleotide sequence of 8-23 nucleotides in length,
   (b) is complementary with at least 15 consecutive nucleotides of a PRC2-associated region of a human ATP2A2 gene, wherein the PRC2-associated region is a region of the ATP2A2 gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the ATP2A2 gene compared to a control sequencing reaction of products of a control RNA-immunoprecipitation assay that employs a control antibody; and
   (c) does not comprise three or more consecutive guanosine nucleotides;
   wherein, during the synthesis, at least one nucleotide incorporated into the oligonucleotide is a nucleotide analogue.

2. The single stranded oligonucleotide of claim 1, wherein the oligonucleotide does not comprise four or more consecutive guanosine nucleotides.

3. The single stranded oligonucleotide of claim 1, wherein the oligonucleotide is 15 to 30 nucleotides in length.

4. The single stranded oligonucleotide of claim 1, wherein the at least one nucleotide analogue results in an increase in Tm of the oligonucleotide in a range of 1 to 5° C. compared with an oligonucleotide that does not have the at least one nucleotide analogue.

5. The single stranded oligonucleotide of claim 1, wherein at least one nucleotide of the oligonucleotide comprises a 2' O-methyl.

6. The single stranded oligonucleotide of claim 1, wherein each nucleotide of the oligonucleotide comprises a 2' O-methyl.

7. The single stranded oligonucleotide of claim 1, wherein the oligonucleotide comprises at least one ribonucleotide, at least one deoxyribonucleotide, or at least one bridged nucleotide.

8. The single strand oligonucleotide of claim 7, wherein the bridged nucleotide is a LNA nucleotide, a cEt nucleotide or a ENA modified nucleotide.

9. The single stranded oligonucleotide of claim 1, wherein each nucleotide of the oligonucleotide is a LNA nucleotide.

10. The single stranded oligonucleotide of claim 1, wherein the nucleotides of the oligonucleotide comprise alternating deoxyribonucleotides and 2'-fluoro-deoxyribonucleotides.

11. The single stranded oligonucleotide of claim 1, wherein the nucleotides of the oligonucleotide comprise alternating deoxyribonucleotides and 2'-O-methyl nucleotides.

12. The single stranded oligonucleotide of claim 1, wherein the nucleotides of the oligonucleotide comprise alternating deoxyribonucleotides and ENA nucleotide analogues.

13. The single stranded oligonucleotide of claim 1, wherein the nucleotides of the oligonucleotide comprise alternating deoxyribonucleotides and LNA nucleotides.

14. The single stranded oligonucleotide claim 10, wherein the 5' nucleotide of the oligonucleotide is a deoxyribonucleotide.

15. The single stranded oligonucleotide of claim 1, wherein the nucleotides of the oligonucleotide comprise alternating LNA nucleotides and 2'-O-methyl nucleotides.

16. The single stranded oligonucleotide of claim 15, wherein the 5' nucleotide of the oligonucleotide is a LNA nucleotide.

17. The single stranded oligonucleotide of claim 1, wherein the nucleotides of the oligonucleotide comprise deoxyribonucleotides flanked by at least one LNA nucleotide on each of the 5' and 3' ends of the deoxyribonucleotides.

18. The single stranded oligonucleotide of claim 1, further comprising phosphorothioate internucleotide linkages between at least two nucleotides.

19. The single stranded oligonucleotide of claim 18, further comprising phosphorothioate internucleotide linkages between all nucleotides.

20. The single stranded oligonucleotide of claim 1, wherein the nucleotide at the 3' position of the oligonucleotide has a 3' hydroxyl group.

21. The single stranded oligonucleotide of claim 1, wherein the nucleotide at the 3' position of the oligonucleotide has a 3' thiophosphate.

22. The single stranded oligonucleotide of claim 1, further comprising a biotin moiety conjugated to the 5' nucleotide.

23. A single stranded oligonucleotide produced by a process comprising:
synthesizing a single stranded oligonucleotide that:
(a) comprises a region of complementarity that is complementary with at least 15 consecutive nucleotides of a PRC2-associated region of a human ATP2A2 gene, wherein the PRC2-associated region is a region of the ATP2A2 gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the ATP2A2 gene compared to a control sequencing reaction of products of a control RNA-immunoprecipitation assay that employs a control antibody;
(b) does not comprise three or more consecutive guanosine nucleotides and has at least one of:
  i) a sequence that is 5'X-Y-Z, wherein X is any nucleotide and wherein X is anchored at the 5' end of the oligonucleotide, Y is a nucleotide sequence of 6 nucleotides in length that is not a human seed sequence of a microRNA, and Z is a nucleotide sequence of 8 to 23 nucleotides in length;
  ii) a sequence that is complementary to a PRC2-associated region that encodes an RNA that forms a secondary structure comprising at least two single stranded loops; and/or
  iii) a sequence that has greater than 60% G-C content
wherein, during the synthesis, at least one nucleotide incorporated into the oligonucleotide is a nucleotide analogue.

24. The single stranded oligonucleotide of claim 23, wherein the oligonucleotide has the sequence 5'X-Y-Z and wherein the oligonucleotide is 15-50 nucleotides in length.

25. A composition comprising a single stranded oligonucleotide of claim 1 and a carrier.

26. A composition comprising a single stranded oligonucleotide of claim 1 in a buffered solution.

27. A composition of claim 25, wherein the oligonucleotide is conjugated to the carrier.

28. The composition of claim 27, wherein the carrier is a peptide.

29. The composition of claim 27, wherein the carrier is a steroid.

30. A pharmaceutical composition comprising a composition of claim 25 and a pharmaceutically acceptable carrier.

31. A kit comprising a container housing the composition of claim 25.

* * * * *